United States Patent 12,569,549 (FLAVIVIRUS VACCINE) - sequence listing, part 40

SEQ ID NO: 15053 - RNA, 9876 nt, synthetic construct
  misc_feature 1..9876: note = derived and/or modified CDS sequence (opt3) from DENV-2__DQ645551__SS-prME
  source 1..9876: mol_type = other RNA
accgcaggagtgatcattatgatgatacccaccgtagttgctttccacctgactacgcggaatggggagcctcatatgatcgtgagcaggcaggaaaagggaaaatccctcctttttaagaccgagaatggtgtaaatatgtgcacactgatggcaatggacttgggagaattatgtgaggatactattacctacaattgcccactgctgcggcaaaacgaaccggaggacatcgattgttggtgcaattctacatcaacctgggtgacttatgggacatgtaccgccacgggagagcaccgccgagaaaaacgtagtgtcgcgctcgtgccccatgttggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagaaggggtttcaggaggtagctgggtggatatagtcctggagcacggcagttgtgtgaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtcgacagaggatggggcaacggttgtgggctgttcggaaagggcggcattgttacttgcgctatgtttacctgcaagaaaaatatggaggggaaggtggtacagcctgaaaacctagagtatacaatcgtgatcaccccacactccggagaagagaatgccgtcggtaacgatactggcaaacatgggaaggagattaaagtgacgccgcagtcaagtataacagaagcagagctcaccggatacggcactgttaccatggaatgtagccccaggacaggtctggacttcaatgagatggtgcttctgcagatggaagataaggcttggttggtccaccggcaatggtttctcgacctgcctttaccatggctgcccggggccgatacccagggctctaactggatccagaaagagactctcgtgacattcaagaaccctcacgcgaagaaacaggacgtagttgtgcttggatcccaagagggcgccatgcatacggcactgaccggggctactgaaattcagatgtcaagcggaaatttgctatttacaggtcacctgaagtgccgtctccgcatggacaaactgcagcttaagggcatgagttattctatgtgtaccgggaaattcaaggtcgtgaaggagatcgccgaaacacaacatggaactatagtcattagagtgcagtacgagggcgatggttccccatgcaaaatccccttcgagatcatggacctggaaaagaggcacgttttggggcggctcattaccgtgaacccgatcgtaacggagaaagatagccctgtcaatattgaagctgagcccccatttggcgactcgtacataatcattggagtggaacctggccagctgaagttatcttggttcaaaaaggggtcctcaatcggacagatgtttgagaccacaatgcgaggtgccaagcgcatggcaatcctgggcgatactgcctgggacttcgggagtctaggaggcgtttttaccagcattggtaaagctctccatcaagtgttcggggcgatatatggcgcagccttttccggagtctcttggacaatgaagatcctgattggcgtggtaatcacttggattgggatgaacagcagatcaaccagtctttccgtgagcttggttctggtcggagtggtgacgctctacctgggcgtcatggttcaggctgattctggttgtgtggtgtcatggaaaaataaggagcttaaatgcgggagtggaatcttcataacagacaacgtacacacctggactgaacagtataagtttcagcccgagagcccatccaagctggcctctgcaatccaaaaagcccacgaagagggcatttgtggtatcaggtcggtcacacggttggaaaatctcatgtggaagcagattacccccgagctgaaccatatcttaagcgagaatgaagtgaaactgactataatgaccggcgatattaaggggatcatgcaggctggaaaacgctccctaagacctcagccaacagagctcaagtactcatggaaagcctggggcaaggcaaagatgctgagtacggaacttcacaaccataccttcttgattgacgggccggagactgcggaatgccccaatacaaacagggcttggaactctctggaggttgaggattatggatttggcgtgttcaccacaaacatctggctcaaactgaaggaacgtcaagacgtcttttgtgacagcaaattaatgtccgccgcaataaaggataatcgggccgtgcacgctgacatgggttactggatcgagtcagccctgaacgatacttggaaaattgaaaaggccagcttcatcgaggttaagtcttgccactggcctaaatcccataccctttggagtaacggggtgttggagagcgaaatgattatcccaaagaatttcgctggacccgtatctcagcacaactatcgacctggctaccatacgcagacagccggtccatggcacctcggcaaactggagatggactttgatttctgtgaagggaccactgtcgtggtgaccgaggactgcggaaatagaggcccctccctaaggacaactaccgcgtcagggaagctgataacagaatggtgctgtcgcagttgcacgctcccgcctctgcggtacagaggagaggatggctgttggtatggtatggagattaggccacttaaagaaaaggaggaaaacttggtcaatagcctggttaccgccgggcatggacagatcgacaacttttcgttaggcgtgctcggtatggctctgttccttgaggaaatgctgcgcactcgagtaggcacaaagcacgcaatcttgctcgtggccgtctcctttgtgaccctgattactgggaatatgtctttccgggatctaggacgtgttatggtgatggtcggcgctacaatgaccgacgatatcgggatgggagtgacgtacctggccctcctggcagcgtttaaagttagacccactttcgccgctggccttttgctgaggaagttaaccagcaaagagctcatgatgacaaccattggtatagtgctgctttcacaaagtactatccctgagacaattctggaactaaccgacgccctcgcactggggatgatggtcttgaagatcgtacgcaacatggagaaatatcagctggctgtgacaattatggccatcttatgcgttcccaatgcagtgatactccagaacgcctggaaggtctcctgtactatcctggctgtggtatctgtgagcccacttctgttgacctcctcacaacagaaggcggattggattcctctcgccctgacgatcaaaggactaaatcccacagcaatttttctgaccactcttagccggaccagtaagaaaagatcttggccactcaacgaagctatcatggccgtcggcatggtttccatactggccagctcgttgctgaagaatgacattccgatgacaggccctttagtggctgggggactcctgactgtgtgctacgtccttaccggtaggtcagcagacctggagttggaacgagccgcggatgtgcgctgggaggagcaggctgaaatctctggcagttcccccatcctcagcattacgatatctgaggacgggagcatgtccatcaaaaacgaagaggaggaacagacactgaccattctaatccggactggactgcttgttatttcaggcctcttcccagtaagtatccccataacagccgcagcctggtatctgtgggaggtgaagaaacaaagagctggtgtcttgtgggatgtgcctagcccaccccctgttgggaaggcagaattagaggacggagcctacaggatcaagcagaaaggcattctgggctattctcagatcggggcgggagtgtacaaggaaggtacctttcacactatgtggcatgtcacacgtggcgctgtgctcatgcacaaagggaagcgcattgagccgtcctgggccgatgtcaagaaggacctgatctcatacggaggcggttggaaacttgagggggaatggaaagagggagaagaggtccaggtgctggcattggaaccaggcaagaatccccgggccgttcaaaccaaacctggcctattcaagacgaacactgggaccataggagctgtgagtctggattttagcccaggtacatccggctctcccattgtcgacaaaaaggggaaggtggttggactctatggcaacggtgtggtcaccagatcggggacatacgtgagcgccatcgcacagactgagaaatcaatcgaggataatcctgaaattgaggacgatatcttcaggaagaaacgactgaccataatggaccttcatccgggagctggcaagacgaaacggtatttacccgccattgtacgcgaagcgatcaagagaggcctgaggacactcattttggccccaactcgggtggttgcagctgagatggaagaggccctgcgagggctccctatcagataccagacccccgctatacgcgcagagcacacaggaagggaaattgtcgatctgatgtgtcatgccaccttcactatgcgtcttctgtccccaatccgggtgcctaactataatttgatcattatggacgaggcccactttaccgaccccgctagtatcgcggcaagaggttacatttctacaagggtggaaatgggcgaggccgctgggatattcatgacggccactccaccgggaagccgcgatccttttccccagtccaacgcaccaatcatggacgaggaacgagagattcccgaaagatcatggaactctggccacgagtgggtcaccgatttcaagggtaaaacagtatggtttgtgcctagcatcaaggccgggaacgacatcgctgcgtgcctacggaaaaatggaaagaaagttattcaactgagtaggaagaccttcgattccgaatatgtgaagactcgcacaaacgactgggattttgtcgtgaccacggacataagcgagatgggcgccaatttcaaagcagagcgtgttatcgatccaagacggtgtatgaagcccgtgattctcactgacggcgaagagagggtcatcttagctgggcctatgccggtgacacattcttcagccgcacagcgccgaggaagagtaggtcggaaccccaagaatgaaaacgatcagtacatttacatgggcgagcccctggaaaatgacgaggactgcgcccactggaaggaggctaaaatgcttctggataacatcaatacccctgaagggataatcccctccatgtttgagccagaaagggagaaggtggacgccattgatggagaatatcgcctcagaggcgaggcgaggaaaaccttcgttgacttgatgcggcgtggtgatctgcctgtctggctcgcataccgcgtggccgctgaggggatcaactatactgaccgaagatggtgttttgatggcgtgaagaacaatcaaattctggaagagaacgtcgaagttgagatctggacaaaggagggagaaaggaagaaacttaaaccccggtggctagacgcccgcatatacagtgatccactggctttgaaagagttcaaagagttcgcagccggcagaaagagcttaaccctgaatctcattacagagatggggaggctgcctacttttatgacgcagaaggctcggaacgcccttgacaatctggcagtgctccataccgcggaagccggaggtcgagcttataaccacgccttgtcggagctgccggagacactagaaactctgctccttctgaccttattggcaacagtaaccggcgggatcttcctgtttctcatgtctggaaaaggcattggtaagatgactctggggatgtgctgcatcataacggcttccgtgcttctgtggtacgcccagatccagccccactggattgcagccagcatcattctcgagttctttttgatcgtcctgttaataccagaacctgagaaacaaagaacaccacaggataatcagctaacatatgtggttattgctatcctgactgtggtcgcggccaccatggcaaacgaaatgggcttcctcgagaagaccaagaaggactttggacttggcgggatcgctacccagcaaccagagtcaaatattctggatatcgacttgcgccctgccagtgcctggactctgtacgcagtagctacaacgttcataacccccatgctcaggcattctattgaaaactccagcgtgaatgtttcactgactgccatcgcgaaccaggctacagtgcttatgggactcggtaagggctggccgctgagtaaaatggacattggggtcccattgctggccatcggatgttacagccaggtgaatcctataaccttaaccgcagccctactgctccttgtcgctcactatgcaatcattggccccggtctgcaggccaaggcgacacgggaggctcaaaaacgtgccgcagccgggatcatgaagaacccaactgtggatggcattacggttatcgacttggatcccattccttacgacccgaaatttgaaaagcagctgggacaggtgatgctcctggtactttgcgtgacccaggtcttaatgatgagaacaacttgggctctgtgtgaggccctcaccttggcaacaggccccatctccaccctgtgggaagggaatccaggaaggttctggaacactacgatagctgtttctatggccaatatttttcgcggcagctatctagcgggtgccgggctactcttctccatcatgaagaacacagcaaacacccggcgaggaactggcaataccggtgagacacttggcgagaaatggaagaacagactgaatgctttggggaaatcagaatttcaaatctacaagaaatctggcattcaggaggtggataggactctggccaaggaaggcataaaacgcggggagaccgaccatcacgcagtcagtcggggatcggctaagctcagatggttcgtggagcgtaacctggtaacacctgaaggcaaggtgatggatttaggttgcgggaggggaggctggagctattactgtggtggccttaaaaatgttaaggaggtgaaagggctgacgaagggaggccccgggcatgaagaacctatcccaatgtccacctatggatggaacctcgtccggctacagtctggcgtggacgtcttctttactccccctgaaaaatgcgatacactgttgtgtgacattggtgagtcaagcccaaatcccaccgtggaggccgggcgcactctgcgagttctcaaccttgtagaaaattggctgaacaataacacacaattctgcatcaaggtgttgaatccgtacatgccttccgtcattgagaagatggaagccctgcagagaaaatacggaggcgcgctcgtgaggaacccattaagtagaaattctacccacgagatgtattgggttagcaacgcttcaggcaacatcgtgtccagtgtcaatatgataagccgcatgctgatcaacagatttacgatgaggcacaagaaagcaacctacgaacccgatgtggaccttgggtctggaacacgaaatattggtatcgagtccgagactcctaacctggatattatcggcaagcggatagagaaaattaagcaggaacatgaaacctcatggcactatgaccaggaccatccatacaagacatgggcctatcacgggagctacgagactaaacaaaccggatcggcttctagtatggtaaatggcgtggttcgtctactcacaaagccctgggatgtcatcccgatggtgacccagatggccatgactgacacgacacctttcggtcagcagagagtgtttaaagaaaaggtcgatacccgcactcaagagcccaaagaggggaccaagaagctgatgaaaatcacagcagaatggttgtggaaggagctgggcaagaagaaaacgccaaggatgtgtacccgggaagagttcactagaaaggttcgctccaacgccgctctcggcgcgatttttacagacgagaataaatggaaaagcgccagggaagcagtggaggattcaggcttctgggaacttgtagacaaggagcgaaacctgcacttagaagggaaatgcgagacctgtgtgtataatatgatgggaaagcgggagaaaaagctgggtgaatttggcaaagctaaggggtccagagccatatggtacatgtggttgggagcaaggttcctcgagtttgaagccctgggcttcctaaacgaggatcattggttttctcgcgaaaatagccttagtggtgtcgagggggagggactgcacaagctcggctacatcctgcgtgacgtgtccaaaaaggaaggcggggctatgtatgccgatgacactgcgggatgggatacacggattaccttggaggacctgaaaaacgaagagatggttacaaatcatatggaaggtgagcacaagaaactcgcagaggccatcttcaaacttacttaccagaacaaggtggtcagagtgcagaggcctacaccccgcggcacggtaatggacattatcagccgacgggatcagagagggtctggacaagttgtgacctatggcctgaatacattcactaacatggaagctcagttaataaggcagatggagggtgaaggggtctttaaatcaatccaacagctgaccgccacagaggagattgcagtgaagaactggttggctcgcgtgggaagagaacggctcagtaggatggccatctccggcgacgattgcgtcgttaaaccactggacgatcgtttcgctagcgccctaactgcacttaatgacatgggcaaggtgcgaaaagatattcagcagtgggagccctctcgcgggtggaacgactggacccaagtacctttttgctcgcatcacttccacgaactgatcatgaaggatggaagagtgctcgtcgtgccatgtcggaatcaggacgagctgattggtagggcgcgcatatcacagggcgccgggtggagcttgagagaaacggcttgcttaggaaagtcctacgcccagatgtggagtctgatgtattttcatcggagggatctccgacttgcagctaacgccatctgttctgcagttccgagccactgggtgcccacatcccgtaccacttggtcaattcatgccacacacgagtggatgaccactgaggacatgctgaccgtctggaatagagtgtggatccaagaaaacccttggatcgaggataaaacaccagtagaaagttgggaggaaattccctacctaggcaagcgcgaggaccagtggtgcggttctctgatagggctcacgagccgggcgacctgggctaaaaatatccagactgccattaaccaggttaggtccttgatcggaaatgaggaatatacagactacatgccttcaatgaagagattccgccgggaggaagaggaagcaggcgtgctgtggtga

SEQ ID NO: 15054 - RNA, 9876 nt, synthetic construct
  misc_feature 1..9876: note = derived and/or modified CDS sequence (opt3) from DENV-2__DQ645552__SS-prME
  source 1..9876: mol_type = other RNA
accgcaggagtgatcattatgatgatacccaccgtagttgctttccacctgactacgcggaatggggagcctcatatgatcgtgagcaggcaggaaaagggaaagtccctcctttttaagaccgagaatggtgtaaatatgtgcacactgatggcaatggacttgggagaattatgtgaggatactattacctacaattgcccactgctgcggcaaaacgaaccggaggacatcgattgttggtgcaattctacatcaacctgggtgacttatgggacatgtaccgccacgggagagcaccgccgagaaaaacgtagtgtcgcgctcgtgccccatgttggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagaaggggtttcaggaggtagctgggtggatatagtcctggagcacggcagttgtgtgaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtcgacagaggatggggcaacggttgtgggctgttcggaaagggcggcattgttacttgcgctatgtttacctgcaagaaaaatatggaggggaaggtggtacagcctgaaaacctagagtatacaatcgtgatcaccccacactccggagaagagaatgccgtcggtaacgatactggcaaacatgggaaggagattaaagtgacgccgcagtcaagtataacagaagcagagctcaccggatacggcactgttaccatggaatgtagccccaggacaggtctggacttcaatgagatggtgcttctgcagatggaagataaggcttggttggtccaccggcaatggtttctcgacctgcctttaccatggctgcccggggccgatacccagggctctaactggatccagaaagagactctcgtgacattcaagaaccctcacgcgaagaaacaggacgtagttgtgcttggatcccaagagggcgccatgcatacggcactgaccggggctactgaaattcagatgtcaagcggaaatttgctatttacaggtcacctgaagtgccgtctccgcatggacaaactgcagcttaagggcatgagttattctatgtgtaccgggaaattcaaggtcgtgaaggagatcgccgaaacacaacatggaactatagtcattagagtgcagtacgagggcgatggttccccatgcaaaatccccttcgagatcatggacctggaaaagaggcacgttttggggcggctcattaccgtgaacccgatcgtaacggagaaagatagccctgtcaatattgaagctgagcccccatttggcgactcgtacataatcattggagtggaacctggccagctgaagttatcttggttcaaaaaggggtcctcaatcggacagatgtttgagaccacaatgcgaggtgccaagcgcatggcaatcctgggcgatactgcctgggacttcgggagtctaggaggcgtttttaccagcattggtaaagctctccatcaagtgttcggggcgatatatggcgcagccttttccggagtctcttggacaatgaagatcctgattggcgtggtaatcacttggattgggatgaacagcagatcaaccagtctttccgtgagcttggttctggtcggagtggtgacgctctacctgggcgtcatggttcaggctgattctggttgtgtggtgtcatggaaaaataaggagcttaaatgcgggagtggaatcttcataacagacaacgtacacacctggactgaacagtataagtttcagcccgagagcccatccaagctggcctctgcaatccaaaaagcccacgaagagggcatttgtggtatcaggtcggtcacacggttggaaaatctcatgtggaagcagattacccccgagctgaaccatatcttaagcgagaatgaagtgaaactgactataatgaccggcgatattaaggggatcatgcaggctggaaaacgctccctaagacctcagccaacagagctcaagtactcatggaaagcctggggcaaggcaaagatgctgagtacggaacttcacaaccataccttcttgattgacgggccggagactgcggaatgccccaatacaaacagggcttggaactctctggaggttgaggattatggatttggcgtgttcaccacaaacatctggctcaaactgaaggaacgtcaagacgtcttttgtgacagcaaattaatgtccgccgcaataaaggataatcgggccgtgcacgctgacatgggttactggatcgagtcagccctgaacgatacttggaaaattgaaaaggccagcttcatcgaggttaagtcttgccactggcctaaatcccataccctttggagtaacggggtgttggagagcgaaatgattatcccaaagaatttcgctggacccgtatctcagcacaactatcgacctggctaccatacgcagacagccggtccatggcacctcggcaaactggagatggactttgatttctgtgaagggaccactgtcgtggtgaccgaggactgcggaaatagaggcccctccctaaggacaactaccgcgtcagggaagctgataacagaatggtgctgtcgcagttgcacgctcccgcctctgcggtacagaggagaggatggctgttggtatggtatggagattaggccacttaaagaaaaggaggaaaacttggtcaatagcctggttaccgccgggcatggacagatcgacaacttttcgttaggcgtgctcggtatggctctgttccttgaggaaatgctgcgcactcgagtaggcacaaagcacgcaatcttgctcgtggccgtctcctttgtgaccctgattactgggaatatgtctttccgggatctaggacgtgttatggtgatggtcggcgctacaatgaccgacgatatcgggatgggagtgacgtacctggccctcctggcagcgtttaaagttagacccactttcgccgctggccttttgctgaggaagttaaccagcaaagagctcatgatgacaaccattggtatagtgctgctttcacaaagtactatccctgagacaattctggaactaaccgacgccctcgcactggggatgatggtcttgaagatcgtacgcaacatggagaaatatcagctggctgtgacaattatggccatcttatgcgttcccaatgcagtgatactccagaacgcctggaaggtctcctgtactatcctggctgtggtatctgtgagcccacttctgttgacctcctcacaacagaaggcggattggattcctctcgccctgacgatcaaaggactaaatcccacagcaatttttctgaccactcttagccggaccagtaagaaaagatcttggccactcaacgaagctatcatggccgtcggcatggtttccatactggccagctcgttgctgaagaatgacattccgatgacaggccctttagtggctgggggactcctgactgtgtgctacgtccttaccggtaggtcagcagacctggagttggaacgagccgcggatgtgcgctgggaggagcaggctgaaatctctggcagttcccccatcctcagcattacgatatctgaggacgggagcatgtccatcaaaaacgaagaggaggaacagacactgaccattctaatccggactggactgcttgttatttcaggcctcttcccagtaagtatccccataacagccgcagcctggtatctgtgggaggtgaagaaacaaagagctggtgtcttgtgggatgtgcctagcccaccccctgttgggaaggcagaattagaggacggagcctacaggatcaagcagaaaggcattctgggctattctcagatcggggcgggagtgtacaaggaaggtacctttcacactatgtggcatgtcacacgtggcgctgtgctcatgcacaaagggaagcgcattgagccgtcctgggccgatgtcaagaaggacctgatctcatacggaggcggttggaaacttgagggggaatggaaagagggagaagaggtccaggtgctggcattggaaccaggcaagaatccccgggccgttcaaaccaaacctggcctattcaagacgaacactgggaccataggagctgtgagtctggattttagcccaggtacatccggctctcccattgtcgacaaaaaggggaaggtggttggactctatggcaacggtgtggtcaccagatcggggacatacgtgagcgccatcgcacagactgagaaatcaatcgaggataatcctgaaattgaggacgatatcttcaggaagaaacgactgaccataatggaccttcatccgggagctggcaagacgaaacggtatttacccgccattgtacgcgaagcgatcaagagaggcctgaggacactcattttggccccaactcgggtggttgcagctgagatggaagaggccctgcgagggctccctatcagataccagacccccgctatacgcgcagagcacacaggaagggaaattgtcgatctgatgtgtcatgccaccttcactatgcgtcttctgtccccaatccgggtgcctaactataatttgatcattatggacgaggcccactttaccgaccccgctagtatcgcggcaagaggttacatttctacaagggtggaaatgggcgaggccgctgggatattcatgacggccactccaccgggaagccgcgatccttttccccagtccaacgcaccaatcatggacgaggaacgagagattcccgaaagatcatggaactctggccacgagtgggtcaccgatttcaagggtaaaacagtatggtttgtgcctagcatcaaggccgggaacgacatcgctgcgtgcctacggaaaaatggaaagaaagttattcaactgagtaggaagaccttcgattccgaatatgtgaagactcgcacaaacgactgggattttgtcgtgaccacggacataagcgagatgggcgccaatttcaaagcagagcgtgttatcgatccaagacggtgtatgaagcccgtgattctcactgacggcgaagagagggtcatcttagctgggcctatgccggtgacacattcttcagccgcacagcgccgaggaagagtaggtcggaaccccaagaatgaaaacgatcagtacatttacatgggcgagcccctggaaaatgacgaggactgcgcccactggaaggaggctaaaatgcttctggataacatcaatacccctgaagggataatcccctccatgtttgagccagaaagggagaaggtggacgccattgatggagaatatcgcctcagaggcgaggcgaggaaaaccttcgttgacttgatgcggcgtggtgatctgcctgtctggctcgcataccgcgtggccgctgaggggatcaactatgccgaccgaagatggtgttttgatggcgtgaagaacaatcaaattctggaagagaacgtcgaagttgagatctggactaaggagggagaaaggaagaaacttaaaccccggtggctagacgctcgcatatacagtgatccactggcattgaaagagttcaaagagttcgccgctggcagaaagagcttaacactgaatctcattaccgagatggggaggctgcctacatttatgactcagaaggcccggaacgcacttgacaatctggcggtgctccatacggccgaagctggaggtcgagcctataaccacgcattgtcggagctgccggagaccctagaaacactgctccttctgactttattggctaccgtaacaggcgggatcttcctgtttctcatgtctggaaaaggcattggtaagatgaccctggggatgtgctgcatcataactgcctccgtgcttctgtggtacgcacagatccagccccactggattgccgctagcatcattctcgagttctttttgatcgtcctgttaataccagaacctgagaaacaaagaacgccccaggataatcagctaacctatgtggttattgcgatcctgacagtggtcgccgcaactatggctaacgaaatgggcttcctcgagaagaccaaaaaggactttggacttggcgggatcgccacacagcaaccagagtcaaatattctggatatcgacttgcgccctgccagtgcatggaccctgtacgctgtagccactacattcataacgcccatgctcaggcattctattgaaaactccagcgtgaatgtttcactgaccgcgatcgctaaccaggccactgtgcttatgggactcggtaagggctggccgctgagtaaaatggacattggggtcccattgctggcaatcggatgttacagccaggtgaatcctataacattaaccgccgctctactgctccttgtcgcacactatgccatcattggccccggtctgcaggcgaaggctacccgggaggcccaaaaacgtgcagccgctgggatcatgaagaacccaacagtggatggcattactgttatcgacttggatcccattccttacgacccgaaatttgaaaagcagctgggacaggtgatgctcctggtactttgcgtgacgcaggtcttaatgatgagaaccacatgggccctgtgtgaggcactcactttggctaccggccccatctccacactgtgggaagggaatccaggaaggttctggaacaccactatagccgtttctatggcgaatatttttcgcggcagctatctagccggtgcagggctactcttctccatcatgaagaacacggctaacacacggcgaggaaccggcaatactggtgagacccttggcgagaaatggaagaacagactgaatgccttggggaaatcagaatttcaaatctacaagaaatctggcattcaggaggtggataggacactggcaaaggaaggcataaaacgcggggagactgaccatcacgctgtcagtcggggatcggccaagctcagatggttcgtggagcgtaacctggtaacccctgaaggcaaggtgatggatttaggttgcgggaggggaggctggagctattactgtggtggccttaaaaatgttaaggaggtgaaagggctgacaaagggaggccccgggcatgaagaacctatcccaatgtccacgtatggatggaacctcgtccggctacagtctggcgtggacgtcttctttacaccacctgaaaaatgcgatactctgttgtgtgacattggtgagtcaagcccaaatcccacagtggaggccgggcgcaccctgcgagttctcaaccttgtagaaaattggctgaacaataacactcaattctgcatcaaggtgttgaatccgtacatgccttccgtcattgagaagatggaagcgctgcagagaaaatacggaggcgctctcgtgaggaacccattaagtagaaattctacacacgagatgtattgggttagcaacgcatcaggcaacatcgtgtccagtgtcaatatgataagccgcatgctgatcaacagatttaccatgaggcacaagaaagccacgtacgaacccgatgtggaccttgggtctggaacccgaaatattggtatcgagtccgagacacctaacctggatattatcggcaagcggatagagaaaattaagcaggaacatgaaacttcatggcactatgaccaggaccatccatacaagacctgggcttatcacgggagctacgagacaaaacaaactggatcggcctctagtatggtaaatggcgtggttcgtctactcaccaagccctgggatgtcatcccgatggtgacacagatggcaatgaccgacactacgcctttcggtcagcagagagtgtttaaagaaaaggtcgatacacgcacccaagagcccaaagaggggactaagaagctgatgaaaatcaccgccgaatggttgtggaaggagctgggcaagaagaaaacaccaaggatgtgtacgcgggaagagttcaccagaaaggttcgctccaacgctgcgctcggcgccatttttactgacgagaataaatggaaaagcgcaagggaagctgtggaggattcaggcttctgggaacttgtagacaaggagcgaaacctgcacttagaagggaaatgcgagacatgtgtgtataatatgatgggaaagcgggagaaaaagctgggtgaatttggcaaagccaaggggtccagagcaatatggtacatgtggttgggagccaggttcctcgagtttgaagctctgggcttcctaaacgaggatcattggttttctcgcgaaaatagccttagtggtgtcgagggggagggactgcacaagctcggctacatcctgcgtgacgtgtccaaaaaggaaggcggggccatgtatgcggatgacaccgcaggatgggatactcggattacattggaggacctgaaaaacgaagagatggttaccaatcatatggaaggtgagcacaagaaactcgccgaggctatcttcaaacttacataccagaacaaggtggtcagagtgcagaggcctactagccgcggcaccgtaatggacattatctctcgacgggatcagagagggtcaggacaagttgtgacgtatggcctgaataccttcacaaacatggaagcccagttaataaggcagatggagggtgaaggggtctttaaaagtatccaacagctgactgcaaccgaggagattgctgtgaagaactggttggcccgcgtgggaagagaacggctctccaggatggctatcagcggcgacgattgcgtcgttaaacccctggacgatcgtttcgcctctgcactaacagcgcttaatgacatgggcaaggtgcgaaaagatattcagcagtgggagccatcgcgcgggtggaacgactggactcaagtacccttttgctcacatcacttccacgaactgatcatgaaggatggaagagtgctcgtcgtgccttgtcggaatcaggacgagctgattggtagggcccgcataagccagggcgctgggtggtccttgagagaaaccgcctgcttaggaaagagttacgcacagatgtggtctctgatgtattttcatcggagggatctccgacttgctgccaacgcaatctgtagcgccgttccatcccactgggtgccgacgtcacgtacaacctggagtattcatgcgactcacgagtggatgacaaccgaggacatgctgactgtctggaatagagtgtggatccaagaaaacccctggatcgaggataaaacccctgtagaatcttgggaggaaattccatacctaggcaagcgcgaggaccagtggtgcggtagcctgatagggctcacatcccgggctacgtgggccaaaaatatccagaccgcaattaaccaggttaggtcattgatcggaaatgaggaatatactgactacatgcccagcatgaagagattccgccgggaggaagaggaagccggcgtgctgtggtga

SEQ ID NO: 15055 - RNA, 9876 nt, synthetic construct
  misc_feature 1..9876: note = derived and/or modified CDS sequence (opt3) from DENV-2__DQ645553__SS-prME
  source 1..9876: mol_type = other RNA
accgcaggagtgatcattatgatgatacccacagtagttgctttccacctgactacgcggaatggggagcctcatatgatcgtgagcaggcaggaaaagggaaaatccctcctttttaagaccgagaatggtgtaaatatgtgcacactgatggcaatggacttgggagaattatgtgaggatactattacctacaattgcccactgttacggcaaaacgaaccggaggacatcgattgttggtgcaattctacatcaacctgggtgacttatgggacatgtaccgcaacgggagagcaccgccgagaaaaacgtagcgtcgcgctcgtgccccatgttggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagaaggggtttcaggaggtagctgggtggatatagtcctggagcacggcagttgtgtgaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtcgacagaggatggggcaacggttgtgggctgttcggaaagggcggcattgttacttgcgctatgtttacctgcaagaaaaatatggaggggaaggtggtacagcctgaaaacctagagtatacaatcgtgatcaccccacactccggagaagagaatgccgtcggtaacgatactggcaaacatgggaaggagattaaagtgacgccgcagtcaagtataacagaagcagagctcaccggatacggcactgttaccatggaatgtagccccaggacaggtctggacttcaatgagatggtgcttctgcagatggaagataaggcttggttggtccaccggcaatggtttctcgacctgcctttaccatggctgcccggggccgatacccagggctctaactggatccagaaagagactctcgtgacattcaagaaccctcacgcgaagaaacaggacgtagttgtgcttggatcccaagagggcgccatgcatacggcactgaccggggctactgaaattcagatgtcaagcggaaatttgctatttacaggtcacctgaagtgccgtctccgcatggacaaactgcagcttaagggcatgagttattctatgtgtaccgggaaattcaaggtcgtgaaggagatcgccgaaacacaacatggaactatagtcattagagtgcagtacgagggcgatggttccccatgcaaaatccccttcgagatcatggacctggaaaagaggcacgttttggggcggctcattaccgtgaacccgatcgtaacggagaaagatagccctgtcaatattgaagctgagcccccatttggcgactcgtacataatcattggagtggaacctggccagctgaagttatcttggttcaaaaaggggtcctcaatcggacagatgtttgagaccacaatgcgaggtgccaagcgcatggcaatcctgggcgatactgcctgggacttcgggagtcccggaggcgtttttaccagcattggtaaagctctacatcaagtgttcggggcgatatatggcgcagccttttccggagtctcttggacaatgaagatcctcattggcgtggtaatcacttggattgggatgaacagcagatcaaccagtctgtccgtgagccttgttttggtcggagtggtgacgctgtacctcggcgtcatggttcaggctgattctggttgtgtggtgtcatggaaaaataaggagctgaaatgcgggagtggaatcttcataacagacaacgtacacacctggactgaacagtataagtttcagccagagagcccctccaaacttgcctctgcaatccaaaaagcccacgaagagggcatttgtggtatcaggtcggtcacacggctggaaaatttgatgtggaagcagattacccctgagctcaaccatatcctgagcgagaatgaagtgaaattaactataatgaccggcgatattaaggggatcatgcaggctggaaaacgctccctgagaccacagccgacagagctaaagtactcatggaaagcctggggcaaggcaaagatgctcagtacggaactgcacaaccataccttccttattgacgggcccgagactgcggaatgccctaatacaaacagggcttggaactctttggaggttgaggattatggatttggcgtgttcaccacaaacatctggctgaaactcaaggaacgtcaagacgtcttttgtgacagcaaactgatgtccgccgcaataaaggataatcgggccgtgcacgctgacatgggttactggatcgagtcagccttaaacgatacttggaaaattgaaaaggccagcttcatcgaggttaagtcttgccactggccaaaatcccataccctgtggagtaacggggtgcttgagagcgaaatgattatccccaagaatttcgctggacctgtatctcagcacaactatcgaccaggctaccatacgcagacagccggtccctggcacttgggcaaactcgagatggactttgatttctgtgaagggaccactgtcgtggtgaccgaggactgcggaaatagaggcccgtccctgaggacaactaccgcgtcagggaagctaataacagaatggtgctgtcgcagttgcacgctgcctccactccggtacagaggagaggatggctgttggtatggtatggagattaggcccctgaaagaaaaggaggaaaaccttgtcaatagcttggttaccgccgggcatggacagatcgacaacttttcgctgggcgtgttaggtatggctctcttcctggaggaaatgcttcgcactcgagtaggcacaaagcacgcaatcctgttggtggccgtctcctttgtgaccctcattactgggaatatgtctttccgggatctgggacgtgttatggtgatggtcggcgctacaatgaccgacgatatcgggatgggagtgacgtacctagccctgctcgcagcgtttaaagttagacctactttcgccgctggcctgcttttgaggaagctgaccagcaaagagttaatgatgacaaccattggtatagtgctcctgtcacaaagtactatccccgagacaattcttgaactgaccgacgccctagcactcgggatgatggtcctgaagatcgtacgcaacatggagaaatatcagttggctgtgacaattatggccatcctgtgcgttccaaatgcagtgatattacagaacgcctggaaggtctcctgtactatcctcgctgtggtatctgtgagccctctgcttctgacctcctcacaacagaaggcggattggattcccttggccctcacgatcaaaggactgaatccaacagcaatttttctaaccactctgagccggaccagtaagaaaagatcttggccgcttaacgaagctatcatggccgtcggcatggtttccatactcgccagctcgctgttgaagaatgacattcctatgacaggccccctggtggctgggggattactcactgtgtgctacgtcctgaccggtaggtcagcagaccttgagctggaacgagccgcggatgtgcgctgggaggagcaggctgaaatctctggcagttccccaatcttgagcattacgatatctgaggacgggagcatgtccatcaaaaacgaagaggaggaacagacactcaccattctgatccggactggactactggttatttcaggccttttccccgtaagtatccctataacagccgcagcctggtatctctgggaggtgaagaaacaaagagctggtgtcctgtgggatgtgccaagtccccctccggttgggaaggcagaattggaggacggagcctacaggatcaagcagaaaggcattttaggctattctcagatcggggcgggagtgtacaaggaaggtacctttcacactatgtggcatgtcacacgtggcgctgtgctgatgcacaaagggaagcgcattgagccatcctgggccgatgtcaagaaggacctcatctcatacggaggcggttggaagctggagggggaatggaaagagggagaagaggtccaggtgcttgcactggaacccggcaagaatcctcgggccgttcaaaccaaaccaggcttgttcaagacgaacactgggaccataggagctgtgagtctagattttagccccggtacatccggctctcctattgtcgacaaaaaggggaaggtggttggactgtatggcaacggtgtggtcaccagatcggggacatacgtgagcgccatcgcacagactgagaaatcaatcgaggataatccggaaattgaggacgatatcttcaggaagaaacgactcaccataatggacctgcatcccggagctggcaagacgaaacggtatcttccagccattgtacgcgaagcgatcaagagaggcttaaggacactgattctcgcccctactcgggtggttgcagctgagatggaagaggccttgcgagggctgcccatcagataccagaccccagctatacgcgcagagcacacaggaagggaaattgtcgatctcatgtgtcatgccaccttcactatgcgtctgctttcccctatccgggtgcccaactataatctgatcattatggacgaggcccactttaccgacccagctagtatcgcggcaagaggttacatttctacaagggtggaaatgggcgaggccgctgggatattcatgacggccactccgcctggaagccgcgatccctttccacagtccaacgcacccatcatggacgaggaacgagagattcctgaaagatcatggaactctggccacgagtgggtcaccgatttcaagggtaaaacagtatggtttgtgccaagcatcaaggccgggaacgacatcgctgcgtgcttgcggaaaaatggaaagaaagttattcaactaagtaggaagaccttcgattccgaatatgtgaagactcgcacaaacgactgggattttgtcgtgaccacggacataagcgagatgggcgccaatttcaaagcagagcgtgttatcgatcccagacggtgtatgaagcctgtgattctgactgacggcgaagagagggtcatcctcgctgggccgatgccagtgacacattcttcagccgcacagcgccgaggaagagtaggtcggaaccccaaaaatgaaaacgatcagtacatttacatgggcgagcctttagaaaatgacgaggactgcgcccactggaaggaggctaaaatgctgcttgataacatcaatacccccgaagggataatcccatccatgtttgagcctgaaagggagaaggtggacgccattgatggagaatatcgcctgagaggcgaggcgaggaaaaccttcgttgacctcatgcggcgtggtgatttgcccgtctggctggcataccgcgtggccgctgaggggatcaactatgccgaccgaagatggtgttttgatggcgtgaagaacaatcaaattctcgaagagaacgtcgaagttgagatctggactaaggagggagaaaggaaaaagctgaaaccacggtggcttgacgctcgcatatacagtgatcctctagcactgaaggagttcaaagagttcgccgctggcagaaagagcttgacattaaatctgattaccgagatggggaggctcccgacatttatgactcagaaggcccggaacgcactggacaatcttgcggtgctgcatacggccgaagctggaggtcgagcctataaccacgcactctcggagttgcccgagaccctggaaacactactgctccttactctgttagctaccgtaacaggcgggatcttcttgtttctgatgtctggaaaaggcattggtaagatgaccctcgggatgtgctgcatcataactgcctccgtgctgctttggtacgcacagatccagccacactggattgccgctagcatcattctggagttctttctcatcgtcttgctgatacctgaacccgagaaacaaagaacgccacaggataatcagttaacctatgtggttattgcgatcctaacagtggtcgccgcaactatggctaacgaaatgggcttcctggagaagaccaaaaaggactttggactcggcgggatcgccacacagcaacctgagtcaaatattcttgatatcgacctgcgccccgccagtgcatggaccttgtacgctgtagccactacattcataacgccgatgctgaggcattctattgaaaactccagcgtgaatgtttcactcaccgcgatcgctaaccaggccactgtgctgatgggacttggtaagggctggccactcagtaaaatggacattggggtccctctgttggcaatcggatgttacagccaggtgaatcccataacactgaccgccgctttactactgctcgtcgcacactatgccatcattggcccaggtcttcaggcgaaggctacccgggaggcccaaaaacgtgcagccgctgggatcatgaagaaccccacagtggatggcattactgttatcgacctggatcctattccgtacgaccccaaatttgaaaagcagttgggacaggtgatgctgctcgtactgtgcgtgacgcaggtccttatgatgagaaccacatgggccttatgtgaggcactgactctcgctaccggcccaatctccacattgtgggaagggaatcctggaaggttctggaacaccactatagccgtttctatggcgaatatttttcgcggcagctatctggccggtgcagggctactgttctccatcatgaagaacacggctaacacacggcgaggaaccggcaatactggtgagaccctcggcgagaaatggaagaacagacttaatgccctggggaaatcagaatttcaaatctacaagaaatctggcattcaggaggtggataggacattggcaaaggaaggcataaaacgcggggagactgaccatcacgctgtcagtcggggatcggccaagctgagatggttcgtggagcgtaacctcgtaacccccgaaggcaaggtgatggatctgggttgcgggaggggaggctggagctattactgtggtggcctaaagaatgttaaggaggtgaaagggcttacaaagggaggccctgggcatgaagaaccaatccccatgtccacgtatggatggaacctggtccggctccagtctggcgtggacgtcttctttacccctccagaaaaatgcgatactctactgtgtgacattggtgagtcaagccccaatccgacagtggaggccgggcgcaccttgcgagttctgaacctcgtagaaaattggcttaacaataacactcaattctgcatcaaggtgctgaatccttacatgccatccgtcattgagaagatggaagcgttgcagagaaaatacggaggcgctctggtgaggaaccccctcagtagaaattctacacacgagatgtattgggttagcaacgcatcaggcaacatcgtgtccagtgtcaatatgataagccgcatgttaatcaacagatttaccatgaggcacaagaaagccacgtacgaacctgatgtggacctggggtctggaacccgaaatattggtatcgagtccgagacaccaaaccttgatattatcggcaagcggatagagaaaattaagcaggaacatgaaacttcatggcactatgaccaggaccatccctacaagacctgggcttatcacgggagctacgagacaaaacaaactggatcggcctctagtatggtaaatggcgtggttcgtctgctaaccaagccgtgggatgtcatccctatggtgacacagatggcaatgaccgacactacgcccttcggtcagcagagagtgtttaaagaaaaggtcgatacacgcacccaagagccaaaagaggggactaagaagctcatgaaaatcaccgccgaatggctgtggaaggagttgggcaaaaagaaaacacctaggatgtgtacgcgggaagagttcaccagaaaggttcgctccaacgctgcgctgggcgccatttttactgacgagaataaatggaaaagcgcaagggaagctgtggaggattcaggcttctgggaactcgtagacaaggagcgaaaccttcacctggaagggaaatgcgagacatgtgtgtataatatgatgggaaagcgggagaaaaagttaggtgaatttggcaaagccaaggggtccagagcaatatggtacatgtggctgggagccaggttcttggagtttgaagctctcggcttcctgaacgaggatcattggttttctcgcgaaaatagcctaagtggtgtcgagggggagggacttcacaagctgggctacatcctccgtgacgtgtccaaaaaggaaggcggggccatgtatgcggatgacaccgcaggatgggatactcggattacactggaggacttgaaaaacgaagagatggttaccaatcatatggaaggtgagcacaagaaactggccgaggctatcttcaagctcacataccagaacaaggtggtcagagtgcagaggcccactccacgcggcaccgtaatggacattatcagccgacgggatcagagagggtctggacaagttgtgacgtatggccttaataccttcacaaacatggaagcccagctgataaggcagatggagggtgaaggggtctttaaatcaatccaacagttaactgcaaccgaggagattgctgtgaagaactggctggcccgcgtgggaagagaacggttgagtaggatggctatctccggcgacgattgcgtcgttaaacccctcgacgatcgtttcgccagcgcactgacagcgctaaatgacatgggcaaggtgcgaaaagatattcagcagtgggagccttctcgcgggtggaacgactggactcaagtaccattttgctcgcatcacttccacgaacttatcatgaaggatggaagagtgctggtcgtgccgtgtcggaatcaggacgagctcattggtagggcccgcatatcacagggcgctgggtggagcctgagagaaaccgcctgcttgggaaagtcctacgcacagatgtggagtttaatgtattttcatcggagggatctgcgactcgctgccaacgcaatctgttctgccgttcccagccactgggtgcctacgtcccgtacaacctggtcaattcatgcgactcacgagtggatgacaaccgaggacatgcttgctgtctggaatagagtgtggatccaagaaaacccatggatcgaggataaaactcccgtagaaagttgggaggaaattccttacctgggcaagcgcgaggaccagtggtgcggttctctaatagggctgaccagccgggccacatgggccaaaaatatccagacggccattaaccaggttaggtccctcatcggaaatgaggaatataccgactacatgccatcaatgaagagattccgccgggaggaagaggaagctggcgtgttgtggtga

SEQ ID NO: 15056 - RNA, 9876 nt, synthetic construct
  misc_feature 1..9876: note = derived and/or modified CDS sequence (opt3) from DENV-2__DQ645554__SS-prME
  source 1..9876: mol_type = other RNA
accgcaggagtgatcattatgatgatacccaccgtagttgctttccacctgactacgcggaatggggagcctcatatgatcgtgagcaggcaggaaaagggaaagtccctcctttttaagaccgagaatggtgtaaatatgtgcacactgatggcaatggacttgggagaattatgtgaggatactattacctacaattgcccactgctgcggcaaaacgaaccggaggacatcgattgttggtgcaattctacatcaacctgggtgacttatgggacatgtaccgccacgggagagcaccgccgagaaaaacgtagtgtcgcgctcgtgccccatgttggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagaaggggtttcaggaggtagctgggtggatatagtcctggagcacggcagttgtgtgaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtcgacagaggatggggcaacggttgtgggctgttcggaaagggcggcattgttacttgcgctatgtttacctgcaagaaaaatatggaggggaaggtggtacagcctgaaaacctagagtatacaatcgtgatcaccccacactccggagaagagaatgccgtcggtaacgatactggcaaacatgggaaggagattaaagtgacgccgcagtcaagtataacagaagcagagctcaccggatacggcactgttaccatggaatgtagccccaggacaggtctggacttcaatgagatggtgcttctgcagatggaagataaggcttggttggtccaccggcaatggtttctcgacctgcctttaccatggctgcccggggccgatacccagggctctaactggatccagaaagagactctcgtgacattcaagaaccctcacgcgaagaaacaggacgtagttgtgcttggatcccaagagggcgccatgcatacggcactgaccggggctactgaaattcagatgtcaagcggaaatttgctatttacaggtcacctgaagtgccgtctccgcatggacaaactgcagcttaagggcatgagttattctatgtgtaccgggaaattcaaggtcgtgaaggagatcgccgaaacacaacatggaactatagtcattagagtgcagtacgagggcgatggttccccatgcaaaatccccttcgagatcatggacctggaaaagaggcacgttttggggcggctcattaccgtgaacccgatcgtaacggagaaagatagccctgtcaatattgaagctgagcccccatttggcgactcgtacataatcattggagtggaacctggccagctgaagttatcttggttcaaaaaggggtcctcaatcggacagatgtttgagaccacaatgcgaggtgccaagcgcatggcaatcctgggcgatactgcctgggacttcgggagtctaggaggcgtttttaccagcattggtaaagctctccatcaagtgttcggggcgatatatggcgcagccttttccggagtctcttggacaatgaagatcctgattggcgtggtaatcacttggattgggatgaacagcagatcaaccagtctttccgtgagcttggttctggtcggagtggtgacgctctacctgggcgtcatggttcaggctgattctggttgtgtggtgtcatggaaaaataaggagcttaaatgcgggagtggaatcttcataacagacaacgtacacacctggactgaacagtataagtttcagcccgagagcccatccaagctggcctctgcaatccaaaaagcccacgaagagggcatttgtggtatcaggtcggtcacacggttggaaaatctcatgtggaagcagattacccccgagctgaaccatatcttaagcgagaatgaagtgaaactgactataatgaccggcgatattaaggggatcatgcaggctggaaaacgctccctaagacctcagccaacagagctcaagtactcatggaaagcctggggcaaggcaaagatgctgagtacggaacttcacaaccataccttcttgattgacgggccggagactgcggaatgccccaatacaaacagggcttggaactctctggaggttgaggattatggatttggcgtgttcaccacaaacatctggctcaaactgaaggaacgtcaagacgtcttttgtgacagcaaattaatgtccgccgcaataaaggataatcgggccgtgcacgctgacatgggttactggatcgagtcagccctgaacgatacttggaaaattgaaaaggccagcttcatcgaggttaagtcttgccactggcctaaatcccataccctttggagtaacggggtgttggagagcgaaatgattatcccaaagaatttcgctggacccgtatctcagcacaactatcgacctggctaccatacgcagacagccggtccatggcacctcggcaaactggagatggactttgatttctgtgaagggaccactgtcgtggtgaccgaggactgcggaaatagaggcccctccctaaggacaactaccgcgtcagggaagctgataacagaatggtgctgtcgcagttgcacgctcccgcctctgcggtacagaggagaggatggctgttggtatggtatggagattaggccacttaaagaaaaggaggaaaacttggtcaatagcctggttaccgccgggcatggacagatcgacaacttttcgttaggcgtgctcggtatggctctgttccttgaggaaatgctgcgcactcgagtaggcacaaagcacgcaatcttgctcgtggccgtctcctttgtgaccctgattactgggaatatgtctttccgggatctaggacgtgttatggtgatggtcggcgctacaatgaccgacgatatcgggatgggagtgacgtacctggccctcctggcagcgtttaaagttagacccactttcgccgctggccttttgctgaggaagttaaccagcaaagagctcatgatgacaaccattggtatagtgctgctttcacaaagtactatccctgagacaattctggaactaaccgacgccctcgcactggggatgatggtcttgaagatcgtacgcaacatggagaaatatcagctggctgtgacaattatggccatcttatgcgttcccaatgcagtgatactccagaacgcctggaaggtctcctgtactatcctggctgtggtatctgtgagcccacttctgttgacctcctcacaacagaaggcggattggattcctctcgccctgacgatcaaaggactaaatcccacagcaatttttctgaccactcttagccggaccagtaagaaaagatcttggccactcaacgaagctatcatggccgtcggcatggtttccatactggccagctcgttgctgaagaatgacattccgatgacaggccctttagtggctgggggactcctgactgtgtgctacgtccttaccggtaggtcagcagacctggagttggaacgagccgcggatgtgcgctgggaggagcaggctgaaatctctggcagttcccccatcctcagcattacgatatctgaggacgggagcatgtccatcaaaaacgaagaggaggaacagacactgaccattctaatccggactggactgcttgttatttcaggcctcttcccagtaagtatccccataacagccgcagcctggtatctgtgggaggtgaagaaacaaagagctggtgtcttgtgggatgtgcctagcccaccccctgttgggaaggcagaattagaggacggagcctacaggatcaagcagaaaggcattctgggctattctcagatcggggcgggagtgtacaaggaaggtacctttcacactatgtggcatgtcacacgtggcgctgtgctcatgcacaaagggaagcgcattgagccgtcctgggccgatgtcaagaaggacctgatctcatacggaggcggttggaaacttgagggggaatggaaagagggagaagaggtccaggtgctggcattggaaccaggcaagaatccccgggccgttcaaaccaaacctggcctattcaagacgaacactgggaccataggagctgtgagtctggattttagcccaggtacatccggctctcccattgtcgacaaaaaggggaaggtggttggactctatggcaacggtgtggtcaccagatcggggacatacgtgagcgccatcgcacagactgagaaatcaatcgaggataatcctgaaattgaggacgatatcttcaggaagaaacgactgaccataatggaccttcatccgggagctggcaagacgaaacggtatttacccgccattgtacgcgaagcgatcaagagaggcctgaggacactcattttggccccaactcgggtggttgcagctgagatggaagaggccctgcgagggctccctatcagataccagacccccgctatacgcgcagagcacacaggaagggaaattgtcgatctgatgtgtcatgccaccttcactatgcgtcttctgtccccaatccgggtgcctaactataatttgatcattatggacgaggcccactttaccgaccccgctagtatcgcggcaagaggttacatttctacaagggtggaaatgggcgaggccgctgggatattcatgacggccactccaccgggaagccgcgatccttttccccagtccaacgcaccaatcatggacgaggaacgagagattcccgaaagatcatggaactctggccacgagtgggtcaccgatttcaagggtaaaacagtatggtttgtgcctagcatcaaggccgggaacgacatcgctgcgtgcctacggaaaaatggaaagaaagttattcaactgagtaggaagaccttcgattccgaatatgtgaagactcgcacaaacgactgggattttgtcgtgaccacggacataagcgagatgggcgccaatttcaaagcagagcgtgttatcgatccaagacggtgtatgaagcccgtgattctcactgacggcgaagagagggtcatcttagctgggcctatgccggtgacacattcttcagccgcacagcgccgaggaagagtaggtcggaaccccaagaatgaaaacgatcagtacatttacatgggcgagcccctggaaaatgacgaggactgcgcccactggaaggaggctaaaatgcttctggataacatcaatacccctgaagggataatcccctccatgtttgagccagaaagggagaaggtggacgccattgatggagaatatcgcctcagaggcgaggcgaggaaaaccttcgttgacttgatgcggcgtggtgatctgcctgtctggctcgcataccgcgtggccgctgaggggatcaactatgccgaccgaagatggtgttttgatggcgtgaagaacaatcaaattctggaagagaacgtcgaagttgagatctggactaaggagggagaaaggaagaaacttaaaccccggtggctagacgctcgcatatacagtgatccactggcattgaaagagttcaaagagttcgccgctggcagaaagagcttaacactgaatctcattaccgagatggggaggctgcctacatttatgactcagaaggcccggaacgcacttgacaatctggcggtgctccatacggccgaagctggaggtcgagcctataaccacgcattgtcggagctgccggagaccctagaaacactgctccttctgactttattggctaccgtaacaggcgggatcttcctgtttctcatgtctggaaaaggcattggtaagatgaccctggggatgtgctgcatcataactgcctccgtgcttctgtggtacgcacagatccagccccactggattgccgctagcatcattctcgagttctttttgatcgtcctgttaataccagaacctgagaaacaaagaacgccccaggataatcagctaacctatgtggttattgcgatcctgacagtggtcgccgcaactatggctaacgaaatgggcttcctcgagaagaccaaaaaggactttggacttggcgggatcgccacacagcaaccagagtcaaatattctggatatcgacttgcgccctgccagtgcatggaccctgtacgctgtagccactacattcataacgcccatgctcaggcattctattgaaaactccagcgtgaatgtttcactgaccgcgatcgctaaccaggccactgtgcttatgggactcggtaagggctggccgctgagtaaaatggacattggggtcccattgctggcaatcggatgttacagccaggtgaatcctataacattaaccgccgctctactgctccttgtcgcacactatgccatcattggccccggtctgcaggcgaaggctacccgggaggcccaaaaacgtgcagccgctgggatcatgaagaacccaacagtggatggcattactgttatcgacttggatcccattccttacgacccgaaatttgaaaagcagctgggacaggtgatgctcctggtactttgcgtgacgcaggtcttaatgatgagaaccacatgggccctgtgtgaggcactcactttggctaccggccccatctccacactgtgggaagggaatccaggaaggttctggaacaccactatagccgtttctatggcgaatatttttcgcggcagctatctagccggtgcagggctactcttctccatcatgaagaacacggctaacacacggcgaggaaccggcaatactggtgagacccttggcgagaaatggaagaacagactgaatgccttggggaaatcagaatttcaaatctacaagaaatctggcattcaggaggtggataggacactggcaaaggaaggcataaaacgcggggagactgaccatcacgctgtcagtcggggatcggccaagctcagatggttcgtggagcgtaacctggtaacccctgaaggcaaggtgatggatttaggttgcgggaggggaggctggagctattactgtggtggccttaaaaatgttaaggaggtgaaagggctgacaaagggaggccccgggcatgaagaacctatcccaatgtccacgtatggatggaacctcgtccggctacagtctggcgtggacgtcttctttacaccacctgaaaaatgcgatactctgttgtgtgacattggtgagtcaagcccaaatcccacagtggaggccgggcgcaccctgcgagttctcaaccttgtagaaaattggctgaacaataacactcaattctgcatcaaggtgttgaatccgtacatgccttccgtcattgagaagatggaagcgctgcagagaaaatacggaggcgctctcgtgaggaacccattaagtagaaattctacacacgagatgtattgggttagcaacgcatcaggcaacatcgtgtccagtgtcaatatgataagccgcatgctgatcaacagatttaccatgaggcacaagaaagccacgtacgaacccgatgtggaccttgggtctggaacccgaaatattggtatcgagtccgagacacctaacctggatattatcggcaagcggatagagaaaattaagcaggaacatgaaacttcatggcactatgaccaggaccatccatacaagacctgggcttatcacgggagctacgagacaaaacaaactggatcggcctctagtatggtaaatggcgtggttcgtctactcaccaagccctgggatgtcatcccgatggtgacacagatggcaatgaccgacactacgcctttcggtcagcagagagtgtttaaagaaaaggtcgatacacgcacccaagagcccaaagaggggactaagaagctgatgaaaatcaccgccgaatggttgtggaaggagctgggcaagaagaaaacaccaaggatgtgtacgcgggaagagttcaccagaaaggttcgctccaacgctgcgctcggcgccatttttactgacgagaataaatggaaaagcgcaagggaagctgtggaggattcaggcttctgggaacttgtagacaaggagcgaaacctgcacttagaagggaaatgcgagacatgtgtgtataatatgatgggaaagcgggagaaaaagctgggtgaatttggcaaagccaaggggtccagagcaatatggtacatgtggttgggagccaggttcctcgagtttgaagctctgggcttcctaaacgaggatcattggttttctcgcgaaaatagccttagtggtgtcgagggggagggactgcacaagctcggctacatcctgcgtgacgtgtccaaaaaggaaggcggggccatgtatgcggatgacaccgcaggatgggatactcggattacattggaggacctgaaaaacgaagagatggttaccaatcatatggaaggtgagcacaagaaactcgccgaggctatcttcaaacttacataccagaacaaggtggtcagagtgcagaggcctactccccgcggcaccgtaatggacattatcagccgacgggatcagagagggtctggacaagttgtgacgtatggcctgaataccttcacaaacatggaagcccagttaataaggcagatggagggtgaaggggtctttaaatcaatccaacagctgactgcaaccgaggagattgctgtgaagaactggttggcccgcgtgggaagagaacggctcagtaggatggctatctccggcgacgattgcgtcgttaaaccactggacgatcgtttcgccagcgcactaacagcgcttaatgacatgggcaagattcgaaaagatatccagcagtgggagccctctcgcgggtggaacgactggactcaagtgcctttttgctcgcatcacttccacgaactgattatgaaggatggaagagtactcgtggtcccatgtcggaatcaggacgagctgataggtagggcccgcatctcacagggcgctgggtggagcttgagagaaaccgcctgcttaggaaagtcctacgcacagatgtggagtctgatgtattttcatcggagggatctccgacttgctgccaacgcaatttgttctgccgtgccgagccactgggttcccacgtcccgtacaacctggtcaatccatgcgactcacgagtggatgacaaccgaggacatgctgactgtgtggaatagagtctggatccaagaaaacccttggattgaggataaaaccccagtggaaagttgggaggaaataccctacctaggcaagcgcgaggaccagtggtgcggttctctgatcgggctcacaagccgggctacgtgggccaaaaatattcagaccgcaatcaaccaggtaaggtccttgattggaaatgaggaatatactgactacatgccttcaatgaagagattccgccgggaggaagaggaagccggcgttctgtggtga

SEQ ID NO: 15057 - RNA, 9876 nt, synthetic construct
  misc_feature 1..9876: note = derived and/or modified CDS sequence (opt3) from DENV-2__DQ645555__SS-prME
  source 1..9876: mol_type = other RNA
accgcaggagtgatcattatgatgatacccaccgtagttgctttccacctgactacgcggaatggggaacctcatatgatcgtgagcaggcaggaaaagggaaagtccctcctttttaagaccgaaaatggtgtaaatatgtgcacactgatggcaatggacttgggagaattatgtgaggatactattacctacaattgcccactgctgcggcaaaacgaaccggaggacatcgattgttggtgcaattctacatcaacctgggtgacttatgggacatgtaccgccacgggagagcaccgccgagaaaaacgtagtgtcgcgctcgtgccccatgttggcatgggtctggagactagaaccgaaacatggatgagctcccagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagagggggtttcaggaggtagctgggtggatatagtcctggaacacggcagttgtgtgaccactatggctaaaaataagcccacactcgacttcgagttaattaagaccgaagccaaacaccctgcgacgctgcggaagtactgcatcgaggcaaaacttaccaacacaactaccgcctcccgctgtccaacacaaggggaaccctctttgaatgaggagcaggataagcgatttgtgtgcaaacatagcatggtcgacagaggatggggcaacggttgtgggctgttcggaaagggcggcattgttacttgcgctatgtttacctgcaagaaaaatatggaagggaaggtggtacagcctgagaacctagaatatacaatcgtgatcaccccacactccggagaggaaaatgccgtcggtaacgatactggcaaacatgggaaggagattaaagtgacgccgcagtcaagtataacagaggcagaactcaccggatacggcactgttaccatggagtgtagccccaggacaggtctggacttcaatgaaatggtgcttctgcaaatggaggataaggcttggttggtccaccggcagtggtttctcgacctgcctttaccatggctgcccggggccgatacccagggctctaactggatccagaaagaaactctcgtgacattcaagaaccctcacgcgaagaaacaagacgtagttgtgcttggatcccaggagggcgccatgcatacggcactgaccggggctactgagattcagatgtcaagcggaaatttgctatttacaggtcacctgaagtgccgtctccgcatggacaaactgcaacttaagggcatgagttattctatgtgtaccgggaaattcaaggtcgtgaaggaaatcgccgagacacagcatggaactatagtcattagagtgcagtacgaaggcgatggttccccatgcaaaatccccttcgagatcatggacctggagaagaggcacgttttggggcggctcattaccgtgaacccgatcgtaacggaaaaagatagccctgtcaatattgaggctgaacccccatttggcgactcgtacataatcattggagtggagcctggccagctgaagttatcttggttcaaaaaggggtcctcaatcggacaaatgtttgaaaccacaatgcgaggtgccaagcgcatggcaatcctgggcgatactgcctgggacttcgggagtctaggaggcgtttttaccagcattggtaaagctctccatcaggtgttcggggcgatatatggcgcagccttttccggagtctcttggacaatgaagatcctgattggcgtggtaatcacttggattgggatgaacagcagatcaaccagtctttccgtgagcttggttctggtcggagtggtgacgctctacctgggcgtcatggttcaggctgattctggttgtgtggtgtcatggaaaaataaggagcttaaatgcgggagtggaatcttcataacagacaacgtacacacctggactgagcagtataagtttcaacccgaaagcccatccaagctggcctctgcaatccagaaagcccacgaggaaggcatttgtggtatcaggtcggtcacacggttggagaatctcatgtggaagcagattacccccgaactgaaccatatcttaagcgagaatgaggtgaaactgactataatgaccggcgatattaaggggatcatgcaggctggaaaacgctccctaagacctcaaccaacagaactcaagtactcatggaaagcctggggcaaggcaaagatgctgagtacggagcttcacaaccataccttcttgattgacgggccggaaactgcggagtgccccaatacaaacagggcttggaactctctggaagttgaggattatggatttggcgtgttcaccacaaacatctggctcaaactgaaggagcgtcaggacgtcttttgtgacagcaaattaatgtccgccgcaataaaggataatcgggccgtgcacgctgacatgggttactggatcgaatcagccctgaacgatacttggaaaattgagaaggccagcttcatcgaagttaagtcttgccactggcctaaatcccataccctttggagtaacggggtgttggagagcgagatgattatcccaaagaatttcgctggacccgtatctcagcacaactatcgacctggctaccatacgcagacagccggtccatggcacctcggcaaactggaaatggactttgatttctgtgaggggaccactgtcgtggtgaccgaagactgcggaaatagaggcccctccctaaggacaactaccgcgtcagggaagctgataacagagtggtgctgtcgcagttgcacgctcccgcctctgcggtacagaggagaagatggctgttggtatggtatggagattaggccacttaaagagaaggaagagaacttggtcaatagcctggttaccgccgggcatggacaaatcgacaacttttcgttaggcgtgctcggtatggctctgttccttgaagagatgctgcgcactcgagtaggcacaaagcacgcaatcttgctcgtggccgtctcctttgtgaccctgattactgggaatatgtctttccgggatctaggacgtgttatggtgatggtcggcgctacaatgaccgacgatatcgggatgggagtgacgtacctggccctcctggcagcgtttaaagttagacccactttcgccgctggccttttgctgaggaagttaaccagcaaagaactcatgatgacaaccattggtatagtgctgctttcacagagtactatccctgagacaattctggagctaaccgacgccctcgcactggggatgatggtcttgaagatcgtacgcaacatggaaaaatatcagctggctgtgacaattatggccatcttatgcgttcccaatgcagtgatactccaaaacgcctggaaggtctcctgtactatcctggctgtggtatctgtgagcccacttctgttgacctcctcacagcagaaggcggattggattcctctcgccctgacgatcaaaggactaaatcccacagcaatttttctgaccactcttagccggaccagtaagaaaagatcttggccactcaacgaggctatcatggccgtcggcatggtttccatactggccagctcgttgctgaagaatgacattccgatgacaggccctttagtggctgggggactcctgactgtgtgctacgtccttaccggtaggtcagcagacctggaattggagcgagccgcggatgtgcgctgggaagaacaggctgagatctctggcagttcccccatcctcagcattacgatatctgaagacgggagcatgtccatcaaaaacgaggaagaggagcaaacactgaccattctaatccggactggactgcttgttatttcaggcctcttcccagtaagtatccccataacagccgcagcctggtatctgtgggaagtgaagaaacagagagctggtgtcttgtgggatgtgcctagcccaccccctgttgggaaggcagagttagaagacggagcctacaggatcaagcagaaaggcattctgggctattctcagatcggggcgggagtgtacaaggagggtacctttcacactatgtggcatgtcacacgtggcgctgtgctcatgcacaaagggaagcgcattgaaccgtcctgggccgatgtcaagaaggacctgatctcatacggaggcggttggaaacttgagggggagtggaaagaaggagaggaagtccaagtgctggcattggagccaggcaagaatccccgggccgttcagaccaaacctggcctattcaagacgaacactgggaccataggagctgtgagtctggattttagcccaggtacatccggctctcccattgtcgacaaaaaggggaaggtggttggactctatggcaacggtgtggtcaccagatcggggacatacgtgagcgccatcgcacagactgaaaaatcaatcgaggataatcctgagattgaagacgatatcttcaggaagaaacgactgaccataatggaccttcatccgggagctggcaagacgaaacggtatttacccgccattgtacgcgaggcgatcaagagaggcctgaggacactcattttggccccaactcgggtggttgcagctgaaatggaggaagccctgcgagggctccctatcagataccagacccccgctatacgcgcagagcacacaggaagggagattgtcgatctgatgtgtcatgccaccttcactatgcgtcttctgtccccaatccgggtgcctaactataatttgatcattatggacgaagcccactttaccgaccccgctagtatcgcggcaagaggttacatttctacaagggtggagatgggcgaagccgctgggatattcatgacggccactccaccgggaagccgcgatccttttccccaatccaacgcaccaatcatggacgaggagcgagaaattcccgagagatcatggaactctggccacgaatgggtcaccgatttcaagggtaaaacagtatggtttgtgcctagcatcaaggccgggaacgacatcgctgcgtgcctacggaaaaatggaaagaaagttattcagctgagtaggaagaccttcgattccgagtatgtgaagactcgcacaaacgactgggattttgtcgtgaccacggacataagcgaaatgggcgccaatttcaaagcagagcgtgttatcgatccaagacggtgtatgaagcccgtgattctcactgacggcgaggaaagggtcatcttagctgggcctatgccggtgacacattcttcagccgcacagcgccgaggaagagtaggtcggaaccccaagaatgagaacgatcaatacatttacatgggcgaacccctggagaatgacgaagactgcgcccactggaaggaggctaaaatgcttctggataacatcaatacccctgaggggataatcccctccatgtttgaaccagagagggaaaaggtggacgccattgatggagagtatcgcctcagaggcgaagcgaggaaaaccttcgttgacttgatgcggcgtggtgatctgcctgtctggctcgcataccgcgtggccgctgaggggatcaactatgccgaccgaagatggtgttttgatggcgtgaagaacaatcagattctggaggaaaacgtcgaggttgaaatctggactaaggagggagagaggaagaaacttaaaccccggtggctagacgctcgcatatacagtgatccactggcattgaaagagttcaaagagttcgccgctggcagaaagagcttaacactgaatctcattaccgaaatggggaggctgcctacatttatgactcagaaggcccggaacgcacttgacaatctggcggtgctccatacggccgaggctggaggtcgagcctataaccacgcattgtcggaactgccggagaccctagagacactgctccttctgactttattggctaccgtaacaggcgggatcttcctgtttctcatgtctggaaaaggcattggtaagatgaccctggggatgtgctgcatcataactgcctccgtgcttctgtggtacgcacagatccaaccccactggattgccgctagcatcattctcgagttctttttgatcgtcctgttaataccagagcctgaaaaacagagaacgccccaggataatcagctaacctatgtggttattgcgatcctgacagtggtcgccgcaactatggctaacgagatgggcttcctcgaaaagaccaaaaaggactttggacttggcgggatcgccacacaacagccagagtcaaatattctggatatcgacttgcgccctgccagtgcatggaccctgtacgctgtagccactacattcataacgcccatgctcaggcattctattgagaactccagcgtgaatgtttcactgaccgcgatcgctaaccaggccactgtgcttatgggactcggtaagggctggccgctgagtaaaatggacattggggtcccattgctggcaatcggatgttacagccaggtgaatcctataacattaaccgccgctctactgctccttgtcgcacactatgccatcattggccccggtctgcaagcgaaggctacccgggaagcccagaaacgtgcagccgctgggatcatgaagaacccaacagtggatggcattactgttatcgacttggatcccattccttacgacccgaaatttgagaagcagctgggacaggtgatgctcctggtactttgcgtgacgcaagtcttaatgatgagaaccacatgggccctgtgtgaagcactcactttggctaccggccccatctccacactgtgggaggggaatccaggaaggttctggaacaccactatagccgtttctatggcgaatatttttcgcggcagctatctagccggtgcagggctactcttctccatcatgaagaacacggctaacacacggcgaggaaccggcaatactggtgaaacccttggcgagaaatggaagaacagactgaatgccttggggaaatcagagtttcagatctacaagaaatctggcattcaggaagtggataggacactggcaaaggagggcataaaacgcggggaaactgaccatcacgctgtcagtcggggatcggccaagctcagatggttcgtggagcgtaacctggtaacccctgagggcaaggtgatggatttaggttgcgggaggggaggctggagctattactgtggtggccttaaaaatgttaaggaagtgaaagggctgacaaagggaggccccgggcatgaggaacctatcccaatgtccacgtatggatggaacctcgtccggctacaatctggcgtggacgtcttctttacaccacctgagaaatgcgatactctgttgtgtgacattggtgaatcaagcccaaatcccacagtggaggccgggcgcaccctgcgagttctcaaccttgtagagaattggctgaacaataacactcagttctgcatcaaggtgttgaatccgtacatgccttccgtcattgaaaagatggaggcgctgcagagaaaatacggaggcgctctcgtgaggaacccattaagtagaaattctacacacgaaatgtattgggttagcaacgcatcaggcaacatcgtgtccagtgtcaatatgataagccgcatgctgatcaacagatttaccatgaggcacaagaaagccacgtacgagcccgatgtggaccttgggtctggaacccgaaatattggtatcgaatccgagacacctaacctggatattatcggcaagcggatagagaaaattaagcaggaacatgagacttcatggcactatgaccaagaccatccatacaagacctgggcttatcacgggagctacgaaacaaaacagactggatcggcctctagtatggtaaatggcgtggttcgtctactcaccaagccctgggatgtcatcccgatggtgacacagatggcaatgaccgacactacgcctttcggtcagcaaagagtgtttaaagagaaggtcgatacacgcacccaggaacccaaagaggggactaagaagctgatgaaaatcaccgccgagtggttgtggaaggaactgggcaagaagaaaacaccaaggatgtgtacgcgggaggagttcaccagaaaggttcgctccaacgctgcgctcggcgccatttttactgacgagaataaatggaaaagcgcaagggaggctgtggaagattcaggcttctgggagcttgtagacaaggaacgaaacctgcacttagaggggaaatgcgaaacatgtgtgtataatatgatgggaaagcgggagaaaaagctgggtgagtttggcaaagccaaggggtccagagcaatatggtacatgtggttgggagccaggttcctcgaatttgaggctctgggcttcctaaacgaagatcattggttttctcgcgagaatagccttagtggtgtcgaaggggagggactgcacaagctcggctacatcctgcgtgacgtgtccaaaaaggagggcggggccatgtatgcggatgacaccgcaggatgggatactcggattacattggaagacctgaaaaacgaggaaatggttaccaatcatatggagggtgaacacaagaaactcgccgaggctatcttcaaacttacataccagaacaaggtggtcagagtgcagaggcctactccccgcggcaccgtaatggacattatcagccgacgggatcaaagagggtctggacaggttgtgacgtatggcctgaataccttcacaaacatggaggcccagttaataaggcaaatggaaggtgagggggtctttaaatcaatccagcagctgactgcaaccgaagagattgctgtgaagaactggttggcccgcgtgggaagagagcggctcagtaggatggctatctccggcgacgattgcgtcgttaaaccactggacgatcgtttcgccagcgcactaacagcgcttaatgacatgggcaaggtgcgaaaagatattcagcaatgggaaccctctcgcgggtggaacgactggactcaggtacctttttgctcgcatcacttccacgagctgatcatgaaggatggaagagtgctcgtcgtgccatgtcggaatcaggacgaactgattggtagggcccgcatatcacagggcgctgggtggagcttgagagagaccgcctgcttaggaaagtcctacgcacaaatgtggagtctgatgtattttcatcggagggatctccgacttgctgccaacgcaatctgttctgccgttccgagccactgggtgcccacgtcccgtacaacctggtcaattcatgcgactcacgaatggatgacaaccgaggacatgctgactgtctggaatagagtgtggatccaggagaacccttggatcgaagataaaaccccagtagagagttgggaagagattccctacctaggcaagcgcgaagaccagtggtgcggttctctgatagggctcacaagccgggctacgtgggccaaaaatatccagaccgcaattaaccaagttaggtccttgatcggaaatgaggagtatactgactacatgccttcaatgaagagattccgccgggaagaggaagaggccggcgtgctgtggtga

SEQ ID NO: 15058 - RNA, 9876 nt, synthetic construct
  misc_feature 1..9876: note = derived and/or modified CDS sequence (opt3) from DENV-2__DQ645556__SS-prME
  source 1..9876: mol_type = other RNA
accgcaggagtgatcattatgatgatacccaccgtagttgctttccacctgactacgcggaatggggagcctcatatgatcgtgagcaggcaggaaaagggaaagtccctcctttttaagaccgagaatggtgtaaatatgtgcacactgatggcaatggacttgggagaattatgtgaggatactattacctacaattgcccactgctgcggcaaaacgaaccggaggacatcgattgttggtgcaattctacatcaacctgggtgacttatgggacatgtaccgccacgggagagcaccgccgagaaaaacgtagtgtcgcgctcgtgccccatgttggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagaaggggtttcaggaggtagctgggtggatatagtcctggagcacggcagttgtgtgaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtcgacagaggatggggcaacggttgtgggctgttcggaaagggcggcattgttacttgcgctatgtttacctgcaagaaaaatatggaggggaaggtggtacagcctgaaaacctagagtatacaatcgtgatcaccccacactccggagaagagaatgccgtcggtaacgatactggcaaacatgggaaggagattaaagtgacgccgcagtcaagtataacagaagcagagctcaccggatacggcactgttaccatggaatgtagccccaggacaggtctggacttcaatgagatggtgcttctgcagatggaagataaggcttggttggtccaccggcaatggtttctcgacctgcctttaccatggctgcccggggccgatacccagggctctaactggatccagaaagagactctcgtgacattcaagaaccctcacgcgaagaaacaggacgtagttgtgcttggatcccaagagggcgccatgcatacggcactgaccggggctactgaaattcagatgtcaagcggaaatttgctatttacaggtcacctgaagtgccgtctccgcatggacaaactgcagcttaagggcatgagttattctatgtgtaccgggaaattcaaggtcgtgaaggagatcgccgaaacacaacatggaactatagtcattagagtgcagtacgagggcgatggttccccatgcaaaatccccttcgagatcatggacctggaaaagaggcacgttttggggcggctcattaccgtgaacccgatcgtaacggagaaagatagccctgtcaatattgaagctgagcccccatttggcgactcgtacataatcattggagtggaacctggccagctgaagttatcttggttcaaaaaggggtcctcaatcggacagatgtttgagaccacaatgcgaggtgccaagcgcatggcaatcctgggcgatactgcctgggacttcgggagtctaggaggcgtttttaccagcattggtaaagctctccatcaagtgttcggggcgatatatggcgcagccttttccggagtctcttggacaatgaagatcctgattggcgtggtaatcacttggattgggatgaacagcagatcaaccagtctttccgtgagcttggttctggtcggagtggtgacgctctacctgggcgtcatggttcaggctgattctggttgtgtggtgtcatggaaaaataaggagcttaaatgcgggagtggaatcttcataacagacaacgtacacacctggactgaacagtataagtttcagcccgagagcccatccaagctggcctctgcaatccaaaaagcccacgaagagggcatttgtggtatcaggtcggtcacacggttggaaaatctcatgtggaagcagattacccccgagctgaaccatatcttaagcgagaatgaagtgaaactgactataatgaccggcgatattaaggggatcatgcaggctggaaaacgctccctaagacctcagccaacagagctcaagtactcatggaaagcctggggcaaggcaaagatgctgagtacggaacttcacaaccataccttcttgattgacgggccggagactgcggaatgccccaatacaaacagggcttggaactctctggaggttgaggattatggatttggcgtgttcaccacaaacatctggctcaaactgaaggaacgtcaagacgtcttttgtgacagcaaattaatgtccgccgcaataaaggataatcgggccgtgcacgctgacatgggttactggatcgagtcagccctgaacgatacttggaaaattgaaaaggccagcttcatcgaggttaagtcttgccactggcctaaatcccataccctttggagtaacggggtgttggagagcgaaatgattatcccaaagaatttcgctggacccgtatctcagcacaactatcgacctggctaccatacgcagacagccggtccatggcacctcggcaaactggagatggactttgatttctgtgaagggaccactgtcgtggtgaccgaggactgcggaaatagaggcccctccctaaggacaactaccgcgtcagggaagctgataacagaatggtgctgtcgcagttgcacgctcccgcctctgcggtacagaggagaggatggctgttggtatggtatggagattaggccacttaaagaaaaggaggaaaacttggtcaatagcctggttaccgccgggcatggacagatcgacaacttttcgttaggcgtgctcggtatggctctgttccttgaggaaatgctgcgcactcgagtaggcacaaagcacgcaatcttgctcgtggccgtctcctttgtgaccctgattactgggaatatgtctttccgggatctaggacgtgttatggtgatggtcggcgctacaatgaccgacgatatcgggatgggagtgacgtacctggccctcctggcagcgtttaaagttagacccactttcgccgctggccttttgctgaggaagttaaccagcaaagagctcatgatgacaaccattggtatagtgctgctttcacaaagtactatccctgagacaattctggaactaaccgacgccctcgcactggggatgatggtcttgaagatcgtacgcaacatggagaaatatcagctggctgtgacaattatggccatcttatgcgttcccaatgcagtgatactccagaacgcctggaaggtctcctgtactatcctggctgtggtatctgtgagcccacttctgttgacctcctcacaacagaaggcggattggattcctctcgccctgacgatcaaaggactaaatcccacagcaatttttctgaccactcttagccggaccagtaagaaaagatcttggccactcaacgaagctatcatggccgtcggcatggtttccatactggccagctcgttgctgaagaatgacattccgatgacaggccctttagtggctgggggactcctgactgtgtgctacgtccttaccggtaggtcagcagacctggagttggaacgagccgcggatgtgcgctgggaggagcaggctgaaatctctggcagttcccccatcctcagcattacgatatctgaggacgggagcatgtccatcaaaaacgaagaggaggaacagacactgaccattctaatccggactggactgcttgttatttcaggcctcttcccagtaagtatccccataacagccgcagcctggtatctgtgggaggtgaagaaacaaagagctggtgtcttgtgggatgtgcctagcccaccccctgttgggaaggcagaattagaggacggagcctacaggatcaagcagaaaggcattctgggctattctcagatcggggcgggagtgtacaaggaaggtacctttcacactatgtggcatgtcacacgtggcgctgtgctcatgcacaaagggaagcgcattgagccgtcctgggccgatgtcaagaaggacctgatctcatacggaggcggttggaaacttgagggggaatggaaagagggagaagaggtccaggtgctggcattggaaccaggcaagaatccccgggccgttcaaaccaaacctggcctattcaagacgaacactgggaccataggagctgtgagtctggattttagcccaggtacatccggctctcccattgtcgacaaaaaggggaaggtggttggactctatggcaacggtgtggtcaccagatcggggacatacgtgagcgccatcgcacagactgagaaatcaatcgaggataatcctgaaattgaggacgatatcttcaggaagaaacgactgaccataatggaccttcatccgggagctggcaagacgaaacggtatttacccgccattgtacgcgaagcgatcaagagaggcctgaggacactcattttggccccaactcgggtggttgcagctgagatggaagaggccctgcgagggctccctatcagataccagacccccgctatacgcgcagagcacacaggaagggaaattgtcgatctgatgtgtcatgccaccttcactatgcgtcttctgtccccaatccgggtgcctaactataatttgatcattatggacgaggcccactttaccgaccccgctagtatcgcggcaagaggttacatttctacaagggtggaaatgggcgaggccgctgggatattcatgacggccactccaccgggaagccgcgatccttttccccagtccaacgcaccaatcatggacgaggaacgagagattcccgaaagatcatggaactctggccacgagtgggtcaccgatttcaagggtaaaacagtatggtttgtgcctagcatcaaggccgggaacgacatcgctgcgtgcctacggaaaaatggaaagaaagttattcaactgagtaggaagaccttcgattccgaatatgtgaagactcgcacaaacgactgggattttgtcgtgaccacggacataagcgagatgggcgccaatttcaaagcagagcgtgttatcgatccaagacggtgtatgaagcccgtgattctcactgacggcgaagagagggtcatcttagctgggcctatgccggtgacacattcttcagccgcacagcgccgaggaagagtaggtcggaaccccaagaatgaaaacgatcagtacatttacatgggcgagcccctggaaaatgacgaggactgcgcccactggaaggaggctaaaatgcttctggataacatcaatacccctgaagggataatcccctccatgtttgagccagaaagggagaaggtggacgccattgatggagaatatcgcctcagaggcgaggcgaggaaaaccttcgttgacttgatgcggcgtggtgatctgcctgtctggctcgcataccgcgtggccgctgaggggatcaactatgccgaccgaagatggtgttttgatggcgtgaagaacaatcaaattctggaagagaacgtcgaagttgagatctggactaaggagggagaaaggaagaaacttaaaccccggtggctagacgctcgcatatacagtgatccactggcattgaaagagttcaaagagttcgccgctggcagaaagagcttaacactgaatctcattaccgagatggggaggctgcctacatttatgactcagaaggcccggaacgcacttgacaatctggcggtgctccatacggccgaagctggaggtcgagcctataaccacgcattgtcggagctgccggagaccctagaaacactgctccttctgactttattggctaccgtaacaggcgggatcttcctgtttctcatgtctggaaaaggcattggtaagatgaccctggggatgtgctgcatcataactgcctccgtgcttctgtggtacgcacagatccagccccactggattgccgctagcatcattctcgagttctttttgatcgtcctgttaataccagaacctgagaaacaaagaacgccccaggataatcagctaacctatgtggttattgcgatcctgacagtggtcgccgcaactatggctaacgaaatgggcttcctcgagaagaccaaaaaggactttggacttggcgggatcgccacacagcaaccagagtcaaatattctggatatcgacttgcgccctgccagtgcatggaccctgtacgctgtagccactacattcataacgcccatgctcaggcattctattgaaaactccagcgtgaatgtttcactgaccgcgatcgctaaccaggccactgtgcttatgggactcggtaagggctggccgctgagtaaaatggacattggggtcccattgctggcaatcggatgttacagccaggtgaatcctataacattaaccgccgctctactgctccttgtcgcacactatgccatcattggccccggtctgcaggcgaaggctacccgggaggcccaaaaacgtgcagccgctgggatcatgaagaacccaacagtggatggcattactgttatcgacttggatcccattccttacgacccgaaatttgaaaagcagctgggacaggtgatgctcctggtactttgcgtgacgcaggtcttaatgatgagaaccacatgggccctgtgtgaggcactcactttggctaccggccccatctccacactgtgggaagggaatccaggaaggttctggaacaccactatagccgtttctatggcgaatatttttcgcggcagctatctagccggtgcagggctactcttctccatcatgaagaacacggctaacacacggcgaggaaccggcaatactggtgagacccttggcgagaaatggaagaacagactgaatgccttggggaaatcagaatttcaaatctacaagaaatctggcattcaggaggtggataggacactggcaaaggaaggcataaaacgcggggagactgaccatcacgctgtcagtcggggatcggccaagctcagatggttcgtggagcgtaacctggtaacccctgaaggcaaggtgatggatttaggttgcgggaggggaggctggagctattactgtggtggccttaaaaatgttaaggaggtgaaagggctgacaaagggaggccccgggcatgaagaacctatcccaatgtccacgtatggatggaacctcgtccggctacagtctggcgtggacgtcttctttacaccacctgaaaaatgcgatactctgttgtgtgacattggtgagtcaagcccaaatcccacagtggaggccgggcgcaccctgcgagttctcaaccttgtagaaaattggctgaacaataacactcaattctgcatcaaggtgttgaatccgtacatgccttccgtcattgagaagatggaagcgctgcagagaaaatacggaggcgctctcgtgaggaacccattaagtagaaattctacacacgagatgtattgggttagcaacgcatcaggcaacatcgtgtccagtgtcaatatgataagccgcatgctgatcaacagatttaccatgaggcacaagaaagccacgtacgaacccgatgtggaccttgggtctggaacccgaaatattggtatcgagtccgagacacctaacctggatattatcggcaagcggatagagaaaattaagcaggaacatgaaacttcatggcactatgaccaggaccatccatacaagacctgggcttatcacgggagctacgagacaaaacaaactggatcggcctctagtatggtaaatggcgtggttcgtctactcaccaagccctgggatgtcatcccgatggtgacacagatggcaatgaccgacactacgcctttcggtcagcagagagtgtttaaagaaaaggtcgatacacgcacccaagagcccaaagaggggactaagaagctgatgaaaatcaccgccgaatggttgtggaaggagctgggcaagaagaaaacaccaaggatgtgtacgcgggaagagttcaccagaaaggttcgctccaacgctgcgctcggcgccatttttactgacgagaataaatggaaaagcgcaagggaagctgtggaggattcaggcttctgggaacttgtagacaaggagcgaaacctgcacttagaagggaaatgcgagacatgtgtgtataatatgatgggaaagcgggagaaaaagctgggtgaatttggcaaagccaaggggtccagagcaatatggtacatgtggttgggagccaggttcctcgagtttgaagctctgggcttcctaaacgaggatcattggttttctcgcgaaaatagccttagtggtgtcgagggggagggactgcacaagctcggctacatcctgcgtgacgtgtccaaaaaggaaggcggggccatgtatgcggatgacaccgcaggatgggatactcggattacattggaggacctgaaaaacgaagagatggttaccaatcatatggaaggtgagcacaagaaactcgccgaggctatcttcaaacttacataccagaacaaggtggtcagagtgcagaggcctactccccgcggcaccgtaatggacattatcagccgacgggatcagagagggtctggacaagttgtgacgtatggcctgaataccttcacaaacatggaagcccagttaataaggcagatggagggtgaaggggtctttaaaaacatccaacagctgactgcaaccgaggagattgctgtgaagaattggttggcccgcgtgggaagagaacggctctcaaggatggctatcagtggcgacgattgcgtcgttaaaccactggacgatcgtttcgcctccgcactaacagcgcttaacgacatgggcaaggtgcgaaaagatgtacagcagtgggagcccagccgcgggtggaatgactggactcaagtgcctttttgctctcatcacttccacgaactgattatgaaggatggaagagtcctcgtggttccatgtcggaaccaggacgagctgatcggtagggcccgcatttcgcagggcgctgggtggtcattgagagaaaccgcctgcttaggaaagagctacgcacagatgtggtccctgatgtattttcatcggagggatctccgacttgctgccaatgcaatatgtagtgccgtgccgtctcactgggtccccacgagccgtacaacctggtccatccatgcgactcacgagtggatgacaaccgaggacatgctgactgtgtggaacagagtatggattcaagaaaatccttggatcgaggataaaaccccagttgaatcatgggaggaaatcccctacctaggcaagcgcgaggaccagtggtgcggtagtctgattgggctcacatctcgggctacgtgggccaaaaacatacagaccgcaatcaatcaggtgaggagcttgattggaaacgaggaatatactgactacatgccttccatgaagagattccgccgggaggaagaggaagccggcgtcctgtggtga

SEQ ID NO: 15059 - RNA, 9876 nt, synthetic construct
  misc_feature 1..9876: note = derived and/or modified CDS sequence (opt3) from DENV-2__AF204178__SS-prME
  source 1..9876: mol_type = other RNA
accgccggcatgatcattatgctgatacccacagtgatggctttccacctcactacgagaaacggggagcctcatatgatcgtcagcaggcaggaaaagggaaaatcccttctgtttaagaccggtgacggcgttaatatgtgcacattgatggcaatggatccaggggagttatgtgaagacactattacctacaaatgcccgctgctaaagcaaaacgagcccgaagatatcgactggtggtgtaattctacatcaacctgggtgacttatggaacatgcaccacgactggcgagcaccggcgcgagaaacgaagtgtagccctcgtgcctcatgtcggtatggggctggaaacccgtacagagacttggatgagctccgaaggagcgtggaagcacgctcagagaattgagacctggatccttaggcatccaggcttcacaatgatggccgcaatactggcctacaccatcggcacgactcactttcagcgggctttgattttcatcctcctgacagcagtggccccctctatgaccatgcgctgtattgggatctcgaacagagattttgttgagggagtgtcaggtggcagctgggtcgacatagtgctggaacacgggagttgcgtaactacaatggctaagaataaacctaccctcgatttcgagttaattaagacggaagccaaacagccagcgaccctgaggaagtattgtatcgaggcaaaacttacaaacactaccacagactcccggtgccccactcaaggagaaccttctttgaatgaggagcaggataagcgctttgtttgtaagcatagcatggtggaccgaggctggggtaacgggtgcggactgttcggcaaaggcgggattgtcacctttgccatgttcacatgtaagaaaaatatgaagggaaaagtggtgcagccagaaaacctagagtacaccatcgtcatcactccgcactccggtgaagagcatgctgttggcaatgatacggggaagcacggaaaagaaattaagataacaccccagtcaagtatcaccgaggccgagctcactggctatggtaccgtgacaatgaagtgcagccctagaaccgggctggactttaacgaaatggtacttctgcaaatggagaataaagcatggttggtgcacaggcagtggttcctcgatctgccattaccctggctgcctggcgctgacactcagggatctaactggattcagaaggaaacactcgtcacgtttaaaaatccacatgccaagaaacaagacgtggttgtgcttggctcccaggagggggcgatgcacaccgccctgactggagcaacagaaatccagatgtcaagcggtaacttgctattcaccggccatctgaagtgccggctccgtatggataagctgcaacttaaagggatgagttactctatgtgtacaggaaagttcaaagtcgtgaaggagatagctgagactcagcacggcaccattgtaatccgcgttcagtatgaaggtgacgggtccccctgcaaaatcccgtttgagattatggatctggaaaagagacatgtgttgggcaggctcatcacggtcaaccctattgtgaccgagaaggacagccccgtcaatatagaggccgaaccacctttcggagattcgtacatcattatcggcgtggagcccgggcagctgaaattaaactggtttaagaaaggatcttccatcggtcaaatgttcgaaacaactatgcggggcgctaagcgaatggccattctgggggacaccgcatgggattttggatcactaggcggtgttttcacaagtatagggaaagccctccaccaggtgtttggcgctatctacggagcggcattcagcggcgtatcctggactatgaagattctgatcggggtcattatcacctggataggaatgaattctcgcagcacgtcacttagtgtgtccttggttctggtgggcgtcgtgacactctatctgggtgtaatggtgcaggccgacagcgggtgtgttgtctcttggaagaacaaagagcttaagtgcggatcaggcatctttattaccgatgacgtgcacacttggacagaacagtacaaattccaaccagagagtcccagcaagctggcttccgccatccagaaagcacatgaggaaggtatttgtggcatcagatctgtgaccaggttggagaatctcatgtggaagcagataactcctgaactgaaccacattttatcggagaatgaagtcaaactgaccatcatgacaggggatattaagggaatcatgcaggccggcaagcggagcctacgcccacaaccgacggagctcaaatattcctggaagacctgggggaaagctaagatgctgtcaactgagagtcataaccagacatttcttatagacggacccgaaaccgccgagtgccctaatacaaacagagcatggaattctttggaagttgaggactacggcttcggtgtgtttactaccaacatctggctgaaactcagggaaaagcaggatgtgttctgtgacagcaagctgatgtccgcggtaattaaagataatcgtgctgcccacgcagacatggggtattggatcgagtcagccttaaacgatacgtggaagattgagaaagctagcttcatcgaagtcaagtcttgccactggccaaaatcccatacactgtggagtaatggagtgcttgagagcgaaatgataattcccaagaactttgccggccctgtttctcagcacaactaccggccaggttatcatacccaaactgcaggcccctggcacttggggaagctcgagatggacttcgatttttgtgagggaaccacagtggtcgtgactgaagactgcggcaatcgagggccgtccctgagaaccacaacggcttcaggaaaactaatcaccgagtggtgttgcaggagttgcactctgcctccactccgctaccggggcgaagatggttgttggtacgggatggagatcagacccctgaaggaaaaagaggagaaccttgttaatagcttggtgacagccggacatggccagattgacaacttctcgctgggtgtattaggcatggcgctctttctggaagagatgcttaggacccgcgtcgggactaagcacgccatcctgttggtggctgtgtccttcgtcacactcattaccggaaatatgtcttttcgagatctgggccgggttatggtgatggtaggggcaacgatgactgacgatataggaatgggcgtgacctatctagccctgctcgctgccttcaaagtccgtcctacatttgcagcgggtctgcttttgagaaagctgaccagcaaggaattaatgatgactacaatcgggattgtgctcctgtcacagagtaccatccccgagacaattcttgaactgactgacgccctagctctcggaatgatggttctgaaaatggtgaggaagatggagaaataccaattggccgtcaccatcatggcaatactgtgcgtgccaaacgctgttatcttacagaatgcctggaaggtgtcctgtacgattctcgcagtcgtatctgtgagccctctgttcatcacatcctcacagcagaaagccgactggattccccttgctctgaccatcaagggcttgaacccaactgcgatatttctcaccacactgagccgcactaataaaaagcggagttggccgctaaacgaggccattatggcagttggcatggtgtctatcctggcttccagccttctcaagaatgatatccctatgaccgggcccctggtcgccggaggtttgctgacggtgtgctatgtattaacaggcagatcggccgacctcgaactggagagggctgcagatgtgaaatgggaagaccaagccgagatttcagggtctagtccaatactttccatcaccattagcgaagatggatctatgagcatcaagaacgaggaggaagagcagattctgactatcttgatacgaacaggcctcctggtcatctccggtctattccccgtttcaattcctatcaccgcggctgcctggtacctgtgggaagtgaaaaagcagcgcgcaggggtgctttgggacgtcccaagtccccctccggtgggaaaagccgagctcgaggatggcgcttatcggattaagcagaagggcatcctggggtacagccaaataggagcaggtgtttataaagaaggcacttttcacacaatgtggcatgtaaccagaggggccgtgttgatgcacaagggaaaaaggattgagccatcttgggcggacgtcaagaaagatttaatctcctacggcggtgggtggaagctggaaggagagtggaaggaaggcgaggaggtgcaggttctcgctctggaacccggcaaaaatcctcgtgccgtgcagacgaagccagggcttttcaaaactaacgcaggaaccatcggtgccgtctcactggacttcagtcccggcacaagcgggtcccctattatcgataagaaaggaaaggtggtaggcttgtacggtaatggggtcgtgacccgctctggagcttatgtttcggccatagcacagacagagaagagcattgaagacaacccggagatcgaagatgacatttttcggaaaagaaagctaactatcatggacctgcatcccggcgctggcaaaaccaagaggtacctcccagccatagtgcgagaggcgattaaacgggggctgcgcacgcttatcttagcccctacaagagtcgtggcagctgagatggaagaggccctgaggggactccccatccggtatcaaactccagctattcgagcagaacacaccggtagagagatcgttgatttgatgtgtcatgccacattcaccatgcgcctgctctcacctgtgagggtccccaactacaatctgattataatggacgaagcccactttactgatccagcttccatcgcggcacgtggctatattagtacccgggtggagatgggggaggccgctggaatcttcatgacagccacgccgcctggctctagagacccctttccacagagcaacgcacccatcatggatgaagagagggaaattcctgagcgctcctggtcatctggtcacgagtgggtaactgacttcaaggggaagaccgtgtggtttgttccaagcataaaagccggaaatgatatcgctgcgtgccttcgaaagaacggcaaaaaggtcattcagctgagtagaaaaacattcgactccgaatacgtgaagacccggactaatgattgggactttgtggtcacaaccgatatcagcgagatgggcgccaacttcaaagcagaaagggtaattgacccccgccgttgtatgaagcctgtgatcttgacggacggggaggaaagagttatactagctggaccgatgccagtgactcattcttcagccgcacaacggaggggtcgcatcggccgaaatcccaagaacgagaatgatcagtatatttacatgggggagcctctggaaaacgacgaggattgcgcccactggaaagaagctaagatgctcttagacaatatcaacacacccgagggaattatcccatccatgtttgaacctgagagagagaaagtcgatgccatagacggcgaataccggctgaggggtgaggcgcgcaagaccttcgtggatcttatgagaaggggggacctgcccgtttggctcgcatatcgggtggccgctgaaggcattaattacgccgatcgtcgctggtgtttcgacggaatcaaaaacaatcagattttggaggaaaacgtcgaggtggagatctggaccaaggaaggcgagcgaaagaaactgaagccaagatggctcgatgctaaaatatatagtgaccctctggcacttaaggaatttaaagagttcgccgctgggaggaagagcctaactctgaacttgatcacagagatgggacggttaccgacctttatgacacagaaggcccgcgatgcactggacaatctcgcggtactgcatactgccgaagctggtggcagagcctacaaccacgcactttcggagctgcccgaaacgctcgagaccttgctgctactgacactccttgctactgtgaccgggggaattttcctgtttttaatgtctggcaggggtatcgggaaaatgacattgggcatgtgctgtattatcaccgcctccatactgctctggtatgcacaaattcagccacactggatcgccgctagcatcattctggaattctttcttatcgttctgctcatacctgagcccgagaagcagcggactccacaggacaatcaattgacgtacgtcgtgattgcgatcctgaccgtggtcgccgcaacaatggctaacgaaatgggattcttagagaaaactaagaaagatctaggcctggggtcaattaccacacagcagcctgaaagtaatatcctcgacatagatcttcgacccgcctctgcctggaccctgtatgcagttgctactacatttgtgacgccgatgttgagacattccatcgagaacagctcagtaaatgtgagtctgaccgccattgcgaaccaggctactgtcctcatgggactgggtaagggctggccacttagcaagatggacatcggggtgcctctcctggccattggatgctactcccaagttaatcccatcacattgaccgcagccctgttcttactagtggctcactacgcaattatcggcccaggtctgcaggccaaagcgacccgcgaagctcagaagagggccgcagccgggataatgaaaaaccccacagtcgatggcattactgtaatcgacctcgatcctatcccgtatgaccccaagtttgagaaacagcttggacaagtgatgctgttggttctgtgcgtgacgcaggtcctcatgatgcggaccacatgggctctgtgtgaggcccttactttagcaaccggcccaatttctacactgtgggaagggaatcctggacgtttctggaacaccactatagctgtgagcatggccaatatctttagaggctcctacctcgcgggtgccgggttgctgttctcaattatgaagaacacgacaaataccaggcgcggaactggcaacatcggtgagaccctaggcgaaaaatggaagattcggctgaatgcactcgggaagtctgagttccagatctataaaaagagtggaatacaagaagtcgatcgaacacttgctaaagagggcatcaagagaggggagactgaccatcacgccgtgtcgaggggaagcgcaaaactgcgctggtttgttgaacggaacatggtgacccccgagggcaaggtagtggatttgggttgcgggagaggaggctggtcctactattgtggtggcctgaagaacgtccgtgaagttaaagggctcacaaagggaggccctgggcatgaggagccaattcccatgtctacgtacggatggaatctggtgaggttacagtcaggcgtcgacgtgttctttacccctccagaaaaatgcgatactcttctgtgtgacatcggtgagagctcccccaacccgacagtagaagctgggcggaccctccgcgtgctaaatctggttgagaactggttgaataacaatactcagttctgcattaaggtgctgaacccttatatgccaagtgtcatcgaaaaaatggagacactccagcgaaagtacggaggcgcccttgtgggcaatcccctgtctagaaacagcacccacgagatgtactgggtctcaaatgcctccgggaacatagtgagtagcgttaatatgatttctaggatgttgatcaaccggtttacgatgcgccacaagaaagcgacctatgaacctgacgtagatctgggatccggtacaagaaatatcggcattgagtcagaaataccaaacctcgacatcattgggaagaggatcgagaaaattaagcaagaacatgagactagctggcactacgatcaggaccatccctataaaacctgggcttaccacggatcgtatgagacaaagcagactggctctgcaagttccatggtgaacggtgtcgtgcgattactgaccaagccgtgggatgttgtgcctatggtcacacagatggccatgaccgacactacgcccttcgggcaacagcgggtgtttaaagaaaaggtagatacacgtacccaggagccaaaagaaggaactaagaaacttatgaagatcaccgctgagtggctgtggaaagaactaggcaagaagaaaacacctagaatgtgtacgcgcgaggagttcaccaggaaggtgcggagcaatgccgcactcggcgccatatttactgacgaaaacaaatggaagtcagctagagaggcggttgaagattcccgcttctgggagctggtcgacaaagagaggaatttgcacctggaagggaagtgcgagacatgtgtgtacaacatgatgggaaagcgagaaaaaaagctcggtgagtttggcaaagccaaggggtctcgggcaatctggtatatgtggcttggagctagattcctggaatttgaggccttaggcttcctgaatgaggatcattggttcagcagggaaaacagtttgtccggtgtggagggggaaggactctacaaactgggctacattctacgcgacgtcagcaagaaggagggcggggcaatgtatgccgacgataccgctggatgggacactcgtatcacacttgaagatctgaaaaatgaggagatggttaccaaccacatggaaggtgagcataagaaactcgccgaagcgatttttaagctgacataccagaataaagtggtacgggtgcaaagacccactccaaggggcaccgtcatggacatcatttctcgccgagatcagcgggggtcaggacaggtgggcacgtatggtttgaacaccttcacaaatatggaggcacaactgataagacagatggaaggggagggagtttttaagagtatccagcacctcactgtgaccgaggaaattgccgtccagaactggcttgctagggtgcgcagagagcggctgtccaggatggccatcagcggcgacgattgcgtagttaagcccttagacgatcgtttcgcatctgctctgacagccttgaatgacatgggcaaagtgcgaaaggatatccaacagtgggaaccttcgcgcgggtggaacgactggactcaggtcccattttgttcacatcacttccacgagctcattatgaaagatggaagagtgctggtggtcccgtgccggaatcaggacgagctaataggtagggctcgcatcagccaaggcgccgggtggtcccttagagaaaccgcatgcctgggaaagagttacgcgcagatgtggtctctcatgtattttcatcggagggacctgcgattggccgctaacgccatttgtagcgcagttccctcccactgggtgcctacgtcacgtacaacctggagtatccatgctaaacacgagtggatgactacagaagatatgttaaccgtatggaacagagtgtggattcaggagaatccatggatggaagacaagactcccgtcgagtcttgggaggaaatcccttacctgggcaagcgcgaggatcagtggtgcggtagcctcatagggcttacctcccgggccacatgggcaaaaaacatccaaacggccattaatcaggtgaggtcactgatcggaaacgaagagtataccgactacatgccaagcatgaagagattccgccgggaagaggaggaagcgggcgttctatggtga

SEQ ID NO: 15060 - RNA, 9876 nt, synthetic construct
  misc_feature 1..9876: note = derived and/or modified CDS sequence (opt3) from DENV-2__AF204177__SS-prME
  source 1..9876: mol_type = other RNA
accgccggcatgatcattatgctgatacccaccgtgatggctttccacctcactacgcgaaacggggaacctcatatgatcgtcagcaggcaggaaaagggaaaatcccttctgtttaagaccggtgacggcgttaatatgtgcacattgatggcaatggatttaggggaactgtgtgaagacactattacctacaaatgcccattactccggcaaaacgaaccggaagatatcgactgttggtgcaattctacatcaacctgggtgacttatggaacatgtaccacgactggcgagcaccgccgagagaagcgtagtgtcgccctggtgccccatgtcggtatggggcttgaaaccagaacagagacttggatgagctccgaaggagcgtggaaacacgctcagaggattgagacctggatcctgcggcatcctggcttcacaataatggccgcaatcttggcctacaccattggcacgactcactttcagcgcgctctcatcttcattctgctgacagcagtggccccatctatgaccatgagatgcatcgggatatcgaacagggattttgttgagggagtgtcaggtggcagctgggtcgacattgtgctcgaacacgggagttgtgtgactacaatggctaagaataagcccaccttagatctggagcttatcaaaacggaagccaagcagtccgcgaccttgcggaaatattgcattgaggcaaagctgacaaacactaccacagaatctcgctgtcctactcaaggagagccaagcctgaatgaggaacaggacaaacgattcgtttgcaagcattccatggtggatagaggctggggtaacgggtgtggactctttggcaagggcgggatcgtaacctgcgccatgttcacatgcaaaaagaatatgaaaggaaaggtggtgcagcccgagaacctggaatacaccatcgtcattactcctcactcaggtgaggaacatgctgttggcaatgacacggggaaacacggaaaggagataaaaatcacaccacagagtagcattaccgaggccgaacttactggctatggtaccgtgacaatggagtgttctccgaggaccgggctggattttaacgaaatggtattgctccaaatggagaataaggcatggctggtgcaccggcagtggttcttagacctgcccctcccttggcttccaggcgctgatactcagggatccaactggatccagaaggaaacactggtcacgtttaaaaatccccatgccaagaaacaagacgtggttgtgttgggctcacaggagggggcgatgcacaccgccctgactggagcaacagagatacagatgagcagtggtaacctactcttcaccggccatctgaagtgccgtcttcgcatggacaaactgcaattgaaggggatgtcttactccatgtgtacaggaaagtttaaagtcgtgaaggaaattgctgagactcagcacggcaccatcgtaatcagagttcagtatgaaggtgatgggagcccttgcaaaattccattcgagatcatggacctcgagaagaggcatgtgctgggccggttaattacggtcaaccccatagtgaccgaaaaagattcgccggtcaatatcgaggccgaacctcccttcggagactcttacattatcatcggcgtggagccagggcagctgaagctaaactggtttaagaaaggatcctcaattggtcaaatgttcgaaacaactatgcgaggcgctaagcgcatggccatactcggggataccgcatgggactttggaagtctgggcggtgttttcacaagcatcgggaaagcccttcaccaggtgtttggcgctatttacggagcggcattctccggcgtatcttggactatgaagatcttgattggggtcatcataacctggatcggaatgaatagcagatcaacgagtctgtccgtgagcctcgttctggtgggcgtcgtgacactttatctgggtgtaatggtgcaggccgattctgggtgtgttgtctcatggaaaaacaaggagttgaagtgcggaagtggcatttttatcaccgacaatgtgcacacttggacagagcagtacaaattccaacctgaaagcccctccaagctcgcttctgccattcagaaagcacatgaggaaggtatctgtggcataaggtcggtgacccggctggagaacttaatgtggaagcagattactccagaactgaatcacatcctaagcgagaacgaggtcaaactcaccattatgacaggggatatcaagggaataatgcaggccggcaaacgctccctgagaccccaacctacggaacttaagtattcatggaagacctgggggaaagctaagatgttgagtactgagtctcataatcagacatttctgatcgacggaccagaaaccgccgagtgcccgaacacaaatagggcatggaacagcctcgaagttgaggattacggcttcggtgtgtttactaccaatatttggctgaaattacgtgagaagcaggacgtgttctgtgactccaaactgatgtcagcggctatcaaggataaccgggccgtacacgcagacatggggtattggattgaaagcgcccttaatgatacgtggaagatcgagaaggcttcttttatagaagtcaagtcctgccactggcccaaaagtcatacattgtggagcaacgaggtgctcgagtctgaaatgattatccctaagaacttcgccggaccagtttcccagcacaattaccgacccggctatcatacccaaactgcaggtccttggcacctgggcaaactagagatggacttcgatttttgtgaagggaccacagtggtcgtgactgaggactgcggaaacagaggcccatcactgaggaccacaacggctagtgggaagctcatcaccgaatgctgttgccgcagctgtactctgcccccgcttcggtacagaggagaggatggctgctggtacggtatggagattaggcctttgaaggaaaaagaggaaaatctggttaactcgttagtgacagccgggcatggacagatcgacaatttctccctcggcgtactgggtatggcgctttttctggaggaaatgttgcgcacccgagtcggcactaagcacgccattctcctggtggctgtgtctttcgtcacactaataaccgggaacatgagctttcgggatctgggacgtgttatggtgatggtaggcgcaacgatgactgacgatatcgggatgggagtgacctatctcgccctgcttgctgccttcaaagtcagaccaacatttgcagcgggcttgctgttaaggaagctcacctcaaaagagctgatgatgactacaattggtatcgtgcttctgagtcagtccaccattcccgagacaatcctagaactcactgacgccctggctttggggatgatggttctgaagatggtgcgcaagatggagaaataccaattagccgtcaccataatggcaatcctctgtgtgcctaatgctgttattctgcagaacgcctggaaggtgtcttgcacgatccttgcagtcgtaagcgtgagccccctgttcttgacatcaagccagcagaaagccgattggattccactcgctctgaccatcaagggactaaatcctactgcgatatttctgaccacacttagtaaaactaacaagaaacggtcttggcccctcaatgaagccattatggcagttggcatggtgtccatcctggctagctcgttgctgaagaacgacatcccaatgaccggcccgttagtcgccgggggactcctgacggtgtgttatgtacttacaggtagatcagccgacctggagttggaaagggctgcagatgtgaagtgggaggaccaagccgagatttctggcagttcccctatactcagcatcaccatttctgaagatgggagcatgtccatcaaaaatgaggaagaggagcagattctgactatcctaatacgaacaggactgcttgtcatctcaggcctcttccccgttagtattccaatcaccgcggctgcctggtacctgtgggaagtgaagaaacagcgcgccggtgtattgtgggacgtccccagccctccacccgtggggaaggcagagttagaagatggagcttatcggattaaacagaagggcatcctgggctactctcaaataggggcaggagtttataaggagggtacttttcacacaatgtggcatgtaaccagaggcgccgtgctcatgcacaaagggaagaggattgaaccttcctgggcggacgtcaaaaaggatctgatctcatacgctggaggctggaaacttgagggtgagtggaaggaaggggaggaagtgcaggttctggccttggagccgggaaagaacccacgtgcagtgcagacgaaacccggcctattcaagactaatgccggcaccatcggggctgtcagtctggactttagccctggaacatccggttctccaattatcgataaaaagggcaaagtggtagggctctacggaaacggcgtcgtgacccgctcgggtgcctatgttagcgcaatagctcagacagaaaagtcaattgaggacaaccccgagatcgaagatgacattttccggaagagaaaactgactatcatggatcttcatcctggggccggaaagaccaaaaggtacttaccggcgatagtgcgagaggccattaagcggggcctgcgcacgctcatcttggcacccacaagagtcgtggctgccgaaatggaggaagctctgaggggcctcccaatccggtatcaaactcctgcaattcgagccgagcacaccgggagagagatcgttgacctgatgtgccatgccacattcaccatgcgccttctgtcccccgtgagggtcccaaattacaacttgattataatggacgaagctcactttactgatcctgcgagtatcgcagcccgtggatatatttctacccgggtggagatgggtgaagctgccggcatcttcatgacagcaacgcccccagggagcagagacccgtttcctcagtccaatgcccccatcatggatgaggagagggaaattccagagcgctcatggtctagcggacacgaatgggtaactgacttcaaaggcaagaccgtgtggtttgttcccagtataaaggctggtaacgatatcgcggcctgtctaagaaagaatgggaagaaagtcattcagctgtccagaaagacattcgacagcgagtacgtgaaaacccggactaacgattgggactttgtggtcacaaccgatatctctgaaatgggagcaaatttcaaggctgagagggtaattgaccctcgccgttgcatgaaaccagtgatcctcacggatggcgaggaaagagttatattagccggccccatgcctgtgactcattcatccgcagcccaacggagggggcgcatcggacgaaacccgaagaatgagaacgaccagtatatttacatgggtgaaccactggagaatgacgaagattgtgctcactggaaggaggccaaaatgcttctggacaacatcaatacacccgagggcattatccctagtatgtttgaacccgagagagaaaaggtcgatgcgatagacggggagtaccggctcaggggagaagcacgcaaaaccttcgtggatttgatgagaaggggcgacctgccagtttggctcgcctatcgggtggctgccgagggtattaactacgctgatcgtcgctggtgctttgacgggatcaagaataaccagattctggaggaaaacgtcgaggtggaaatctggaccaaagagggcgagcgaaagaaacttaaacctagatggctagatgcaaggatatatagcgaccccctggccttgaaggagttcaaagagttcgctgccggacggaagtcgttaactctgaatctcatcacagaaatgggccgcctgccaacctttatgacacagaaagcaagagatgcgcttgacaacctggccgtactccatactgctgaggccgggggaagggcatacaatcacgctttgtctgaactgcctgagacgctagagaccctgctccttctgacattattggccactgtgaccggtggcattttcctgtttctcatgtccgggcggggaatcggcaagatgacactgggtatgtgctgtattatcaccgcaagcatacttctgtggtatgcccaaattcagccgcactggatcgctgcgtcaatcattctcgagttctttttgatcgttctgttaatacccgagccagaaaagcagcgaactcctcaggataaccaactaacgtacgtcgtgattgccatcctgaccgtggtcgcagctacaatggccaatgagatggggttcctcgagaaaactaagaaagaccttggcctgggaagtattaccacacagcagcccgagtctaacatcttggacatagatctgagaccagcctccgcatggaccctctatgctgttgccactacatttgtgacgcctatgctgcgccatagcatcgaaaattcaagtgtaaacgtgagccttaccgcgattgctaatcaggccactgtcctcatgggcctggggaagggatggcccttgtccaaaatggacatcggtgtgccgctgttagcaattggctgctactctcaagttaacccaatcacactaaccgccgctctgttcctccttgtggcacactacgccattatcgggcctggactgcaggcgaaggctaccagggaagcccagaagcgggcagccgctggcataatgaaaaatcccacagtcgatggtattactgtaatcgacttggatccaatcccctatgaccctaagtttgagaaacagctggggcaagtgatgctcctggttctttgtgtgacgcaggtcttaatgatgcgtaccacatgggccctgtgcgaagcactcactttggctaccggcccgattagcacactgtgggagggaaaccccggcagattctggaataccactatagccgtgtccatggcgaacatctttagggggtcatacctagccggagcaggcctactcttctctattatgaagaatacgacaaacacccgccggggtactgggaatatcggagaaacccttggcgagaaatggaagagtcgactgaacgctttgggtaaatcggagtttcagatttataagaagtccggcatccaagaagtcgatagaacactggccaaagaggggataaagaggggagaaactgaccatcacgcagtgtcccgcggctctgctaaactccggtggttcgttgagagaaacatggtgaccccagaggggaaggtagtggatctgggatgtggccgtggtgggtggtcatactattgcggaggccttaaaaatgtcagggaagttaagggtctaacaaagcggggccctgggcatgaggaacccatccctatgagcacgtacggatggaacctggtgcgcctccagtccggcgtcgacgtgttctttaccccacccgagaaatgtgatactctactgtgcgacattggggaaagttctcctaatccaacagtagaggccggacgaaccttgagagtgctgaacctcgttgagaattggcttaacaataacactcagttctgtatcaaggtgctgaatccctatatgccgagcgtcattgagaaaatggaggccttgcagaggaagtacggcggtgcgctggtgcggaaccctctctcacgcaattccacacacgaaatgtactgggtcagtaacgctagcgggaatatcgtgtcttccgttaacatgatatcaagaatgttaattaataggtttaccatgcgacacaaaaaggcaacgtatgagccagatgtagacctgggaagcggcacccggaacatcggcatcgaatcggagattcccaaccttgacataatcgggaagcgtattgagaaaatcaagcaagaacatgagacactgtggcactacgatcaggaccatccttataaaacttgggcctaccacggatcttatgaaaccaagcagacaggtagtgcttccagcatggtgaatggcgtcgtgagactactcactaaaccatgggatgttgtgcccatggtcacccagatggccatgacagacaccactccgttcgggcaacagcgcgtgtttaaggagaaggtagatacgaggacacaggaacctaaagagggaaccaagaaactgatgaagattactgcagagtggttgtggaaagaactgggcaagaaaaagacaccccggatgtgcacaagagaggagttcacgcgcaaggtgaggtcaaacgccgctctcggtgcgatctttaccgacgagaataaacgaaagtccgcccgggaggcagttgaagattctagattctgggagcttgtcgacaaagaaaggaacctgcacttagaggggaagtgtgaaacttgcgtgtacaatatgatgggaaaacgcgagaagaagctgggcgagtttggcaaagctaaggggagccgtgccatatggtatatgtggttgggagcacggttcctcgaatttgaggccctgggtttcctaaacgaagatcattggtttagtagagaaaattcccttagcggcgtggaaggggagggactgcacaaactcggctacatcctgagggacgtctctaagaaagagggtggggctatgtacgccgatgacacagcgggatgggacacccgcattactttggaagatctgaagaacgaggaaatggttacaaatcatatggagggcgaacacaagaaactcgcagaggccatcttcaaacttacctatcagaacaaagtggtacgagtgcaacggccaacacctagaggcactgtcatggacattatctcaaggcgcgatcagagagggagtggacaggtgggtacctacggcctgaatacgttcaccaacatggaggctcaattaattcggcagatggaaggggagggagtttttaagtccatacagcatctgacagtgactgaagagatcgccgtccagaattggttggcaagggtgggccgtgagcgactcagccgcatggctatttctggtgacgattgcgtagttaaacccctggacgatagattcgcctcggctctaaccgcccttaacgacatggggaaggtgcggaaggatatccaacagtgggaaccatcaaggggatggaatgactggacacaggtccccttttgtagccaccacttccatgagctgatcatgaaagatggccgcgtgctcgtggtcccttgcagaaaccagaacgaactgattggccgggcaaggatatcccaaggggcgggatggagtttgcgagagactgcctgtttaggtaagtcttatgctcagatgtggagcctgatgtactttcaccgtagagacctccgccttgccgcaaatgctatctgctccgccgttccatcacattgggtgccgaccagtcggacgacatggtctattcacgcaaaacacgaatggatgaccactgaggatatgctgacagtatggaacagggtgtggatccaggagaatccctggatggaagacaagaccagcgtcgagtcctgggaagagattccttatctaggcaaaagagaagaccagtggtgtgggtcactgatcggactcactagccgcgccacctgggcgaagaacatacaaacagctatcaatcaggtgcggtctttgattggcaacgaggagtacacggattatatgccatccatgaagaggttccgaagagaagaggaagaggccggtgttctgtggtga

SEQ ID NO: 15061 - RNA, 9876 nt, synthetic construct
  misc_feature 1..9876: note = derived and/or modified CDS sequence (opt3) from DENV-2__DQ645540__SS-prME
  source 1..9876: mol_type = other RNA
accgcaggagtgataattatgatgatacccacagtagttgctttccacctgactacgcggaatggggaacctcatatgatcgtgagcaggcaggaaaagggaaaatccctcctttttaagaccgagaatggtgtaaacatgtgcacactgatggcaatggacttgggcgaattatgtgaggatactattacctacaattgcccactgctgcggcaaaacgaaccggaggacatcgattgttggtgcaattctacatcaacctgggtgacttatgggacatgtaccgccacgggagagcaccgccgagaaaaacgtagtgtcgcgctcgtgccccatgttggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagaaggggtttcaggaggtagctgggtggatatagtcctggagcacggcagttgtgtgaccactatggctaaaaataagcccacactcgacttcgaattaaccaagacggaggccaaacaccctgcgaccctgcggaagtactgcattgaagcaaaacttacaaacactaccacagcctcccgctgtccaactcagggggagccctctttgaatgaggaacaagataagcgatttgtgtgcaaacatagcatggtcgacagaggatggggcaacggttgtgggctgttcggaaagggcggcatcgttacctgcgctatgtttacatgcaagaaaaatatggaggggaaggtggtacagcctgaaaacctagagtataccattgtgatcactccacactccggagaagagaatgccgtcggtaacgatacgggcaaacatgggaaggagatcaaagtgacaccgcagtcaagtattaccgaagcagagctcactggatacggcaccgttacaatggaatgtagccccaggaccggtctggacttcaatgagatggtgcttctgcagatggaagataaggcttggttggtccaccggcaatggtttctcgacctgcctttaccatggctgcccggggccgatactcagggctctaactggatacagaaagagacactcgtgacgttcaagaaccctcacgcgaagaaacaggacgtagttgtgcttggatcccaagagggcgccatgcataccgcactgactggggctacagaaatccagatgtcaagcggaaatttgctatttaccggtcacctgaagtgccgtctccgcatggacaaactgcagcttaagggcatgagttattctatgtgtacagggaaattcaaggtcgtgaaggagattgccgaaactcaacatggaaccatcgtcataagagtgcagtacgagggcgatggttccccatgcaaaattcccttcgagatcatggacctggaaaagaggcacgttttggggcggctcatcacggtgaacccgattgtaaccgagaaagatagccctgtcaatatcgaagctgagcccccatttggcgactcgtacattataatcggagtggaacctggccagctgaagttatcttggttcaaaaaggggtcctcaattggacagatgtttgagacaactatgcgaggtgccaagcgcatggcaatcctgggcgataccgcctgggacttcgggagtctaggaggcgtttttacaagcatcggtaaagctctccatcaagtgttcggggcgatttatggcgcagccttttccggagtctcttggactatgaagatactgatcggcgtggtaattacctggatcgggatgaacagcagatcaacgagtctttccgtgagcttggttctggtcggagtggtgacactctacctgggcgtcatggttcaggctgattctggttgtgtggtgtcatggaaaaataaggagcttaaatgcgggagtggaattttcatcaccgacaacgtacacacttggacagaacagtataagtttcagcccgagagcccatccaagctggcctctgcaatacaaaaagcccacgaagagggcatctgtggtattaggtcggtcacccggttggaaaatctcatgtggaagcagatcactcccgagctgaaccatattttaagcgagaatgaagtgaaactgaccatcatgacaggcgatataaaggggattatgcaggctggaaaacgctccctaagacctcagccaacggagctcaagtactcatggaaagcctggggcaaggcaaagatgctgagtaccgaacttcacaaccatactttcttgatcgacgggccggagacagcggaatgccccaataccaacagggcttggaactctctggaggttgaggattatggatttggcgtgttcacaactaacatttggctcaaactgaaggaacgtcaagacgtcttttgtgacagcaaattaatgtccgccgcaatcaaggataatcgggccgtgcacgctgacatgggttactggatagagtcagccctgaacgatacctggaaaatcgaaaaggccagcttcattgaggttaagtcttgccactggcctaaatcccatacgctttggagtaacggggtgttggagagcgaaatgatcattccaaagaatttcgctggacccgtatctcagcacaactatcgacctggctaccatacacagaccgccggtccatggcacctcggcaaactggagatggactttgatttctgtgaagggactaccgtcgtggtgacagaggactgcggaaatagaggcccctccctaaggactaccacagcgtcagggaagctgatcacggaatggtgctgtcgcagttgcaccctcccgcctctgcggtacagaggagaggatggctgttggtatggtatggagataaggccacttaaagaaaaggaggaaaacttggtcaatagcctggttactgccgggcatggacagattgacaacttttcgttaggcgtgctcggtatggctctgttccttgaggaaatgctgcgcacacgagtaggcaccaagcacgcaatcttgctcgtggccgtctcctttgtgactctgatcacagggaatatgtctttccgggatctaggacgtgttatggtgatggtcggcgctaccatgacggacgatattgggatgggagtgacttacctggccctcctggcagcgtttaaagttagacccaccttcgccgctggccttttgctgaggaagttaacaagcaaagagctcatgatgaccactatcggtattgtgctgctttcacaaagtacaatacctgagaccatcctggaactaacagacgccctcgcactggggatgatggtcttgaagattgtacgcaacatggagaaatatcagctggctgtgactatcatggccattttatgcgttcccaatgcagtgatcctccagaacgcctggaaggtctcctgtaccatactggctgtggtatctgtgagcccacttctgttgacgtcctcacaacagaaggcggattggatccctctcgccctgacaattaaaggactaaatcccaccgcaatctttctgactacccttagccggacaagtaagaaaagatcttggccactcaacgaagctattatggccgtcggcatggtttccatcctggccagctcgttgctgaagaatgacataccgatgactggccctttagtggctgggggactcctgaccgtgtgctacgtccttacgggtaggtcagcagacctggagttggaacgagccgcggatgtgcgctgggaggagcaggctgaaatttctggcagttcccccatcctcagcatcacaatttctgaggacgggagcatgtccatcaagaatgaagaggaggaacagaccctgactatcctaattcggacaggactgcttgttatctcaggcctcttcccagtaagtattcccatcaccgccgcagcctggtatctgtgggaggtgaagaaacaaagagctggtgtcttgtgggatgtgcctagcccaccccctgttgggaaggcagaattagaggacggagcctacaggataaagcagaaaggcatcctgggctattctcagattggggcgggagtgtacaaggaaggtacttttcacacaatgtggcatgtcacccgtggcgctgtgctcatgcacaaagggaagcgcatcgagccgtcctgggccgatgtcaagaaggacctgatttcatacggaggcggttggaaacttgagggggaatggaaagagggagaagaggtccaggtgctggcattggaaccaggcaagaatccccgggccgttcaaacgaaacctggcctattcaagactaacaccgggacaatcggagctgtgagtctggattttagcccaggtacctccggctctcccatagtcgacaaaaaggggaaggtggttggactctatggcaacggtgtggtcacaagatcggggacttacgtgagcgccattgcacagaccgagaaatcaatcgaggataatcctgaaatcgaggacgatattttcaggaagaaacgactgacgatcatggaccttcatccgggagctggcaagacaaaacggtatttacccgccatagtacgcgaagcgattaagagaggcctgaggactctcatcttggccccaacccgggtggttgcagctgagatggaagaggccctgcgagggctccctattagataccagacacccgctatccgcgcagagcacaccggaagggaaatagtcgatctgatgtgtcatgccactttcaccatgcgtcttctgtccccaattcgggtgcctaactataatttgatcatcatggacgaggcccactttacagaccccgctagtattgcggcaagaggttacatctctacgagggtggaaatgggcgaggccgctgggattttcatgactgccaccccaccgggaagccgcgatccttttccccagtccaacgcaccaataatggacgaggaacgagagatccccgaaagatcatggaactctggccacgagtgggtcacagatttcaagggtaaaaccgtatggtttgtgcctagcattaaggccgggaacgacatcgctgcgtgcctacggaaaaatggaaagaaagttatccaactgagtaggaagactttcgattccgaatatgtgaagacacgcaccaacgactgggattttgtcgtgacgactgacattagcgagatgggcgccaatttcaaagcagagcgtgttatagatccaagacggtgtatgaagcccgtgatcctcacagacggcgaagagagggtcattttagctgggcctatgccggtgacccattcttcagccgcacagcgccgaggaagagtaggtcggaaccccaagaatgaaaacgatcagtacatctacatgggcgagcccctggaaaatgacgaggactgcgcccactggaaggaggctaaaatgcttctggataacattaatacccctgaagggatcataccctccatgtttgagccagaaagggagaaggtggacgccatcgatggagaatatcgcctcagaggcgaggcgaggaaaactttcgttgacttgatgcggcgtggtgatctgcctgtctggctcgcataccgcgtggccgctgaggggattaactatgccgaccgaagatggtgttttgatggcgtgaagaacaatcaaatcctggaagagaacgtcgaagttgagatttggacaaaggagggagaaaggaagaaacttaaaccccggtggctagacgctcgcatctacagtgatccactggcattgaaagagttcaaagagttcgccgctggcagaaagagcttaaccctgaatctcataacagagatggggaggctgcctacttttatgacgcagaaggcccggaacgcacttgacaatctggcggtgctccataccgccgaagctggaggtcgagcctataaccacgcattgtcggagctgccggagacactagaaactctgctccttctgaccttattggctacagtaaccggcgggattttcctgtttctcatgtctggaaaaggcatcggtaagatgactctggggatgtgctgcattatcacggcctccgtgcttctgtggtacgcacagatacagccccactggatcgccgctagcattatcctcgagttctttttgattgtcctgttaatcccagaacctgagaaacaaagaacaccacaggataatcagctaacatatgtggttatagcgattctgactgtggtcgccgcaaccatggctaacgaaatgggcttcctcgagaagaccaagaaggactttggacttggcgggatcgccacccagcaaccagagtcaaatatcctggatattgacttgcgccctgccagtgcatggactctgtacgctgtagccacaacgttcatcacccccatgctcaggcattctatagaaaactccagcgtgaatgtttcactgactgcgattgctaaccaggccacagtgcttatgggactcggtaagggctggccgctgagtaaaatggacatcggggtcccattgctggcaattggatgttacagccaggtgaatcctatcaccttaaccgccgctctactgctccttgtcgcacactatgccataatcggccccggtctgcaggcgaaggctacacgggaggcccaaaaacgtgcagccgctgggattatgaagaacccaactgtggatggcatcacggttattgacttggatcccatcccttacgacccgaaatttgaaaagcagctgggacaggtgatgctcctggtactttgcgtgacccaggtcttaatgatgagaacaacttgggccctgtgtgaggcactcaccttggctacaggccccatttccaccctgtgggaagggaatccaggaaggttctggaacactacgatcgccgtttctatggcgaatatatttcgcggcagctatctagccggtgcagggctactcttctccattatgaagaacacagctaacacccggcgaggaactggcaataccggtgagacacttggcgagaaatggaagaacagactgaatgccttggggaaatcagaatttcaaatctacaagaaatctggaatccaggaggtggataggactctggcaaaggaaggcattaaacgcggggagaccgaccatcacgctgtcagtcggggatcggccaagctcagatggttcgtggagcgtaacctggtaacacctgaaggcaaggtgatggatttaggttgcgggaggggaggctggagctattactgtggtggccttaaaaatgttaaggaggtgaaagggctgacgaagggaggccccgggcatgaagaacctataccaatgtccacctatggatggaacctcgtccggctacagtctggcgtggacgtcttctttactccccctgaaaaatgcgatacactgttgtgtgacatcggtgagtcaagcccaaatcccaccgtggaggccgggcgcactctgcgagttctcaaccttgtagaaaattggctgaacaataacacacaattctgcattaaggtgttgaatccgtacatgccttccgtcatcgagaagatggaagcgctgcagagaaaatacggaggcgctctcgtgaggaacccattaagtagaaattctacccacgagatgtattgggttagcaacgcatcaggcaacattgtgtccagtgtcaatatgatcagccgcatgctgataaacagatttacgatgaggcacaagaaagccacctacgaacccgatgtggaccttgggtctggaacacgaaatatcggtattgagtccgagatccctaacctggatattatcggcaagcggatagagaaaattaagcaggaacatgaaacttcatggcactatgaccaggaccatccatacaagacctgggcttatcacgggagctacgagacaaaacaaactggatcggcctctagtatggtaaatggcgtggttcgtctactcaccaagccctgggatgtcatcccgatggtgacacagatggcaatgaccgacactacgcctttcggtcagcagagagtgtttaaagtcaaggttgatacacgcacccaagaacccaaagaggggactaagaagctgatgaaaatcaccgccgagtggttgtggaaggaactgggcaaaaagaaaacaccaaggatgtgtacgcgggaggagttcaccagaaaggtgcgctccaacgctgcgctcggcgccatttttactgacgagaataaatggaaaagcgcaagggaggctgtagaagattcaggcttctgggagcttgtggacaaggaacgaaacctgcacttagaggggaaatgcgaaacatgtgtctataatatgatgggaaagcgggagaaaaagctgggtgagtttggcaaagccaaggggtccagagcaatatggtacatgtggttgggagccaggttcctcgaatttgaggctctgggcttcctaaacgaagatcattggttttctcgcgagaatagccttagtggtgtggaaggggagggactgcacaagctcggctacatcctgcgtgacgtttccaaaaaggagggcggggccatgtatgcggatgacaccgcaggatgggatactcggattacattggaagacctgaaaaacgaggaaatggtgaccaatcatatggagggtgaacacaagaaactcgccgaggctatcttcaaacttacataccagaacaaggtcgtgagagtacagaggcctactccccgcggcaccgttatggacattatcagccgacgggatcagagagggtctggacaagtggtcacgtatggcctgaataccttcacaaacatggaggcccagttaataaggcagatggaaggtgagggggtgtttaaatcaatccaacagctgactgcaaccgaagagattgctgtgaagaactggttggcccgcgtcggaagagagcggctcagtaggatggctatctccggcgacgattgcgttgtgaaaccactggacgatcgtttcgccagcgcactaacagcgcttaatgacatgggcaaggtacgaaaagatattcagcagtgggaaccctctcgcgggtggaacgactggactcaagtgcctttttgctcgcatcacttccacgagctgatcatgaaggatggaagagtcctcgtggttccatgtcggaatcaggacgaactgattggtagggcccgcatatcacagggcgctgggtggagcttgagagagaccgcctgcttaggaaagtcctacgcacagatgtggagtctgatgtattttcatcggagggatctccgacttgctgccaacgcaatctgttctgccgtgccgagccactgggtccccacgtcccgtacaacctggtcaattcatgcgactcacgaatggatgacaaccgaggacatgctgactgtgtggaatagagtatggatccaagagaacccttggatcgaagataaaaccccagttgagagttgggaagagattccctacctaggcaagcgcgaagaccagtggtgcggttctctgatagggctcacaagccgggctacgtgggccaaaaatatccagaccgcaattaaccaggtgaggtccttgatcggaaatgaggagtatactgactacatgccttcaatgaagagattccgccgggaagaggaagaggccggcgtcctgtggtga

SEQ ID NO: 15062 - RNA, 9876 nt, synthetic construct
  misc_feature 1..9876: note = derived and/or modified CDS sequence (opt3) from DENV-2__DQ645541__SS-prME
  source 1..9876: mol_type = other RNA
accgcaggagtgataattatgatgatacccaccgtagttgctttccacctgactacgcggaatggggagcctcatatgatcgtgagcaggcaggaaaagggaaaatccctcctttttaagaccgagaatggtgtaaacatgtgcacactgatggcaatggacttgggcgaattatgtgaggatactattacctacaattgcccactgctgcggcaaaacgaaccggaggacatcgattgttggtgcaattctacatcaacctgggtgacttatgggacatgtaccgccacgggagagcaccgccgagaaaaacgtagtgtcgcgctcgtgccccatgttggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagaaggggtttcaggaggtagctgggtggatatagtcctggagcacggcagttgtgtgaccactatggctaaaaataagcccacactcgacttcgaattaaccaagacggaggccaaacaccctgcgaccctgcggaagtactgcattgaagcaaaacttacaaacactaccacagcctcccgctgtccaactcagggggagccctctttgaatgaggaacaagataagcgatttgtgtgcaaacatagcatggtcgacagaggatggggcaacggttgtgggctgttcggaaagggcggcatcgttacctgcgctatgtttacatgcaagaaaaatatggaggggaaggtggtacagcctgaaaacctagagtataccattgtgatcactccacactccggagaagagaatgccgtcggtaacgatacgggcaaacatgggaaggagatcaaagtgacaccgcagtcaagtattaccgaagcagagctcactggatacggcaccgttacaatggaatgtagccccaggaccggtctggacttcaatgagatggtgcttctgcagatggaagataaggcttggttggtccaccggcaatggtttctcgacctgcctttaccatggctgcccggggccgatactcagggctctaactggatacagaaagagacactcgtgacgttcaagaaccctcacgcgaagaaacaggacgtagttgtgcttggatcccaagagggcgccatgcataccgcactgactggggctacagaaatccagatgtcaagcggaaatttgctatttaccggtcacctgaagtgccgtctccgcatggacaaactgcagcttaagggcatgagttattctatgtgtacagggaaattcaaggtcgtgaaggagattgccgaaactcaacatggaaccatcgtcataagagtgcagtacgagggcgatggttccccatgcaaaattcccttcgagatcatggacctggaaaagaggcacgttttggggcggctcatcacggtgaacccgattgtaaccgagaaagatagccctgtcaatatcgaagctgagcccccatttggcgactcgtacattataatcggagtggaacctggccagctgaagttatcttggttcaaaaaggggtcctcaattggacagatgtttgagacaactatgcgaggtgccaagcgcatggcaatcctgggcgataccgcctgggacttcgggagtctaggaggcgtttttacaagcatcggtaaagctctccatcaagtgttcggggcgatttatggcgcagccttttccggagtctcttggactatgaagatactgatcggcgtggtaattacctggatcgggatgaacagcagatcaacgagtctttccgtgagcttggttctggtcggagtggtgacactctacctgggcgtcatggttcaggctgattctggttgtgtggtgtcatggaaaaataaggagcttaaatgcgggagtggaattttcatcaccgacaacgtacacacttggacagaacagtataagtttcagcccgagagcccatccaagctggcctctgcaatacaaaaagcccacgaagagggcatctgtggtattaggtcggtcacccggttggaaaatctcatgtggaagcagatcactcccgagctgaaccatattttaagcgagaatgaagtgaaactgaccatcatgacaggcgatataaaggggattatgcaggctggaaaacgctccctaagacctcagccaacggagctcaagtactcatggaaagcctggggcaaggcaaagatgctgagtaccgaacttcacaaccatactttcttgatcgacgggccggagacagcggaatgccccaataccaacagggcttggaactctctggaggttgaggattatggatttggcgtgttcacaactaacatttggctcaaactgaaggaacgtcaagacgtcttttgtgacagcaaattaatgtccgccgcaatcaaggataatcgggccgtgcacgctgacatgggttactggatagagtcagccctgaacgatacctggaaaatcgaaaaggccagcttcattgaggttaagtcttgccactggcctaaatcccatacgctttggagtaacggggtgttggagagcgaaatgatcattccaaagaatttcgctggacccgtatctcagcacaactatcgacctggctaccatacacagaccgccggtccatggcacctcggcaaactggagatggactttgatttctgtgaagggactaccgtcgtggtgacagaggactgcggaaatagaggcccctccctaaggactaccacagcgtcagggaagctgatcacggaatggtgctgtcgcagttgcaccctcccgcctctgcggtacagaggagaggatggctgttggtatggtatggagataaggccacttaaagaaaaggaggaaaacttggtcaatagcctggttactgccgggcatggacagattgacaacttttcgttaggcgtgctcggtatggctctgttccttgaggaaatgctgcgcacacgagtaggcaccaagcacgcaatcttgctcgtggccgtctcctttgtgactctgatcacagggaatatgtctttccgggatctaggacgtgttatggtgatggtcggcgctaccatgacggacgatattgggatgggagtgacttacctggccctcctggcagcgtttaaagttagacccaccttcgccgctggccttttgctgaggaagttaacaagcaaagagctcatgatgaccactatcggtattgtgctgctttcacaaagtacaatacctgagaccatcctggaactaacagacgccctcgcactggggatgatggtcttgaagattgtacgcaacatggagaaatatcagctggctgtgactatcatggccattttatgcgttcccaatgcagtgatcctccagaacgcctggaaggtctcctgtaccatactggctgtggtatctgtgagcccacttctgttgacgtcctcacaacagaaggcggattggatccctctcgccctgacaattaaaggactaaatcccaccgcaatctttctgactacccttagccggacaagtaagaaaagatcttggccactcaacgaagctattatggccgtcggcatggtttccatcctggccagctcgttgctgaagaatgacataccgatgactggccctttagtggctgggggactcctgaccgtgtgctacgtccttacgggtaggtcagcagacctggagttggaacgagccgcggatgtgcgctgggaggagcaggctgaaatttctggcagttcccccatcctcagcatcacaatttctgaggacgggagcatgtccatcaagaatgaagaggaggaacagaccctgactatcctaattcggacaggactgcttgttatctcaggcctcttcccagtaagtattcccatcaccgccgcagcctggtatctgtgggaggtgaagaaacaaagagctggtgtcttgtgggatgtgcctagcccaccccctgttgggaaggcagaattagaggacggagcctacaggataaagcagaaaggcatcctgggctattctcagattggggcgggagtgtacaaggaaggtacttttcacacaatgtggcatgtcacccgtggcgctgtgctcatgcacaaagggaagcgcatcgagccgtcctgggccgatgtcaagaaggacctgatttcatacggaggcggttggaaacttgagggggaatggaaagagggagaagaggtccaggtgctggcattggaaccaggcaagaatccccgggccgttcaaacgaaacctggcctattcaagactaacaccgggacaatcggagctgtgagtctggattttagcccaggtacctccggctctcccatagtcgacaaaaaggggaaggtggttggactctatggcaacggtgtggtcacaagatcggggacttacgtgagcgccattgcacagaccgagaaatcaatcgaggataatcctgaaatcgaggacgatattttcaggaagaaacgactgacgatcatggaccttcatccgggagctggcaagacaaaacggtatttacccgccatagtacgcgaagcgattaagagaggcctgaggactctcatcttggccccaacccgggtggttgcagctgagatggaagaggccctgcgagggctccctattagataccagacacccgctatccgcgcagagcacaccggaagggaaatagtcgatctgatgtgtcatgccactttcaccatgcgtcttctgtccccaattcgggtgcctaactataatttgatcatcatggacgaggcccactttacagaccccgctagtattgcggcaagaggttacatctctacgagggtggaaatgggcgaggccgctgggattttcatgactgccaccccaccgggaagccgcgatccttttccccagtccaacgcaccaataatggacgaggaacgagagatccccgaaagatcatggaactctggccacgagtgggtcacagatttcaagggtaaaaccgtatggtttgtgcctagcattaaggccgggaacgacatcgctgcgtgcctacggaaaaatggaaagaaagttatccaactgagtaggaagactttcgattccgaatatgtgaagacacgcaccaacgactgggattttgtcgtgacgactgacattagcgagatgggcgccaatttcaaagcagagcgtgttatagatccaagacggtgtatgaagcccgtgatcctcacagacggcgaagagagggtcattttagctgggcctatgccggtgacccattcttcagccgcacagcgccgaggaagagtaggtcggaaccccaagaatgaaaacgatcagtacatctacatgggcgagcccctggaaaatgacgaggactgcgcccactggaaggaggctaaaatgcttctggataacattaatacccctgaagggatcataccctccatgtttgagccagaaagggagaaggtggacgccatcgatggagaatatcgcctcagaggcgaggcgaggaaaactttcgttgacttgatgcggcgtggtgatctgcctgtctggctcgcataccgcgtggccgctgaggggattaactatgccgaccgaagatggtgttttgatggcgtgaagaacaatcaaatcctggaagagaacgtcgaagttgagatttggacaaaggagggagaaaggaagaaacttaaaccccggtggctagacgctcgcatctacagtgatccactggcattgaaagagttcaaagagttcgccgctggcagaaagagcttaaccctgaatctcataacagagatggggaggctgcctacttttatgacgcagaaggcccggaacgcacttgacaatctggcggtgctccataccgccgaagctggaggtcgagcctataaccacgcattgtcggagctgccggagacactagaaactctgctccttctgaccttattggctacagtaaccggcgggattttcctgtttctcatgtctggaaaaggcatcggtaagatgactctggggatgtgctgcattatcacggcctccgtgcttctgtggtacgcacagatacagccccactggatcgccgctagcattatcctcgagttctttttgattgtcctgttaatcccagaacctgagaaacaaagaacaccacaggataatcagctaacatatgtggttatagcgattctgactgtggtcgccgcaaccatggctaacgaaatgggcttcctcgagaagaccaagaaggactttggacttggcgggatcgccacccagcaaccagagtcaaatatcctggatattgacttgcgccctgccagtgcatggactctgtacgctgtagccacaacgttcatcacccccatgctcaggcattctatagaaaactccagcgtgaatgtttcactgactgcgattgctaaccaggccacagtgcttatgggactcggtaagggctggccgctgagtaaaatggacatcggggtcccattgctggcaattggatgttacagccaggtgaatcctatcaccttaaccgccgctctactgctccttgtcgcacactatgccataatcggccccggtctgcaggcgaaggctacacgggaggcccaaaaacgtgcagccgctgggattatgaagaacccaactgtggatggcatcacggttattgacttggatcccatcccttacgacccgaaatttgaaaagcagctgggacaggtgatgctcctggtactttgcgtgacccaggtcttaatgatgagaacaacttgggccctgtgtgaggcactcaccttggctacaggccccatttccaccctgtgggaagggaatccaggaaggttctggaacactacgatcgccgtttctatggcgaatatatttcgcggcagctatctagccggtgcagggctactcttctccattatgaagaacacagctaacacccggcgaggaactggcaataccggtgagacacttggcgagaaatggaagaacagactgaatgccttggggaaatcagaatttcaaatctacaagaaatctggaatccaggaggtggataggactctggcaaaggaaggcattaaacgcggggagaccgaccatcacgctgtcagtcggggatcggccaagctcagatggttcgtggagcgtaacctggtaacacctgaaggcaaggtgatggatttaggttgcgggaggggaggctggagctattactgtggtggccttaaaaatgttaaggaggtgaaagggctgacgaagggaggccccgggcatgaagaacctataccaatgtccacctatggatggaacctcgtccggctacagtctggcgtggacgtcttctttactccccctgaaaaatgcgatacactgttgtgtgacatcggtgagtcaagcccaaatcccaccgtggaggccgggcgcactctgcgagttctcaaccttgtagaaaattggctgaacaataacacacaattctgcattaaggtgttgaatccgtacatgccttccgtcatcgagaagatggaagcgctgcagagaaaatacggaggcgctctcgtgaggaacccattaagtagaaattctacccacgagatgtattgggttagcaacgcatcaggcaacattgtgtccagtgtcaatatgatcagccgcatgctgataaacagatttacgatgaggcacaagaaagccacctacgaacccgatgtggaccttgggtctggaacacgaaatatcggtattgagtccgagactcctaacctggatatcattggcaagcggatcgagaaaataaagcaggaacatgaaacctcatggcactatgaccaggaccatccatacaagacatgggcttatcacgggagctacgagactaaacaaaccggatcggcctctagtatggtaaatggcgtggttcgtctactcacaaagccctgggatgtcattccgatggtgacccagatggcaatgactgacacgacacctttcggtcagcagagagtgtttaaagaaaaggtcgatacccgcactcaagagcccaaagaggggaccaagaagctgatgaaaatcacagccgaatggttgtggaaggagctgggcaaaaagaaaacgccaaggatgtgtacccgggaagagttcactagaaaggttcgctccaacgctgcgctcggcgccatctttacagacgagaataaatggaaaagcgcaagggaagctgtggaggattcaggcttctgggaacttgtagacaaggagcgaaacctgcacttagaagggaaatgcgagacctgtgtgtataatatgatgggaaagcgggagaaaaagctgggtgaatttggcaaagccaaggggtccagagcaatttggtacatgtggttgggagccaggttcctcgagtttgaagctctgggcttcctaaacgaggatcattggttttctcgcgaaaatagccttagtggtgtcgagggggagggactgcacaagctcggctacatactgcgtgacgtgtccaaaaaggaaggcggggccatgtatgcggatgacactgcaggatgggatacacggatcaccttggaggacctgaaaaacgaagagatggttacaaatcatatggaaggtgagcacaagaaactcgccgaggctattttcaaacttacttaccagaacaaggtggtcagagtgcagaggcctacaccccgcggcacggtaatggacatcattagccgacgggatcagagagggtctggacaagttgtgacctatggcctgaatacattcactaacatggaagcccagttaatcaggcagatggagggtgaaggggtctttaaatcaatacaacagctgaccgcaacagaggagatcgctgtgaagaactggttggcccgcgtgggaagagaacggctcagtaggatggctatttccggcgacgattgcgtcgttaaaccactggacgatcgtttcgccagcgcactaactgcgcttaatgacatgggcaaggtgcgaaaagatatccagcagtgggagccctctcgcgggtggaacgactggacccaagtacctttttgctcgcatcacttccacgaactgattatgaaggatggaagagtgctcgtcgtgccatgtcggaatcaggacgagctgatcggtagggcccgcatttcacagggcgctgggtggagcttgagagaaacggcctgcttaggaaagtcctacgcacagatgtggagtctgatgtattttcatcggagggatctccgacttgctgccaacgcaatatgttctgccgttccgagccactgggtgcccacatcccgtaccacttggtcaatccatgcgacacacgagtggatgaccactgaggacatgctgaccgtctggaatagagtgtggattcaagaaaacccttggatcgaggataaaacaccagtagaaagttgggaggaaatcccctacctaggcaagcgcgaggaccagtggtgcggttctctgattgggctcacgagccgggctacctgggccaaaaatatacagactgcaatcaaccaggttaggtccttgattggaaatgaggaatatacagactacatgccttcaatgaagagattccgccgggaggaagaggaagccggcgtgctgtggtga

SEQ ID NO: 15063 - RNA, 9876 nt, synthetic construct
  misc_feature 1..9876: note = derived and/or modified CDS sequence (opt3) from DENV-2__DQ645542__SS-prME
  source 1..9876: mol_type = other RNA
accgcaggagtgataattatgatgatacccacagtagttgctttccacctgactacgcggaatggggagcctcatatgatcgtgagcaggcaggaaaagggaaaatccctcctttttaagaccgagaatggtgtaaacatgtgcacactgatggcaatggacttgggcgaattatgtgaggatactattacctacaattgcccactgctgcggcaaaacgaaccggaggacatcgattgttggtgcaattctacatcaacctgggtgacttatgggacatgtaccgccacgggagagcaccgccgagaaaaacgtagtgtcgcgctcgtgccccatgttggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagaaggggtttcaggaggtagctgggtggatatagtcctggagcacggcagttgtgtgaccactatggctaaaaataagcccacactcgacttcgaattaaccaagacggaggccaaacaccctgcgaccctgcggaagtactgcattgaagcaaaacttacaaacactaccacagcctcccgctgtccaactcagggggagccctctttgaatgaggaacaagataagcgatttgtgtgcaaacatagcatggtcgacagaggatggggcaacggttgtgggctgttcggaaagggcggcatcgttacctgcgctatgtttacatgcaagaaaaatatggaggggaaggtggtacagcctgaaaacctagagtataccattgtgatcactccacactccggagaagagaatgccgtcggtaacgatacgggcaaacatgggaaggagatcaaagtgacaccgcagtcaagtattaccgaagcagagctcactggatacggcaccgttacaatggaatgtagccccaggaccggtctggacttcaatgagatggtgcttctgcagatggaagataaggcttggttggtccaccggcaatggtttctcgacctgcctttaccatggctgcccggggccgatactcagggctctaactggatacagaaagagacactcgtgacgttcaagaaccctcacgcgaagaaacaggacgtagttgtgcttggatcccaagagggcgccatgcataccgcactgactggggctacagaaatccagatgtcaagcggaaatttgctatttaccggtcacctgaagtgccgtctccgcatggacaaactgcagcttaagggcatgagttattctatgtgtacagggaaattcaaggtcgtgaaggagattgccgaaactcaacatggaaccatcgtcataagagtgcagtacgagggcgatggttccccatgcaaaattcccttcgagatcatggacctggaaaagaggcacgttttggggcggctcatcacggtgaacccgattgtaaccgagaaagatagccctgtcaatatcgaagctgagcccccatttggcgactcgtacattataatcggagtggaacctggccagctgaagttatcttggttcaaaaaggggtcctcaattggacagatgtttgagacaactatgcgaggtgccaagcgcatggcaatcctgggcgataccgcctgggacttcgggagtctaggaggcgtttttacaagcatcggtaaagctctccatcaagtgttcggggcgatttatggcgcagccttttccggagtctcttggactatgaagatactgatcggcgtggtaattacctggatcgggatgaacagcagatcaacgagtctttccgtgagcttggttctggtcggagtggtgacactctacctgggcgtcatggttcaggctgattctggttgtgtggtgtcatggaaaaataaggagcttaaatgcgggagtggaattttcatcaccgacaacgtacacacttggacagaacagtataagtttcagcccgagagcccatccaagctggcctctgcaatacaaaaagcccacgaagagggcatctgtggtattaggtcggtcacccggttggaaaatctcatgtggaagcagatcactcccgagctgaaccatattttaagcgagaatgaagtgaaactgaccatcatgacaggcgatataaaggggattatgcaggctggaaaacgctccctaagacctcagccaacggagctcaagtactcatggaaagcctggggcaaggcaaagatgctgagtaccgaacttcacaaccatactttcttgatcgacgggccggagacagcggaatgccccaataccaacagggcttggaactctctggaggttgaggattatggatttggcgtgttcacaactaacatttggctcaaactgaaggaacgtcaagacgtcttttgtgacagcaaattaatgtccgccgcaatcaaggataatcgggccgtgcacgctgacatgggttactggatagagtcagccctgaacgatacctggaaaatcgaaaaggccagcttcattgaggttaagtcttgccactggcctaaatcccatacgctttggagtaacggggtgttggagagcgaaatgatcattccaaagaatttcgctggacccgtatctcagcacaactatcgacctggctaccatacacagaccgccggtccatggcacctcggcaaactggagatggactttgatttctgtgaagggactaccgtcgtggtgacagaggactgcggaaatagaggcccctccctaaggactaccacagcgtcagggaagctgatcacggaatggtgctgtcgcagttgcaccctcccgcctctgcggtacagaggagaggatggctgttggtatggtatggagataaggccacttaaagaaaaggaggaaaacttggtcaatagcctggttactgccgggcatggacagattgacaacttttcgttaggcgtgctcggtatggctctgttccttgaggaaatgctgcgcacacgagtaggcaccaagcacgcaatcttgctcgtggccgtctcctttgtgactctgatcacagggaatatgtctttccgggatctaggacgtgttatggtgatggtcggcgctaccatgacggacgatattgggatgggagtgacttacctggccctcctggcagcgtttaaagttagacccaccttcgccgctggccttttgctgaggaagttaacaagcaaagagctcatgatgaccactatcggtattgtgctgctttcacaaagtacaatacctgagaccatcctggaactaacagacgccctcgcactggggatgatggtcttgaagattgtacgcaacatggagaaatatcagctggctgtgactatcatggccattttatgcgttcccaatgcagtgatcctccagaacgcctggaaggtctcctgtaccatactggctgtggtatctgtgagcccacttctgttgacgtcctcacaacagaaggcggattggatccctctcgccctgacaattaaaggactaaatcccaccgcaatctttctgactacccttagccggacaagtaagaaaagatcttggccactcaacgaagctattatggccgtcggcatggtttccatcctggccagctcgttgctgaagaatgacataccgatgactggccctttagtggctgggggactcctgaccgtgtgctacgtccttacgggtaggtcagcagacctggagttggaacgagccgcggatgtgcgctgggaggagcaggctgaaatttctggcagttcccccatcctcagcatcacaatttctgaggacgggagcatgtccatcaagaatgaagaggaggaacagaccctgactatcctaattcggacaggactgcttgttatctcaggcctcttcccagtaagtattcccatcaccgccgcagcctggtatctgtgggaggtgaagaaacaaagagctggtgtcttgtgggatgtgcctagcccaccccctgttgggaaggcagaattagaggacggagcctacaggataaagcagaaaggcatcctgggctattctcagattggggcgggagtgtacaaggaaggtacttttcacacaatgtggcatgtcacccgtggcgctgtgctcatgcacaaagggaagcgcatcgagccgtcctgggccgatgtcaagaaggacctgatttcatacggaggcggttggaaacttgagggggaatggaaagagggagaagaggtccaggtgctggcattggaaccaggcaagaatccccgggccgttcaaacgaaacctggcctattcaagactaacaccgggacaatcggagctgtgagtctggattttagcccaggtacctccggctctcccatagtcgacaaaaaggggaaggtggttggactctatggcaacggtgtggtcacaagatcggggacttacgtgagcgccattgcacagaccgagaaatcaatcgaggataatcctgaaatcgaggacgatattttcaggaagaaacgactgacgatcatggaccttcatccgggagctggcaagacaaaacggtatttacccgccatagtacgcgaagcgattaagagaggcctgaggactctcatcttggccccaacccgggtggttgcagctgagatggaagaggccctgcgagggctccctattagataccagacacccgctatccgcgcagagcacaccggaagggaaatagtcgatctgatgtgtcatgccactttcaccatgcgtcttctgtccccaattcgggtgcctaactataatttgatcatcatggacgaggcccactttacagaccccgctagtattgcggcaagaggttacatctctacgagggtggaaatgggcgaggccgctgggattttcatgactgccaccccaccgggaagccgcgatccttttccccagtccaacgcaccaataatggacgaggaacgagagatccccgaaagatcatggaactctggccacgagtgggtcacagatttcaagggtaaaaccgtatggtttgtgcctagcattaaggccgggaacgacatcgctgcgtgcctacggaaaaatggaaagaaagttatccaactgagtaggaagactttcgattccgaatatgtgaagacacgcaccaacgactgggattttgtcgtgacgactgacattagcgagatgggcgccaatttcaaagcagagcgtgttatagatccaagacggtgtatgaagcccgtgatcctcacagacggcgaagagagggtcattttagctgggcctatgccggtgacccattcttcagccgcacagcgccgaggaagagtaggtcggaaccccaagaatgaaaacgatcagtacatctacatgggcgagcccctggaaaatgacgaggactgcgcccactggaaggaggctaaaatgcttctggataacattaatacccctgaagggatcataccctccatgtttgagccagaaagggagaaggtggacgccatcgatggagaatatcgcctcagaggcgaggcgaggaaaactttcgttgacttgatgcggcgtggtgatctgcctgtctggctcgcataccgcgtggccgctgaggggattaactatgccgaccgaagatggtgttttgatggcgtgaagaacaatcaaatcctggaagagaacgtcgaagttgagatttggacaaaggagggagaaaggaagaaacttaaaccccggtggctagacgctcgcatctacagtgatccactggcattgaaagagttcaaagagttcgccgctggcagaaagagcttaaccctgaatctcataacagagatggggaggctgcctacttttatgacgcagaaggcccggaacgcacttgacaatctggcggtgctccataccgccgaagctggaggtcgagcctataaccacgcattgtcggagctgccggagacactagaaactctgctccttctgaccttattggctacagtaaccggcgggattttcctgtttctcatgtctggaaaaggcatcggtaagatgactctggggatgtgctgcattatcacggcctccgtgcttctgtggtacgcacagatacagccccactggatcgccgctagcattatcctcgagttctttttgattgtcctgttaatcccagaacctgagaaacaaagaacaccacaggataatcagctaacatatgtggttatagcgattctgactgtggtcgccgcaaccatggctaacgaaatgggcttcctcgagaagaccaagaaggactttggacttggcgggatcgccacccagcaaccagagtcaaatatcctggatattgacttgcgccctgccagtgcatggactctgtacgctgtagccacaacgttcatcacccccatgctcaggcattctatagaaaactccagcgtgaatgtttcactgactgcgattgctaaccaggccacagtgcttatgggactcggtaagggctggccgctgagtaaaatggacatcggggtcccattgctggcaattggatgttacagccaggtgaatcctatcaccttaaccgccgctctactgctccttgtcgcacactatgccataatcggccccggtctgcaggcgaaggctacacgggaggcccaaaaacgtgcagccgctgggattatgaagaacccaactgtggatggcatcacggttattgacttggatcccatcccttacgacccgaaatttgaaaagcagctgggacaggtgatgctcctggtactttgcgtgacccaggtcttaatgatgagaacaacttgggccctgtgtgaggcactcaccttggctacaggccccatttccaccctgtgggaagggaatccaggaaggttctggaacactacgatcgccgtttctatggcgaatatatttcgcggcagctatctagccggtgcagggctactcttctccattatgaagaacacagctaacacccggcgaggaactggcaataccggtgagacacttggcgagaaatggaagaacagactgaatgccttggggaaatcagaatttcaaatctacaagaaatctggaatccaggaggtggataggactctggcaaaggaaggcattaaacgcggggagaccgaccatcacgctgtcagtcggggatcggccaagctcagatggttcgtggagcgtaacctggtaacacctgaaggcaaggtgatggatttaggttgcgggaggggaggctggagctattactgtggtggccttaaaaatgttaaggaggtgaaagggctgacgaagggaggccccgggcatgaagaacctataccaatgtccacctatggatggaacctcgtccggctacagtctggcgtggacgtcttctttactccccctgaaaaatgcgatacactgttgtgtgacatcggtgagtcaagcccaaatcccaccgtggaggccgggcgcactctgcgagttctcaaccttgtagaaaattggctgaacaataacacacaattctgcattaaggtgttgaatccgtacatgccttccgtcatcgagaagatggaagcgctgcagagaaaatacggaggcgctctcgtgaggaacccattaagtagaaattctacccacgagatgtattgggttagcaacgcatcaggcaacattgtgtccagtgtcaatatgatcagccgcatgctgataaacagatttacgatgaggcacaagaaagccacctacgaacccgatgtggaccttgggtctggaacacgaaatatcggtattgagtccgagatccctaacctggatattatcggcaagcggatagagaaaattaagcaggaacatgaaacttcatggcactatgaccaggaccatccatacaagacctgggcttatcacgggagctacgagacaaaacaaactggatcggcctctagtatggtaaatggcgtggttcgtctactcaccaagccctgggatgtcatcccgatggtgacacagatggcaatgaccgacactacgcctttcggtcagcagagagtgtttaaagaaaaggtcgatacacgcacccaagagcccaaagaggggactaagaagctgatgaaaatcaccgccgaatggttgtggaaggagctgggcaaaaagaaaacaccaaggatgtgtacgcgggaagagttcaccagaaaggttcgctccaacgctgcgctcggcgccatttttactgacgagaataaatggaaaagcgcaagggaagctgtggaggattcaggcttctgggaacttgtagacaaggagcgaaacctgcacttagaagggaaatgcgagacatgtgtgtataatatgatgggaaagcgggagaaaaagctgggtgaatttggcaaagccaaggggtccagagcaatatggtacatgtggttgggagccaggttcctcgagtttgaagctctgggcttcctaaacgaggatcattggttttctcgcgaaaatagccttagtggtgtcgagggggagggactgcacaagctcggctacatcctgcgtgacgtgtccaaaaaggaaggcggggccatgtatgcggatgacaccgcaggatgggatactcggattacattggaggacctgaaaaacgaagagatggttaccaatcatatggaaggtgagcacaagaaactcgccgaggctatcttcaaacttacataccagaacaaggtggtcagagtgcagaggcctactccccgcggcaccgtaatggacattatcagccgacgggatcagagagggtctggacaagttgtgacgtatggcctgaataccttcacaaacatggaagcccagttaataaggcagatggagggtgaaggggtctttaaatcaatccaacagctgactgcaaccgaggagattgctgtgaagaactggttggcccgcgtgggaagagaacggctcagtaggatggctatctccggcgacgattgcgtcgttaaaccactggacgatcgtttcgccagcgcactaacagcgcttaatgacatgggcaaggtgcgaaaagatattcagcagtgggagccctctcgcgggtggaacgactggactcaagtacctttttgctcgcatcacttccacgaactgatcatgaaggatggaagagtgctcgtcgtgccatgtcggaatcaggacgagctgattggtagggcccgcatatcacagggcgctgggtggagcttgagagaaaccgcctgcttaggaaagtcctacgcacagatgtggagtctgatgtattttcatcggagggatctccgacttgctgccaacgcaatctgttctgccgttccgagccactgggtgcccacgtcccgtacaacctggtcaattcatgcgactcacgagtggatgacaaccgaggacatgctgactgtctggaatagagtgtggatccaagaaaacccttggatcgaggataaaaccccagtagaaagttgggaggaaattccctacctaggcaagcgcgaggaccagtggtgcggttctctgatagggctcacaagccgggctacgtgggccaaaaatatccagaccgcaattaaccaggttaggtccttgatcggaaatgaggaatatactgactacatgccttcaatgaagagattccgccgggaggaagaggaagccggcgtgctgtggtga

SEQ ID NO: 15064 - RNA, 9876 nt, synthetic construct
  misc_feature 1..9876: note = derived and/or modified CDS sequence (opt3) from DENV-2__AY702036__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctacaagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtcgaagactacggctttggtgttttctctaccaacatttggctcaagctgcgtgagaaacaggacgtgttttgtgatagcaagttaatgtccgctgccatcaaagacaatcgggcagtgcacgccgatatggggtattggatagaatcagctctgaacgacacgtggaagatggagaaggccagcttcattgaggtaaaatcttgccactggcctaagtcccatacactttggagtaatggagtcttggaaagcgagatgatcatcccaaaaaacttcgcaggccccgtgtctcagcacaactaccgacctggttatcatacccaaactgctggcccatggcacctcgggaagctggaaatggattttgacttctgtgagggaaccacagttgtggtcactgaagattgcggcaatagagggccctccctaaggaccacaacggcctcaggaaaactgattaccgagtggtgctgtcgcagttgcactctcccgcctctgcggtacagaggcgaggacggttgttggtacgggatggaaatcaggccacttaaggagaaggaagagaacttggtgaatagcctggttacagcgggacatggccagattgataacttttcgttaggtgtgctcggcatggccctgttccttgaagagatgctgcgcacccgagtagggactaaacacgctatattgctcgtcgcagtgtcctttgtgacactgatcaccggaaatatgtctttccgggacctaggccgtgtcatggttatggtgggggccacgatgactgatgacattggaatgggcgtaacctatctggctctcctggccgcatttaaggtgagacccacattcgcggccggtcttttgctgaggaaattaaccagcaaggagctcatgatggctactatcgggattgccctgctttcacagagtacaatgcctgaaaccatcctggagctaacagatgcactcgctctgggaatgatggtcttgaaaatagtgcgcaacatggaaaagtaccaactggccgttactatcatggcaatttcctgcgtgcccaatgccgtcatcttacagaacgcttggaaggtgtcttgtaccattctcgcggccgttagcgtgtccccactgcttctgacgtcaagccagcagaaagcagactggatccctttggctctcacaataaagggcctgaatcccaccgccatttttctaactaccctgagtcggacatctaaaaagagatcctggccacttaacgaggccatcatggctgtcggcatggtaagcatcctcgcatcgtcactgttgaaaaatgacattccgatgactgggcctctggtggccggaggtttactcaccgtttgctatgtgctgacgggcaggtctgcggatcttgaactggagcgagctgccgacgtcaagtgggaggatcaagcagaaataagtgggtccagccccatcttgtctattacaatcagcgaggacggatccatgtcaattaaaaacgaagaggaggaacagaccctcactatcctgatacgcacaggcctactggtgatcagtggtgtattcccagtgagcattcccatcaccgccgctgcatggtacctttgggaggtcaagaagcagcgggccggggttctctgggatgtgccttctccaccccctgtgggaaaagcggaactggaggacggcgcttatagaattaagcagaggggcatcttggggtactcccaaataggagccggtgtctataaagaaggcacttttcacacaatgtggcatgtgacccgtggggcagttttaatgcaccgcggaaagcggattgagccgtcatgggccgatgtaaaaaaggacctgatcagttacggcggtgggtggaagctcgagggagaatggaaagagggcgaagaggtgcaggtcctggctcttgaaccaggcaagaatcccagagccgtgcagacgaaacctgggatcttcaagactaacaccggaacaattggtgcagttagcctggatttttccccaggcacctctgggtcgcccatcgtggacaggaaaggaaaggtcgtgggcttgtacggtaatggggtagtcacacgaagcggagcttatgtgtcagccatagcgcagactgagaagtccattgaggataaccctgaaatcgaggacgatattttccggaaaaagcgcctaaccatcatggacctgcatccgggcgccggcaaaacgaagagatacctccccgcaatagttagggaagctattaaccgggggctgcgaacacttatcttagccccaactagagtggtcgctgcagagatggaagaggccctgcgcggactccctatcaggtatcaaacccccgccattcgtgctgagcacacaggtcgggaaatcgtggacttgatgtgtcatgcgaccttcactatgagactgctcagtccagttagggtgcctaattacaacctgattataatggatgaggcacactttaccgaccccgcctctatcgctgcccgcggctatattagcacacgagtcgaaatgggggaggcagccggaatcttcatgacggctactccaccgggctccagagatccttttccccagtcaaatgcgccaatcatggacgaggaacgggagattcccgaaaggtcttggaacagcggtcacgagtgggtgaccgatttcaaagggaagacagtatggtttgtgcctagtataaaggccggaaatgacatcgcagcttgccttcgcaaaaacggcaagaaagttattcagctgtcccgtaagaccttcgatagcgaatacgtcaaaactagagccaatgactgggattttgtggtgacaaccgacatctctgagatgggcgcaaacttcaaggccgagcgggtcattgatccaaggcgctgtatgaagcccgtaatcttgacggacggggaagagcgagtgatactagctggacctatgccggttactcattcatccgccgcgcaaagacggggtaggatcggccgcaatccaaaaaacgaaaatgaccagtatatttacatgggggagcccctggaaaacgatgaggactgcgcacactggaaggaggccaaaatgctcttagataatatcaacacacctgaaggaattatccccagtatgtttgagccagaaagagagaaggtggacgctatagatggcgaatacaggctgcggggtgaggcccgtaaaaccttcgtcgaccttatgcgccgaggggatctgcctgtgtggctcgcttataaggttgcagccgagggcattaattacgctgacagaaaatggtgttttgatggaatcaagaacaaccagattttggaagagaatgtggaagtcgagatctggaccaaggagggcgaaaggaaaaagctgaaaccccggtggctcgacgcccgcatatatagcgatccactggcacttaaggagttcaaagaattcgcggccgggagaaagtcgctaactctgaacttgatcacagagatgggaaggttacctacctttatgacacagaaggctcggaatgccctggacaacctcgcagtgctgcatactgctgaagccggtggccgagcatacaatcacgccctttctgagctgccggagacgctcgaaaccttgctgctactgacactccttgctactgtaaccgggggaattttcctgtttttaatgtccggcaaaggtatcgggaagatgacattgggcatgtgctgcattatcaccgcgagctcactgctctggtatgcccaaatacagccccactggattgcagctagtatcatcctggagttctttcttattgtgctgctcatcccagaacctgagaaacagagaactccccaggataaccaattgacgtacgttgtcatagccattctgaccgtggtggccgcaacaatggctaatgaaatgggattcttagagaagactaaaaaggacctaggcctggggtctatcaccacacaggagtccgaaagcaacattctcgacatcgatcttcgcccagcctcagcgtggaccctgtatgctgtcgccactacatttgttacgcctatgttgaggcatagtatagagaatagctccgtgaacgtatctctgaccgcaatcgccaatcaggctactgtgctcatgggactgggtaagggctggccccttagcaaaatggacattggggtcccgctcctggcaatcggatgttactcccaggtgaacccaattacattgaccgccgcgctgttactactggttgctcactacgccatcattggccctggtctccaagcaaaggccacccgggaagctcagaaacgtgccgcagctgggatcatgaagaatcccacagtggatggcataactgtcattgaccttgagccaatcccctatgatcctaaattcgaaaagcagctgggacaggtaatgttgctgatcctctgcgtgacgcaagttctgatgatgagaaccacatgggccctttgtgaggcgttaactctggccaccggcccgatttcaacactctgggaggggaaccccggaaggttttggaataccactatagcagtgtctatggctaacatcttccgcggcagttacttggccggtgcagggctgctattttcgattatgaagaatacgacaaacacccggcgaggaactggcaacatcggtgaaaccctgggcgagaaatggaagagcagactcaatgctcttgggaaatccgaattccagatttataagaaatctggaatccaggaggtcgacaggacactggccaaggagggcataaaacgcggggaaactgatcatcacgccgtgtcacggggaagcgcgaagttgagatggtttgtcgagcgtaacatggtgaccccagaaggcaaggttgtggacctgggttgcgggaggggaggctggtcctactattgtggtggcctcaaaaatgtacgggaggtgaaggggctgacaaaaggaggccctgggcatgaagagcccatccctatgagtacgtacggatggaacttagtccgccttcaatctggcgttgatgtgttcttcaccccacccgagaagtgcgacactctgctctgtgatattggtgaaagctcacctaatccaacaatcgaggctgggcgaaccctaagagtcctgaacttggtggaaaattggctgaacaataacactcagttttgcattaaagtactcaatccctatatgccgtccgtgatcgagaagatggaaacacttcagaggaagtacggaggcgcactggttcggaaccctttgagtcgcaatagcacccacgagatgtactgggtgtctaacgccacgggcaatatagtctcctcagtgaacatgattagcagaatgctgatcaacaggttcaccatgaaacacaagaaagctacatatgagccagacgtcgatctcgggtcgggaactcgaaatatcggtattgaatctgagatacccaacttagacatcattggcaagcggatcgaaaaaattaagcaggagcatgaaaccagttggcactacgaccaagatcatccttataagacatgggcctaccacgggtcctatgagactaaacagaccggaagcgcatcatccatggtgaatggcgttgtacgtctgcttacaaagccatgggacgtggtccccatggtgacccagatggccatgactgatacgacaccgtttggtcagcaaagagttttcaaagagaaggtggacacccgcactcaggaacctaaagaggggaccaagaagctgatgaaaatcacagctgaatggctatggaaggagctcggaaaaaagaaaacgcccaggatgtgtacccgggaggaatttactagaaaggtccgctctaacgcggccctgggcgcaatattcacagatgagaataaatggaagagcgctagggaagccgtggaggacggccgattttgggaattggtagatcgggagagaaacctgcacctcgaggggaagtgcgaaacctgtgtgtacaatatgatgggaaaaagggagaagaaacttggtgaattcggcaaggcaaaagggagtcgcgccatctggtatatgtggctgggagctcgttttttagagttcgaagccctgggctttttgaacgaggaccattggttctcccggggtaatagcctctctggggttgagggagaaggcctgcacagactaggctacattcttagggaggtcgggaagaaggaaggaggtgcgatgtacgcagatgacactgccggctgggatacacgcatcaccctggaggacctcaaaaacgaagagatggtgacaaatcatatgaagggggagcacaaaaagctggctgaagccatttttaaattgacttatcagaacaaggtggtccgagttcagcggccaacccctagaggaacggtgatggacatcatttcaaggcgcgatcaaagaggcagtggtcaggtagggacctacggactgaatacattcactaacatggaggcacagctcatacggcaaatggaaggcgagggcatcttcaagtccattcagcatcttaccgctacagaggaaatcgccgtgcagaattggctggctagggtcgggcgtgagcgattaagccgcatggccatctctggagacgattgcgtggttaaacccattgacgatagatttgcatcggcgctgactgccttgaacgacatgggtaaggtgcggaaagatatacagcaatgggaaccatcaaggggctggaacgactggacccaggtccccttctgcagccaccactttcatgagctcgtgatgaaggatgggcgcgtactggttgtgccttgtagaaatcaggacgaactaatcggacgggctaggatttcccagggcgccggttggagtcttaaagagacggcatgcctggggaagtcttatgctcaaatgtggacactcatgtacttccaccgacgtgatctgagattggccgcaaacgccatctgtagcgcggtcccatcccattgggtgccgacctcacgcactacatggagtattcacgctaagcacgagtggatgaccactgaagacatgttagccgtgtggaatcgggtctggatccaggagaacccctggatggaagataaaacccctgttgagtcttgggaagaggtgccatatctgggaaagagggaggaccagtggtgcggcagcctcataggccttacatccagagcaacgtgggccaaaaatatccagaccgctattaaccaagtacgctcactgatcgggaatgaagagtacactgactatatgcccagcatgaagcggtttaggcgagaagaggaagaggccggagtgctatggtga

SEQ ID NO: 15065 - RNA, 9876 nt, synthetic construct
  misc_feature 1..9876: note = derived and/or modified CDS sequence (opt3) from DENV-2__AY702034__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctacaagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtcgaagactacggctttggtgttttcaccacgaacatttggctcaagctgcgtgagaaacaggacgtgttttgtgattctaagttaatgagcgctgccatcaaagacaatcgggcagtgcacgccgatatggggtattggatagaatccgctctgaacgacacatggaagatggagaaggcctcattcattgaggtaaaaagctgccactggcctaagtctcataccctttggtccaatggagtcttggaaagtgagatgatcatcccaaaaaacttcgcaggccccgtgagccagcacaactaccgacctggttatcatactcaaaccgctggcccatggcacctcgggaagctggaaatggattttgacttctgtgagggaacaactgttgtggtcaccgaagattgcggcaatagagggccctctctaaggacaacgaccgcctccggaaaactgattactgagtggtgctgtcgctcatgcacactcccgcctctgcggtacagaggcgaggacggttgttggtacgggatggaaatcaggccacttaaggagaaggaagagaacttggtgaatagtctggttaccgcgggacatggccagattgataactttagcttaggtgtgctcggcatggccctgttccttgaagagatgctgcgcactcgagtagggacaaaacacgctatattgctcgtcgcagtgtcgtttgtgaccctgatcacgggaaatatgtccttccgggacctaggccgtgtcatggttatggtgggggccactatgaccgatgacattggaatgggcgtaacatatctggctctcctggccgcatttaaggtgagacccaccttcgcggccggtcttttgctgaggaaattaacttctaaggagctcatgatggctacaatcgggattgccctgcttagccagtcaaccatgcctgaaacaatcctggagctaactgatgcactcgctctgggaatgatggtcttgaaaatagtgcgcaacatggaaaagtaccaactggccgttaccatcatggcaattagttgcgtgcccaatgccgtcatcttacagaacgcttggaaggtgtcctgtacgattctcgcggccgtttctgtgagcccactgcttctgacatcctcacagcagaaagcagactggatccctttggctctcaccataaagggcctgaatcccactgccatttttctaaccacactgagccggactagtaaaaagagatcttggccacttaacgaggccatcatggctgtcggcatggtatccatcctcgcaagctcgctgttgaaaaatgacattccgatgaccgggcctctggtggccggaggtttactcacggtttgctatgtgctgacaggcaggtcagcggatcttgaactggagcgagctgccgacgtcaagtgggaggatcaagcagaaatatctgggagttcccccatcttgagcattaccatctctgaggacggaagcatgtccattaaaaacgaagaggaggaacagactctcacaatcctgatacgcaccggcctactggtgatctcaggtgtattcccagtgagtattcccatcactgccgctgcatggtacctttgggaggtcaagaagcagcgggccggggttctctgggatgtgcctagcccaccccctgtgggaaaagcggaactggaggacggcgcttatagaattaagcagaggggcatcttggggtactctcaaataggagccggtgtctataaagaaggcacatttcacaccatgtggcatgtgacgcgtggggcagttttaatgcaccgcggaaagcggattgagccgtcctgggccgatgtaaaaaaggacctgatctcatacggcggtgggtggaagctcgagggagaatggaaagagggcgaagaggtgcaggtcctggctcttgaaccaggcaagaatcccagagccgtgcagactaaacctgggatcttcaagaccaacacaggaaccattggtgcagttagtctggattttagcccaggcacatccgggtctcccatcgtggacaggaaaggaaaggtcgtgggcttgtacggtaatggggtagtcactcgatcgggagcttatgtgagcgccatagcgcagaccgagaagtcaattgaggataaccctgaaatcgaggacgatattttccggaaaaagcgcctaacgatcatggacctgcatccgggcgccggcaaaacaaagagatacctccccgcaatagttagggaagctattaaccgggggctgcgaactcttatcttagccccaaccagagtggtcgctgcagagatggaagaggccctgcgcggactccctatcaggtatcaaacacccgccattcgtgctgagcacaccggtcgggaaatcgtggacttgatgtgtcatgcgactttcaccatgagactgctctccccagttagggtgcctaattacaacctgattataatggatgaggcacactttacagaccccgccagtatcgctgcccgcggctatatttctacgcgagtcgaaatgggggaggcagccggaatcttcatgactgctaccccaccgggcagcagagatccttttccccagtccaatgcgccaatcatggacgaggaacgggagattcccgaaaggtcatggaactctggtcacgagtgggtgacagatttcaaagggaagaccgtatggtttgtgcctagcataaaggccggaaatgacatcgcagcttgccttcgcaaaaacggcaagaaagttattcagctgagtcgtaagactttcgattccgaatacgtcaaaacaagagccaatgactgggattttgtggtgaccacggacatcagcgagatgggcgcaaacttcaaggccgagcgggtcattgatccaaggcgctgtatgaagcccgtaatcttgactgacggggaagagcgagtgatactagctggacctatgccggttacacattcttcagccgcgcaaagacggggtaggatcggccgcaatccaaaaaacgaaaatgaccagtatatttacatgggggagcccctggaaaacgatgaggactgcgcacactggaaggaggccaaaatgctcttagataatatcaacacccctgaaggaattatcccctccatgtttgagccagaaagagagaaggtggacgctatagatggcgaatacaggctgcggggtgaggcccgtaaaaccttcgtcgaccttatgcgccgaggggatctgcctgtgtggctcgcttataaggttgcagccgagggcattaattacgctgacagaaaatggtgttttgatggaatcaagaacaaccagattttggaagagaatgtggaagtcgagatctggactaaggagggcgaaaggaaaaagctgaaaccccggtggctcgacgcccgcatatatagtgatccactggcacttaaggagttcaaagaattcgcggccgggagaaagagcctaacactgaacttgatcaccgagatgggaaggttacctacatttatgactcagaaggctcggaatgccctggacaacctcgcagtgctgcatacggctgaagccggtggccgagcatacaatcacgccctttcggagctgccggagaccctcgaaacattgctgctactgactctccttgctaccgtaacagggggaattttcctgtttttaatgtctggcaaaggtatcgggaagatgaccttgggcatgtgctgcattatcactgcgtccagcctgctctggtatgcccaaatacagccccactggattgcagcttcaatcatcctggagttctttcttattgtgctgctcatcccagaacctgagaaacagagaacgccccaggataaccaattgacctacgttgtcatagccattctgacagtggtggccgcaactatggctaatgaaatgggattcttagagaagaccaaaaaggacctaggcctggggagtatcacaacccaggagtctgaatccaacattctcgacatcgatcttcgcccagccagcgcgtggactctgtatgctgtcgccacaacgtttgttacccctatgttgaggcattcaatagagaatagtagcgtgaacgtatccctgactgcaatcgccaatcaggctacagtgctcatgggactgggtaagggctggcccctttctaaaatggacattggggtcccgctcctggcaatcggatgttacagccaggtgaacccaattaccttgaccgccgcgctgttactactggttgctcactacgccatcattggccctggtctccaagcaaaggccacacgggaagctcagaaacgtgccgcagctgggatcatgaagaatcccactgtggatggcataacggtcattgaccttgagccaatcccctatgatcctaaattcgaaaagcagctgggacaggtaatgttgctgatcctctgcgtgacccaagttctgatgatgagaacaacttgggccctttgtgaggcgttaaccctggccacaggcccgatttccaccctctgggaggggaaccccggaaggttttggaatactacgatagcagtgtcaatggctaacatcttccgcggctcttacttggccggtgcagggctgctatttagtattatgaagaatacaaccaacactcggcgaggaaccggcaacatcggtgaaacactgggcgagaaatggaagtcgagactcaatgctcttgggaaaagcgaattccagatttataagaaatccggaatccaggaggtcgacaggactctggccaaggagggcataaaacgcggggaaaccgatcatcacgccgtgtctcggggatcagcgaagttgagatggtttgtcgagcgtaacatggtgacaccagaaggcaaggttgtggacctgggttgcgggaggggaggctggagctactattgtggtggcctcaaaaatgtacgggaggtgaaggggctgacgaaaggaggccctgggcatgaagagcccatccctatgtccacctacggatggaacttagtccgccttcaaagtggcgttgatgtgttcttcactccacccgagaagtgcgacacactgctctgtgatattggtgaatctagccctaatccaaccatcgaggctgggcgaactctaagagtcctgaacttggtggaaaattggctgaacaataacacacagttttgcattaaagtactcaatccctatatgccgtcagtgatcgagaagatggaaacccttcagaggaagtacggaggcgcactggttcggaaccctttgtcccgcaatagtacgcacgagatgtactgggtgagcaacgccaccggcaatatagtctcttccgtgaacatgatttcaagaatgctgatcaacaggttcacaatgaaacacaagaaagctacttatgagccagacgtcgatctcgggagcggaacccgaaatatcggtattgaatcggagatacccaacttagacatcattggcaagcggatcgaaaaaattaagcaggagcatgaaacatcttggcactacgaccaagatcatccttataagacttgggcctaccacgggagttatgagaccaaacagacaggatccgcaagctcaatggtgaatggcgttgtacgtctgcttaccaagccatgggacgtggtccccatggtgactcagatggccatgacggatacaaccccgtttggtcagcaaagagttttcaaagagaaggtggacactcgcacccaggaacctaaagaggggacaaagaagctgatgaaaatcacggctgaatggctatggaaggagctcggaaaaaagaaaacccccaggatgtgtactcgggaggaatttacaagaaaggtccgctccaacgcggccctgggcgcaatattcaccgatgagaataaatggaagtctgctagggaagccgtggaggacggccgattttgggaattggtagatcgggagagaaacctgcacctcgaggggaagtgcgaaacttgtgtgtacaatatgatgggaaaaagggagaagaaacttggtgaattcggcaaggcaaaagggagccgcgccatctggtatatgtggctgggagctcgttttttagagttcgaagccctgggctttttgaacgaggaccattggttcagtcggggtaattccctcagcggggttgagggagaaggcctgcacagactaggctacattcttagggaggtcgggaagaaggaaggaggtgcgatgtacgcagatgacacagccggctgggatacccgcatcacactggaggacctcaaaaacgaagagatggtgactaatcatatgaagggggagcacaaaaagctggctgaagccatttttaaattgacctatcagaacaaggtggtccgagttcagcggccaacgcctagaggaaccgtgatggacatcatttctaggcgcgatcaaagaggctcaggtcaggtagggacatacggactgaatactttcaccaacatggaggcacagctcatacggcaaatggaaggcgagggcatcttcaagagtattcagcatcttacagctactgaggaaatcgccgtgcagaattggctggctagggtcgggcgtgagcgattatcccgcatggccatcagcggagacgattgcgtggttaaacccattgacgatagatttgcatctgcgctgaccgccttgaacgacatgggtaaggtgcggaaagatatacagcaatgggaaccatcgaggggctggaacgactggacgcaggtccccttctgctcacaccactttcatgagctcgtgatgaaggatgggcgcgtactggttgtgccttgtagaaatcaggacgaactaatcggacgggctaggattagccagggcgccggttggtcccttaaagagacagcatgcctggggaagagttatgctcaaatgtggaccctcatgtacttccaccgacgtgatctgagattggccgcaaacgccatctgttctgcggtcccaagccattgggtgccgacttcccgcacaacctggtcaattcacgctaagcacgagtggatgactaccgaagacatgttagccgtgtggaatcgggtctggatccaggagaacccctggatggaagataaaacacctgttgagagttgggaagaggtgccatatctgggaaagagggaggaccagtggtgcggctctctcataggccttacgagcagagcaacctgggccaaaaatatccagactgctattaaccaagtacgctccctgatcgggaatgaagagtacacagactatatgccctcaatgaagcggtttaggcgagaagaggaagaggccggagtgctatggtga

SEQ ID NO: 15066 - RNA, 9876 nt, synthetic construct
  misc_feature 1..9876: note = derived and/or modified CDS sequence (opt3) from DENV-2__AF208496__SS-prME
  source 1..9876: mol_type = other RNA
accgcaggcgtgatcgtaatgctgattcccacagctatggcattccacctcactacgagaaatggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccattcctacggcaaaacgaaccggaggatatcgactgttggtgcaattttacatccacctgggtgacttatggaacatgtaccacgactggcgagcaccgccgagaaaagcgttctgtggcgctcgtaccccatgtgggtatggggctggagaccagaacagaaacttggatgtcaagtgagggagcttggaaacacgttcagaggattgagacctggatccttcggcatcctggcttcacaataatggccgcaatcctggcctacaccattggcacgactcactttcagcgcgctttgatcttcattctcctgacagcagtggccccaagcatgaccatgagatgcatcgggatatccaacagggattttgtcgaaggagtgtctggtggctcgtgggtagacattgttctggagcacgggtcatgtgtgactacaatggctaagaataagcccaccctcgatttcgaattaatcaaaacggaggccaagcagcctgcgaccctgcggaaatattgcattgaagcaaaacttacaaacactaccacagagagccgctgtccaactcaaggagagcccagtttgaatgaagaacaggacaaacgatttatctgcaagcattccatggtcgatagaggctggggtaacgggtgtggactgttcggcaagggcgggatcgtgacctgcgccatgtttacatgcaaaaagaatatggaaggaaaagtggtccagcctgagaacctagaatacaccattgttataactccacactctggtgaggagcatgctgtgggcaatgacacggggaagcacggaaaagaaatcaagattacaccgcagagctccatcaccgaggccgaactcactggctatggtaccgtaacaatggagtgttcacccaggaccgggctggatttcaacgaaatggtgcttctgcaaatggaggacaaagcatggttggtccaccggcagtggtttctcgatctgcctttaccatggctgcccggcgctgacactcagggaagtaattggatacagaaggagacactcgtgacgttcaagaaccctcatgccaaaaagcaagacgttgtggtccttggcagccaggaaggggcgatgcacaccgccctgactggagcaacagagattcagatgtcttccggtaatttgctattcaccggccatctgaaatgccgtctccgcatggataagctgcaacttaaagggatgtcatacagcatgtgtacaggaaagtttaagatcgtgaaagaaatcgctgagactcagcacggcaccattgtaatcagagttcagtatgagggtgacgggagtccatgcaagattcccttcgaaataacggatctggagaaaaggcatgtgttgggccggctcatcaccgtcaacccgattgtgacagaaaaggactctcctgtcaacatcgaggccgaacccccatttggagattcctacatcattataggcgtggagcctgggcagctgaaattaaattggttcaagaagggaagctcgatcggtcaaatgtttgagactaccatgcgaggcgctaaacgcatggccattctgggggacacagcatgggatttcggatctctaggcggtgtttttacttccatcgggaaggccctccaccaggtgttcggcgctatttacggagcggcattttcaggcgtaagttggaccatgaaaatcctgataggggtcatcattacgtggatcggaatgaacagcagatccacatctcttagcgtgtcattggttctggtgggcgtcgtgaccctctatctgggtgccatggtacaggctgacagtgggtgtgtggtttcctggaagaataaagaacttaagtgcggaagcggcattttcatcactgataacgtccacacatggaccgagcagtacaagtttcaacccgaatctccatcaaaactggccagtgcaatacagaaggcccatgaggaaggtatttgtggcatcaggagcgtgactcggttggagaatctcatgtggaaacagattacccccgagctgaaccacatcttatccgaaaatgaggtgaagctgacaataatgacgggggacatcaaaggaattatgcaggctggcaagcgctctctaagacctcaaccaaccgaactcaaatattcgtggaagacttgggggaaggccaaaatgctgagcacagagtcccataaccagaccttccttatcgatggaccggaaacagcagagtgccccaatactaacagggcgtggaactcattggaggtcgaagactacggctttggtgttttcaccacgaacatttggctgaagctccgtgagaaacaggacgtgttctgtgatagtaagctgatgtctgctgccatcaaagacaatcgggcagtgcacgccgatatggggtattggatagaaagcgctttaaacgacacatggaagatggagaaggcctcctttattgaggtaaaatcatgccactggcctaagagccataccctgtggtctaatggagtccttgaatccgagatgatcatccccaagaatttcgcaggccccgtgagtcagcacaactaccgacctggttatcatactcaaaccgctggcccatggcacttggggaagctcgaaatggattttgacttctgtgagggaacaactgttgtggtcaccgaagattgcggcaatagagggcccagcctgaggacaacgaccgcctctggaaaactaattactgagtggtgctgtcgctcctgcacactgccgcctctccggtacagaggcgaggacggttgttggtacgggatggaaatcaggccactgaaggagaaggaagagaaccttgtaaattcattggttaccgcgggacatggccagattgataactttagtctgggtgtgttaggcatggccctcttcctggaagagatgcttcgcactcgagtagggacaaaacacgctatactgttggtcgcagtgagctttgtgaccctcatcacgggaaatatgtcgttccgggacctgggccgtgtcatggttatggtgggggccactatgaccgatgacattggaatgggcgtaacatatctagctctgctcgccgcatttaaggtgagacccaccttcgcggccggtctgcttttgaggaaactgacttccaaggagttaatgatggctacaatcgggattgccctcctgtctcagagcaccatgcctgaaacaatccttgagctgactgatgcactagctctcggaatgatggtcctgaaaatagtgcgcaacatggaaaagtaccaattggccgttaccatcatggcaatttcatgcgtgcccaatgccgtcatcctgcagaacgcttggaaggtgagttgtacgattttagcggccgtttccgtgtctccactcctgcttacaagctcccagcagaaagcagactggatccctctggctttgaccataaagggcctcaatcccactgccatttttctgaccacactatcacggactagcaaaaagagaagttggccactgaacgaggccatcatggctgtcggcatggtatctatccttgcatccagcctcctgaaaaatgacattccgatgaccgggcctttggtggccggaggtctgttaacggtttgctatgtgctcacaggcaggtcggcggatctggaacttgagcgagctgccgacgtcaagtgggaggatcaagcagaaatatcagggtctagtcccatcctgtccattaccatcagcgaggacggatctatgagcattaaaaacgaagaggaggaacagactttgacaatcctcatacgcaccggcctgctagtgatctccggtgtattcccagtgtcaattcccatcactgccgctgcatggtacctgtgggaggtcaagaagcagcgggccggggttctttgggatgtgcctagtccaccccctgtgggaaaagcggaactcgaggacggcgcttatagaattaagcagaggggcatcctggggtacagccaaataggagccggtgtctataaagaaggcacatttcacaccatgtggcatgtgacgcgtggggcagttttgatgcaccgcggaaagcggattgagccgtcttgggccgatgtcaaaaaggacttaatctcctacggcggtgggtggaagctggagggagaatggaaagagggcgaagaggtgcaggtcctcgctctggaaccaggcaagaatcccagagccgtgcagactaaacctgggatcttcaagaccaacacaggaaccattggtgcagtttcacttgatttcagtccaggcacaagcgggtcccccatcgtggacaggaaaggaaaggtcgtgggcctgtacggtaatggggtagtcactcgatctggagcttatgtgtcggccatagcgcagaccgaaaagagcattgaggataaccctgaaatcgaggacgatatttttcggaaaaagcgcttgacgatcatggacctacatccgggcgccggcaaaacaaagagatacctgcccgcaatagttagggaagctattaaacgggggctccgaactctgatccttgccccaaccagagtggtcgctgcagagatggaagaggccttacgcggactgcctatcaggtatcaaacacccgccattcgtgctgagcacaccggtcgggaaatcgtggacctcatgtgtcatgcgactttcaccatgagattgctgtcaccagttagggtgcctaactacaatctcattataatggatgaggcacactttacagaccccgcctccatcgctgcccgcggctatattagtacgcgagtcgaaatgggggaggcagccggaatcttcatgactgctaccccaccgggctctagagatccttttccccagagcaacgcgccaatcatggacgaggaacgggagattcccgaaaggtcctggaactcaggtcacgagtgggtgacagatttcaaggggaagaccgtatggtttgtgccttctataaaagccggaaacgacatcgcagcttgcctgcgcaagaatggcaaaaaggttattcagcttagccgtaaaactttcgatagtgaatacgtcaagacaagagccaacgactgggattttgtggtgaccacggacatctccgagatgggcgcaaatttcaaggccgagcgggtcattgatccaaggcgctgtatgaaacccgtaatcctgactgacggggaagaacgagtgatattggctggacctatgccggttacacatagctctgccgcgcaaagacggggtaggatcggccgcaacccaaagaatgaaaacgaccagtatatttacatgggggagcccctagaaaatgatgaggactgcgcacactggaaagaggccaagatgctgctcgataacatcaatacccctgaaggaattatcccctcaatgtttgagccagaaagagagaaagtggacgctatagatggcgaatacaggttacggggtgaggcccgtaagaccttcgtcgacctgatgcgccgaggggatcttcctgtgtggctggcttataaagttgcagccgagggcattaactacgctgacagaaagtggtgtttcgatggaatcaagaataaccagattctcgaagagaacgtggaagtcgagatctggactaaagagggcgaaaggaagaaattgaagccccggtggctggacgcccgcatatattccgatccactcgcactgaaagagtttaaggagttcgcggccgggagaaagagtcttacactaaatctgatcaccgagatgggaaggttgcctacatttatgactcagaaagctcggaacgccttagacaatctggcagtgctccatacggctgaagccggtggccgagcatacaaccacgccctgagcgagcttccggagaccctggaaacactcttgctgctaactctgctcgctaccgtaacagggggaattttcctttttctgatgtcgggcaagggtatcgggaaaatgaccttaggcatgtgctgcattatcactgcgtcttccttgctgtggtatgcccaaatacagccccactggattgcagctagcatcatcctcgagttctttctgattgtgcttctgatcccagaacctgagaagcagagaacgccccaggataatcaactcacctacgttgtcatagccattttgacagtggtggccgcaactatggctaacgaaatgggattcctggagaaaaccaagaaggacttaggcctagggtcaatcgccacacaggagagtgaatctaatattctggacatcgatctccgcccagcgtccgcttggaccctttatgccgtcgcaactacatttgttacgcctatgctgaggcatagcatagagaactcaagtgtgaatgtcagcttgaccgccatcgctaaccaggcaactgtgctgatgggactcggtaaaggctggcccctgtccaagatggacattggggtcccgcttctcgccatcggatgttactctcaggtgaatccaattacactgaccgcggctttgctgctattagttgcccactacgcaatcattggccctggtctgcaagccaaagctacccgggaagcccagaagcgtgcagctgccgggatcatgaaaaaccccacagtggatggcataactgtcattgacctcgagccaatcccctatgatcctaagttcgaaaagcagcttggacaggtaatgctgttgatcctgtgcgtgacgcaagttctcatgatgagaaccacatgggcgctgtgtgaggcccttactttagcaaccggcccgattagcacactgtgggaggggaatcccggaaggttttggaacaccactatagctgtgtccatggccaatatcttccgcggctcatacctcgccggtgctgggttgctgttttctattatgaaaaacacgacaaatacccggcgaggaactggcaacatcggtgaaaccctaggcgagaagtggaaaagtagactgaacgccctcgggaagtcggagttccagatttataaaaagagcggaatccaggaggtcgacaggacacttgccaaagagggcataaagcgcggggaaactgatcatcacgcggtgtcccggggatctgctaagctgagatggttcgtcgagcgtaatatggtgaccccagaaggcaaagttgtggacttgggttgcgggaggggaggctggtcatactattgtggtggcctgaagaacgtacgggaggtgaaagggctcacaaagggaggccctgggcatgaggaaccaatccctatgagcacgtacggatggaatctggtccgcttacaatccggcgttgatgtgtttttcaccccacccgagaaatgcgacactcttctgtgtgatattggtgaaagttctcctaacccaacaatcgaggcagggcgaaccctcagagtcctaaatctggtggaaaactggttgaataacaatactcagttttgcattaaggtactgaacccctatatgccgagcgtgatcgagaagatggaaacactccagaggaaatacggaggcgcccttgttcggaatcctctgtcacgcaactccacccacgagatgtactgggtgagtaatgctacgggcaacatagtcagctctgtgaatatgatttccagaatgttgatcaacaggttcaccatgaagcacaaaaaggccacatatgagccagacgtcgatctggggtcaggaactcgaaacatcggtattgaaagcgagatacccaatctcgacatcattggcaaacggatcgaaaagattaagcaggagcatgaaacctcgtggcactacgaccaagatcatccttataaaacatgggcataccacgggtcttatgagactaagcagaccggaagtgcctccagcatggtgaacggcgttgtacgtttactgacaaaaccatgggacgtggtccccatggtgacccagatggctatgactgatacgacaccgtttggtcagcaaagagttttcaaggagaaagtggacacccgcactcaggaacctaaggaggggaccaagaaacttatgaagatcacagcggaatggctgtggaaagagctaggaaagaaaaagacgcccaggatgtgtacccgggaggaatttactagaaaagtccgctcaaatgccgcactcggcgctatattcacagatgagaacaagtggaagtccgccagggaagcagtggaggacggccgattttgggaactggtagatcgggagagaaatttgcacctggaggggaaatgcgaaacctgtgtgtacaacatgatgggaaagagggagaaaaagctcggtgagttcggcaaagccaaggggtctcgcgctatctggtatatgtggcttggagcccgttttctggagttcgaagcgttaggctttctgaatgaggaccattggttcagccggggtaacagtttgtccggggttgagggagaaggcctccacagactgggctacattctaagggaggtcgggaagaaagaaggaggtgcaatgtacgccgatgacactgctggctgggatacacgcatcacccttgaggacctgaagaatgaagagatggtgacaaaccatatgaaaggggagcacaagaaactcgccgaagcaattttcaagctgacttatcagaataaggtggtccgagttcagcggccaacccctagaggaacggtgatggacatcattagcaggcgcgatcaaagaggctctggtcaggtagggacctacggattgaacacatttactaatatggaggctcagctgatacggcaaatggaaggcgagggcatcttcaaatcaattcagcatctcaccgccacagaggaaatcgctgtgcagaactggcttgccagggtcgggcgtgagcgactgagtcgcatggcaatctccggagacgattgcgtggttaagcccattgacgatagatttgcgagcgccttaactgctctgaatgacatgggtaaagtgcggaaggatatacagcaatgggaaccatctaggggctggaacgactggacccaggtccccttctgctcgcaccactttcatgagttggtgatgaaagatgggcgcgtactcgttgtgccttgtagaaaccaggacgaactgatcggacgggccaggatttcacagggcgcaggttggagcctaaaggagacggcttgccttgggaagtcctatgcccaaatgtggacactgatgtacttccacaaacgagatctccgtctggcagccaatgcgatctgtagtgctgtcccatctcattgggtgccgaccagcagaactacatggtccattcacgccaagcacgagtggatgaccactgaagacatgttggcagtgtggaaccgcgtctggatccaggagaatccctggatggaagataaaacccctgttgagtcatgggaagaggtgccatatttaggaaagcgggaggaccagtggtgcggcagtctgataggcctcacatctagggccacgtgggctaaaaacatccagaccgccattaatcaagtaagaagccttatcgggaacgaagagtacactgactatatgccctccatgaagcgctttcggagggaagaggaagaggcaggagtgctgtggtga

SEQ ID NO: 15067 - RNA, 9876 nt, synthetic construct
  misc_feature 1..9876: note = derived and/or modified CDS sequence (opt3) from DENV-2__AY702040__SS-prME
  source 1..9876: mol_type = other RNA
accgcaggaatgatcattatgctgatacccaccgtgatggctttccacctcactacgcggaatggggagcctcatatgatcgtcagcaggcaggaaaaggggaaatcccttctgtttaagaccaaagacggtacaaatatgtgcactttgatggcaatggatttaggcgagctgtgtgaagacaccattacatacaagtgcccattcctaaaacaaaacgagccggaagatatcgactgttggtgcaattctacctcaacttgggttacatatgggacctgtacgactaccggagagcaccggcgcgagaagcgaagtgtggccctcgtcccccatgtgggcatgggtctggaaacacgtactgagacctggatgagctccgaaggggcgtggaagcacgctcagcggattgagacatggatccttaggcatcctggatttaccataatggccgcaatcctggcctacacgattggcactacacacttccagcgggtcttgatctttattctcctgaccgctatcgcaccatctatgactatgcgctgcataggcatttcgaacagagatttcgtggagggggtttcaggaggtagctgggtggacatcgtcctggaacacggcagttgtgtgacaaccatggccaaaaataagcccacgctcgattttgagttaattaaaaccgaagctaagcagcctgccacactgaggaaatattgcatcgaggcgaaacttactaacaccacaactgactcccggtgtccaacccaaggggaacccacattgaatgaggagcaggataagcgcttcgtatgcaaacattctatggttgaccgaggatggggcaacggttgtgggctgtttggaaagggcggcatcgtgacctgcgcaatgttcacttgcaaaaagaatatggaagggaaaattgtccagcctgagaacctagaatacacggtggtgataacaccacacagcggagaggaacatgccgtcggtaatgataccggcaagcacgggaaagaggttaagatcactccgcagtcctcaattaccgaggctgaactcacaggatatggcaccgtgactatggagtgtagtcccagaacaggtctggactttaacgaaatggtacttctgcaaatggaggataaggcctggttggtgcacaggcagtggttcctcgacctgcctttaccatggctgcccggggcagacacgcagggcagcaattggatccagaaagaaaccctcgtcacttttaagaaccctcatgctaaaaagcaagatgtggttgtgcttggatctcaggagggcgccatgcacacagcgctgaccggggccacagagatacagatgtcctcaggaaatttgctattcactggtcatctgaaatgccggctccgtatggacaagctgcaacttaagggcatgagctacagtatgtgtaccgggaaattcaagattgtcaaagaaatcgcagagacgcagcacggaaccatcgtgattcgcgtacagtatgaaggcgatggttctccatgcaagatcccctttgagattatggacctggagaaaagacatgttttggggaggctcataacagtgaacccgatcgtcactgaaaaggattcccctgtgaacattgaggctgaacccccattcggcgacagctacatcatcattggagtcgagcctggccagctgaagttagattggtttaaaaaggggtcgtctataggacaaatgttcgaaaccacaatgcggggtgccaaacgaatggctatcctgggcgacactgcctgggattttgggtccctaggaggcgtgttcacctcaattggtaaggcactccaccaggtttttggggccatctacggcgctgcgttcagtggagtgagctggacgatgaaaattctgatcggcgtaataatcacatggattgggatgaactcccgctctaccagcctttcagtcagtttggtgctggttggaatcgtgactctctatctgggcgtcatggtgcaggcagactccggttgtgtagtgagctggaagaacaaggagcttaaatgcgggtctggaatttttgttacagataatgtccacacctggactgagcagtacaagttccaacccgaatcaccaagtaaactggccagcgctatccagaaggcccatgaggaaggcatatgtggtattagatccgtgaccaggttggagaacctcatgtggaaacagatcacatctgaactgaatcacattttatcggagaacgaggtgaagctgacgatcatgaccggcgacataaaagggatcatgcaggtcggaaagcggagcctacgcccccaacctactgaactcagatattcctggaagacatggggcaaagcaaagatgctgtcaaccgagcttcataatcagacatttttgattgacgggccagaaactgccgagtgcccgaacaccaatagggcttggaacagtctggaagttgaggattacggattcggcgtgtttacgacaaatatctggctccgtctgcgggagaaacaggacgccttctgtgatcccaagttaatgtctgcagcgattaaagacaaccgagctgtgcacgccgatatgggttattggatcgaaagcgcactgaatgacacctggaagatagagaaggcctccttcattgaagtaaaatcatgccactggcctaagagccatactctttggtctaacggggtcttggagtccgagatggtgatccccaagaattttgctggacccgttagtcagcacaacaacagacctggctaccatacccaaacagccggtccatggcacctcggcaagctggaaatggatttcgacttttgtgaggggactaccgtggtcgtgacagaagagtgcggaaataggggccccagcctacgcacgaccactgcatctgggaaactgatcacagaatggtgctgtcggtcctgcaccctcccgcctctgagatataggggagaggatggctgttggtacggtatggagattcgcccacttaaggaaaaggaggaaaacttggtttcaagtctggtgactgctgggcatggacagatcgacaatttcagcttaggcattctcggtatggccctgtttcttgaggaaatgctgcgaacacgggtaggcaccaaacacgcgatattgctcgtcgccgtgtcgttcgtgacgctgatcactgggaacatgtcctttcgtgatctaggaagagtcatggttatggtgggcgctaccatgacagacgatattgggatgggagtaacctacctggcactcctggccgctttcaaggtgaggcccacttttgccgcaggccttttgctgcgcaaattaacatctaaggagctcatgatgaccacaatcggtattgtcctgcttagccagtcaagtatccctgagactatactggaactaaccgacgcgctcgccctggggatgatggtgttgaaaatggttcggaatatggagaagtatcaactggctgtgacgatcatggccattttatgcgtccccaacgcagtgatcctccagaatgcttggaaggtttcctgtacaattctggccgtggtctctgtaagcccacttctgttgacctcctcacagcagaaagcagactggatccctctcgccctgactataaagggactaaaccccaccgctattttcctgacaactcttagcagaaccagtaaaaagaggtcttggccactcaatgaagcgatcatggccgtgggcatggtttccatcctggcaagctcgttgctgaaaaacgatattccgatgacgggccctttagtggctgggggactcctgacagtctgctacgtgcttaccggtcgatcagccgacctggagttggaacgcgccactgatgtaaagtgggacgatcaagctgagatatctggcagttcccccatcctcagcattatcatttctgaggacgggagcatgtccatcaaaaatgaagaggaggaacagacactgaccatactaatccggactggactgcttgtgatttcaggcctctttccagtcagtatccccattacagcagccgcgtggtatctgtgggaggttaagaagcagagagctggtgtgttgtgggatgtgcctagcccaccccctgtcgggagggccgaattagaggacggagcataccgtatcaaacagaagggcatactgggctattctcaaattggggccggagtgtacaaagaaggtaccttccacacgatgtggcatgttactcgcggcgctgtactcatgcacaaggggaaacggatcgagccgtcctgggcagatgtgaagaaggacctgatctcatatggaggcggttggaaacttgaaggggagtggaaggagggagaagaggtccaggtgctggccttggaaccaggcaaaaaccccagagcggttcagaccaagcctggcctatttaggacaaataccgggacaattggagctgtgagtctggatttcagcccaggtacttccggctctcccatcgtcgacaaaaaggggaaggtggtaggactctacggcaacggtgtcgtgacccgagggggagcctacgtttcggcaatagcccagacggagaaaagcattgaagataatcctgagatcgaggacgacattttccggaagcgcagactgacaatcatggatcttcatccgggcgctggcaaaactaagaggtatttacccgccatagtgcgggaagcaattaaacgagggctgagaaccctcatcttggctccaacacgcgtcgtggccgcggagatggaagaggccctgaggggactccctatccgttaccaaacccccgcaattcgggctgaacacactggtagagagatcgttgacctgatgtgtcatgccacctttacaatgaggcttctgtcaccaattcgcgtgcctaactataacttgataatcatggatgaggctcacttcacggaccccgcatccattgccgcccgaggctacatcagtactagagtcgaaatgggggaggctgcgggaatctttatgaccgcaacaccaccgggctctcgggatcctttcccccagagcaatgccccaattatggacgaagagagggagatacccgaacgctcctggaactcaggtcacgagtgggtgaccgattttaaggggaagactgtatggttcgtgccttctatcaaaacaggaaatgacattgctgcctgcctacgtaagaacggcaaaagagttatccagctgagccggaagacctttgatagtgaatatgtcaaaacgaggactaatgactgggatttcgtggtgacaaccgacatttccgagatgggcgcaaactttaaggccgaacgcgtcatcgacccacgaagatgtatgaagcccgtaatactcaccgatggggaggagcgggtgatcttagctggacctatgccggttactcatagctctgcggcccaaaggcgcggtagaattggcaggaatccacggaacgaaaatgaccagtacatctatatgggggagcccctggaaaacgatgaggactgcgcacactggaaagaagctaagatgcttctggataatattaacacacctgagggaatcataccctcaatgttcgagccagaacgtgagaaagtggacgccattgatggcgaataccgcctccgaggtgaggcaagaaagacctttgtcgacttgatgaggagaggggatctgcctgtgtggctcgcctacaaagttgctgccgaaggcatcaattatgcggaccgcagatggtgtttcgatggaacaaggaacaatcagattctggaggagaacgtggaagtcgagatctggactaaggaaggcgagcggaagaaacttaaaccccgatggctagacgcaagaatatactccgatccactggccttgaaagagttcaaggaatttgctgccgggcgcaaaagtttaacgctgaacctcatcaccgagatgggaaggctgcctacattcatgactcagaaggctcgggacgcacttgacaatctggccgtgctccataccgctgaagccggtggcaaagcatataaccacgcgttgagcgagctgccggaaacactagagaccctgctccttctgactttattggccacggtaaccgggggaatttttctgttcctcatgtcgggccgtggtatcgggaagatgacactgggcatgtgctgcattatcactgcttctatacttctgtggtacgcccaaattcagccccactggatcgcagcttccatcattctcgagtttttcttgatcgtgctgttaataccagaacctgagaagcagagaaccccacaggataatcaactaacatatgttattatcgccattctgaccgtcgtggcagccactatggctaacgaaatgggatttctcgagaaaacaaagaaagacttcggccttgggcatatcgcgacgcagcagccagaaagcaatatactggatatcgacttgaggcctgcctcagcatggaccctgtacgctgtggccactacatttattacccccatgctccgccacagtatcgagaactcttccgtcaatgttagcctgaccgccattgcaaaccaggctacagtgcttatgggactcggtaagggctggccgctgtcaaaaatggatatcggggtaccattgctggccattggatgttatagtcaagtgaatcctatcactttaacggcggctctactgctccttgtcgcccattacgcaataattggccccggtctgcaggccaaggctacccgggaggcacagaagcgagccgcggctgggatcatgaaaaacccaacagtggacggcatcactgttattgatttggaccccataccttacgatccgaagttcgaaaaacagctgggacaagtgatgctcctggtcctttgcgtaacccaggtgttaatgatgagaacaacctgggccctgtgtgaggcactcactttggccacgggccccgttagcacactgtgggaagggaatccaggaaggttttggaacaccactatcgctgtgtccatggccaatattttccgcggctcttatctagccggtgctgggctgctctttagcatcatgaagaacaccacatccgcccggagaggaactggcaatatgggtgagacccttggcgaaaaatggaagtcacgtctgaacgcgttggggaagtctgagttccagatttacaaaaagagtggaatccaagaggtcgacaggacactggccaaagaaggcataaagagaggggaaacggatcaccatgcagtgtcgcgcggaagcgctaaactccgatggttcgtcgaaagaaatctggtgacccctgagggcaaggttgtggacttaggttgcgggaggggaggctggtcctattactgtggtggccttaaaaacgtacgggaggtgaaggggctgactaagggaggccccgggcacgaggagcctatcccaatgtctacatatggatggaacctcgtccgcctacagtcaggcgttgatgtgtttttcgtaccccctgaaaaatgcgacaccctgttgtgtgacattggtgagagctccccaaatcccactgtggaagccgggagaacactgagggtactcaaccttgtggagaattggctgaacaataacacccagttttgcgttaaggtgttgaatccgtacatgcctagtgtcatcgagcgaatggaaacgctgcagcggaaatatggaggcgcactcgtgcgtaacccattatctagaaatagcacccacgagatgtactgggtctcaaacgcttccggcaatattgtgagtagcgttaacatgatctctcgcatgctgataaataggttcacaatgcggcataagaaagccacttacgaacccgatgtagaccttgggtccggaaccagaaacattggtatcgagtcagaaacacctaatctggatatcattggcaagcgcatagagaagatcaaacaagagcacgaaactagctggcattatgaccaggatcacccatacaagacctgggcctatcacgggtcgtacgagacaaaacagaccggatctgcgagttccatggtgaacggcgtcgtgaggctactcactaagccctgggacgttattccgatggtgacgcagatggctatgacagataccactccttttggtcaacagcgagtcttcaaagaaaaggtggacacccggacacaggagcccaaggaagggacgaaaaagctgatgaaaatcaccgcagagtggttgtggaaggagctgggcaagaagaagactccaagaatgtgtacaagggaagagtttaccaaaaaggtacgcagcaacgccgctctcggcgccattttcactgatgaaaataaatggaagtcagcacgtgaggccgtggaggacaaccggttttgggaacttgttgataaagagagaaatctgcatttagaaggcaagtgcgagacatgtgtctataacatgatggggaaaagggaaaagaagctgggagagttcggtaaagctaagggctcccgcgcgatctggtacatgtggttgggggcccgatttctcgagttcgaagcactgggatttctaaatgaggaccactggttctctcgggaaaacagccttagtggcgtggagggtgaagggctgcataaactcggatatatactgagagaggtgtccaagaaagagggcggcgctatgtacgccgacgataccgcagggtgggacacaaggatcactattgaagatttgaagaatgaggaaatgatcaccaaccacatggccggagagcataagaaactggctgaagccattttcaagctcacgtaccagaataaagtcgttcgcgtgcaaagacctacaccccggggtacagtaatggacatcattagcaggaaggatcagcgtggctctggacaggtgggaacttatggccttaacacctttacaaatatggaggcgcaactgatacgacagatggagggtgaagggatcttcaaatcaattcagcacttaactgcaagtgaggaaatcgccgtccaggactggctggtgcgcgttggaagagagcggttgtccaggatggctatcagcggcgatgactgcgtggtcaagccactcgatgaccgctttgccaaggcactgaccgctctaaacgatatgggcaaagtgagaaaggacattcaacagtgggagccctctcgggggtggaatgattggacgcaggtacctttctgctcgcaccattttcacgaacttataatgaaagacggaaggacactggttgtgccatgtcgaaaccaggacgagctcatcggtcgtgccagaatttcacaaggcgctgggtggagcctgcgcgaaaccgcctgcttgggaaagtcctacgcacagatgtggagtttaatgtatttccatcggagggatctgagactcgcggccaatgctatctgttctgccgtcccgagccactgggtgcccacttcccgcacaacctggtcaattcacgcaagtcatgagtggatgactaccgaagacatgcttacagtgtggaaccgggtctggatcctggagaacccttggatggaggataaaacgccagttgaatcttgggaggaaataccctacctaggcaagagggaggaccagtggtgcggtagcctgatcgggctcacctcccgagctacttgggccaagaatattcagacagcaatcaaccaagtgagatcattgattggaaatgaagagtataccgattacatgcctagcatgaaacggtttaggcgcgaggaagaggaagccggcgtactgtggtga

SEQ ID NO: 15068 - RNA, 9876 nt, synthetic construct
  misc_feature 1..9876: note = derived and/or modified CDS sequence (opt3) from DENV-2__AY037116__SS-prME
  source 1..9876: mol_type = other RNA
accgccggcatcattataatgatgatccccactgtgatggctttccacctgactacgcgaaatggggagcctcatatgattgtcagcaggcaggaaaaaggaaaatccctcctttttaagaccgagaatggtgttaatatgtgcaccctgatggcaatggacttgggcgaattatgtgaggatactatcacctacaattgcccactgctacggcaaaacgaaccggaggacattgattgtgggtgccactctacctcaacctgggtgacttatggaacatgtaccgccacgggcgagcatcgccgagaaaaacgtagtgtagcgctcgtgccccacgtcggtatggggctggagactcggaccgaaacatggatgagctccgagggagcttggaagcatgcccagaggatcgagacttgggtgcttcggcaccctggcttcaccataatggcagccatcctggcttacacaattggcaccacgtattttcagcgcgttttgatcttcattctcctgactgcagtgacaccatctatgaccatgagatgcatcgggatatcgaatagggactttgtcgaaggagtgtcaggtggcagctgggtagatattgttctggagcacgggagttgtgtgactacaatggccaaaaacaagcccaccctcgacttcgaattagtcaagacggaggctaaacatcctgccaccctgcggaagtactgcatcgaagcgaaacttacaaatactaccacagcatcccgctgtccaactcagggagagccctctttgaacgaggaacaagataagcgatttgtgtgcaaacacagcatggtggacagaggctggggtaatgggtgtggactgttcggcaagggcgggattgtaacctgcgccatgtttacatgcaagaaaaacatggagggaaaggttgtgcagcctgaaaatctagagtataccatcgtaatcactccacattccggtgaagagaacgctgtgggcaatgatacggggaaacacggaaaggagattaaagtcacaccgcagtcaagtataaccgaagccgagctcactggctacggtaccgtgacaatggaatgtagccccaggaccgggctggacttcaacgagatggttcttctgcagatggaaaataaggcatggttggtgcaccggcaatggtttctcgatctgcctttaccatggctgcccggcgctgacactcagggatctaactggatccagaaagagacactcgtcacgttcaagaaccctcatgccaagaaacaggatgtggtagttcttggctcccaagagggggcgatgcacaccgccctgactggagcaacagaaattcagatgtcaagcggtaatttgctatttaccggccatctgaagtgccgtctccgcatggacaaactgcagcttaaggggatgagttattctatgtgtacaggaaaattcaaggtggtcaaggagatcgctgaaactcaacacggcaccatagtgattagagtccagtacgagggtgacgggtccccatgcaaaatccccttcgagatcatggatctggaaaagaggcatgtgttgggccggctcattacggttaacccgatcgtgaccgagaaagacagccctgtaaatattgaagccgagcccccatttggagattcgtacataatcattggcgtcgaacctgggcagctgaagttatcttggttcaaaaagggatcctcaatcggtcagatgtttgagacaactatgcgaggcgctaagcgcatggccatcctgggggacaccgcatgggatttcggaagtctaggcggtgtgtttacaagcattgggaaagccctccaccaagttttcggcgctatatatggagcggcattttccggcgtgtcttggactatgaagatcctgattggggtcgtgatcacctggattggaatgaacagcagatcaacgagtctttccgtcagcttggtgctggttggcgtcgtgacactctacctgggtgtgatggtccaggccgactctgggtgtgttgtgtcatggaaaaataaggagcttaaatgcggaagtggcatcttcataaccgataacgtgcacacttggacagaacagtataagtttcagcccgagagcccatccaagctggcttctgccatccaaaaagcacatgaagagggtatttgtggcatcaggtcggtaacccggttggaaaatctcatgtggaagcagattactcccgagctgaaccacatcttaagcgagaatgaagtcaaactgaccataatgacaggggacattaagggaatcatgcaggccggcaaacgctccctaagacctcagccaacggagctcaagtactcatggaaggcttgggggaaggccaagatgctgagtaccgaacttcataaccacactttcttgattgatggaccggagacagcagaatgccccaataccaacagggcgtggaactctctggaggtggaggactatggctttggtgttttcacaactaacatctggctcaaactgaaggaacgtcaagatgtgttttgtgacagcaaattaatgtccgctgccataaaggacaatcgggcagtccacgccgatatggggtactggatcgagtcagctctgaacgacacctggaaaattgaaaaggccagcttcatcgaggtgaagtcttgccattggcctaaatcccacacgctttggagtaacggagttttggagagcgaaatgattatcccaaagaatttcgcaggccccgtgtctcagcataactatcgacctggttaccacacacagaccgctggcccatggcatctcgggagactggagatggattttgacttctgtgaaggaactaccgtagtcgtgacagaggattgcggcaatagggggccctccctacgcactaccacagcctcaggaaaactgataacggaatggtgctgtcggagttgcaccctcccgcctctgagatacaggggcgaggacggttgttggtatgggatggagattcgcccacttaaggaaaaagaggaaaacttggtgaatagcctggtcactgcgggacacggccagatcgataacttttcgttaggtgttctcggcatggccctgttccttgaggaaatgctgcgaacacgggtggggaccaagcacgctatcttgctcgtagcagtgtcctttgtcactctgattacaggaaatatgtctttccgtgacctaggcagagtgatggttatggtgggggccaccatgacggatgacatcggaatgggcgtcacttacctggctctcctggccgcatttaaggtgaggcccaccttcgcggccggtcttttgctgcgcaaattaacaagcaaggagctcatgatgaccactattgggatagttctgctttcacaaagtacaatccctgagaccattctggaactaacagatgcttgggccctcggaatgatggtgctgaaaatcgtccggaacatggagaagtatcagttggcagtaactattatggctatcctgtgcgtgcccaatgccgttatattacagaacgcatggaaagtgtcctgtaccacgctcgccgtcgtgtctgtaagcccactgcttctgacatcctcacaacagaaggctgactggatccctttggcgctcaccattaagggcctgaatcccactgccatctttctaaccacactgagcagaacaagtaaaaagaggtcttggccacttaacgaagcaattatggctgtgggcatggtctccatcctcgccagctcgctgttgaaaaatgatataccgatgaccgggcctctggttgccggaggtttactcacggtgtgctacgtgctgacaggccgatcagctgaccttgagctggaacgcgcagccgacgtccggtgggaggagcaggcggaaatttctgggagttcccccatcttgagcatcaccatttctgaggatggaagcatgtccataaagaacgaagaggaggaacagactctcacaatcctgattagaaccggcctactggtgatctcaggtcttttcccagctagtattcccatcactgccgcagcctggtatctctgggaggttaaaaagcaaagggctggggtactgtgggacgtgcctagcccaccccctgtcggaaaagcagaattggaggatggcgcctaccgtataaagcagaagggcatcttagggtattctcagattggagcgggtgtgtacaaagaaggcacatttcataccatgtggcacgttacgcgcggggctgtgctgatgcataagggaaaacggatcgagccgtcctgggccgacgtcaagaaagatctcatttcatacggcggtgggtggaagctggagggagaatggaaggagggcgaagaggtgcaggtacttgcactggaaccaggcaaaaatcccagagccgtccaaactaagcctgggttgttcaaaaccaacacaggaaccatcggtgctgtgagtctagactttagcccaggcacatccgggtctcccatagttgataagaaaggaaaggtggtcggcctgtatggtaacggggtggttactaggtcgggagcctacgtgagcgcaattgctcagaccgagaagtcaatcgaggacaatcctgaaatcgaggatgacattttcaggaagaaacggctcacgatcatggatctgcacccgggcgccggcaaaacaaaacgctatcttcccgcgatagtcagagaagccattaaaagggggttacggactctgatcctcgcaccaacccgagtggtagctgccgagatggaagaggctttgagaggactgcctattcgctaccagacacccgcaatcagggccgagcataccggtcgtgaaatagtggacctcatgtgtcacgccactttcaccatgcggctgctttccccaattagagttcctaactataatctgatcatcatggatgaggctcactttacagaccccgcgagtattgcagccaggggctacatctctacgcgcgtcgaaatgggggaggctgccggaattttcatgactgcaaccccaccgggcagccgagacccttttccccagtccaacgccccaataatggatgaggaaagagagatccccgaacggtcatggaactctggtcatgagtgggtgacagacttcaaggggaagaccgtgtggtttgtccctagcattaaagctggaaacgatatcgcggcctgcttgaggaagaatggcaaaaaggtaatccaactaagtcgcaaaactttcgactccgaatatattaagacacgtaccaacgattgggactttgtggttacgactgatataagcgagatgggcgcaaatttcaaggctgagagagtgatcgacccacggaggtgtatgaaacccgtcattctgacagatggggaagaacgcgtgatcctcgccggacctatgccggttacccactcttcagcagcccagcgaagaggtcgggtgggcaggaacccaaagaatgaaaacgaccagtacatttacatgggggagcccttagaaaatgatgaggactgcgctcattggaaagaggccaagatgctgcttgacaacatcaatacccctgaaggaataatcccctccatgtttgagccagaacgcgagaaagtcgatgcgattgacggcgaatatagactgaggggtgaggcacggaagactttcgtggatctcatgcgtcgcggggacttgcctgtatggctggcctaccgagtggctgccgagggcatcaactatgctgatagaaggtggtgttttgacggagttaaaaacaatcaaattctcgaagagaacgtcgaagtggagatctggacaaaggagggcgaacggaagaaactgaagccccgctggcttgatgcaagaatatacagtgacccactagccctgaaagagttcaaggagttcgctgccgggagaaagagcttgaccttaaatctgattacagagatgggacggctccctacttttatgacgcagaaggcacgaaacgcgctggataatcttgccgtgctgcacaccgctgaagccggtggcagagcatataaccacgctctctcggagttgccggagacactggaaactctactgctccttaccctgttagccacagtcaccgggggaatcttcttgtttctgatgtctggcaagggtattgggaaaatgactctcggcatgtgctgcatcataacggcatccatcctgctttggtacgcccagattcagccccattggatcgctgcgagcattatcctggagttctttctcatagttttgctgattccagaacctgagaagcaacgcacaccccaggacaatcagttaacatatgtggtaatcgccatcctaactgtggtcgcagctaccatggccaacgaaatgggattcctggagaaaacaaagaaagattttggcctcgggtcaattgccacccagcaaccagagagtaatatccttgacatagatctgaggcctgcatctgcttggactttgtacgccgtggcgacaacgttcattacccccatgctgcggcactccatcgaaaacagctcagttaatgtgagtctcactgctattgccaaccaggcaacagtcctgatgggacttggtaagggctggccgctcagcaagatggacatcggggtaccactgttggccataggatgttactcccaggtgaatcctatcaccctgaccgctgcattactactgctcgttgcccattatgcgattatcggccccggtcttcaggctaaagccacacgtgaggcacaaaagagagccgctgccgggattatgaaaaacccaactgtggacggcatcacggtcattgatctggaccccatcccttacgatccgaagtttgaaaaacagttgggacaggtgatgctgctcgtcctgtgcgtgacccaggttcttatgatgaggacaacttgggcattatgtgaggctctgaccctcgccacaggccccatatctaccttgtgggaagggaatccaggacgcttctggaacactacgattgcggtgagcatggccaatatctttcggggctcctatctggctggtgcagggctactgttctcaatcatgaagaacacagccaacacccgaagaggaactggcaataccggtgagacactcggcgagaagtggaaaaacaggcttaatgcactggggaagtctgaatttcaaatttacaaaaagagtggaatacaggaggtagaccgcactttggctaaagaaggcatcaagagaggggaaaccgatcaccatgccgtgtcgagaggaagcgccaaactgcgttggttcgtcgagaggaacctcgttacacctgaaggcaaggtggtcgacctgggttgcgggcggggaggctggtcctattactgtggtggcttaaagaatgtgaaagaggtaaaggggcttacgaaaggaggccccgggcacgaggaacctattccaatgtctacctatggatggaacctggtgcgcctccagtcaggcgttgatgtgttctttactccccctgaaaagtgcgacacactactgtgtgatatcggtgagagctccccaaatcccaccgtcgaggcggggcgaactttgagagtgctgaacctcgtcgaaaattggcttaacaataacacacaattctgcattaaagtgctgaatccgtacatgcctagtgttatcgagaagatggaggctttgcagaggaagtacggaggcgcactggtacggaacccactctctcgcaatagcacccacgagatgtattgggtgtcaaacgcctccggcaacatagtcagtagcgtgaatatgatctctagaatgttaattaacaggtttacgatgcgacataaaaaggctacctacgaacccgacgttgatctggggtccggaacacggaatatcggtattgagtcagagactcctaaccttgacatcataggcaaacgtattgaaaagatcaaacaggagcacgaaaccagctggcattatgatcaggaccacccatacaagacatgggcctatcacgggtcgtacgagactaagcaaaccggatctgcaagttccatggtgaatggcgtcgtgagactgctaacaaaaccctgggacatcattccgatggtaacccagatggccatgactgatacgacacctttcggtcagcagcgcgtgtttaaggaaaaagttgacaccaggactcaagagcccaaggaggggaccaaaaagctcatgaagataacagctgaatggctgtggaaagagttgggaaagaaaaagacgccacggatgtgtaccagagaagagttcactcgcaaagtcaggagcaacgcggccctgggcgcaatctttacagatgagaataagtggaaatcagctcgagaagccgtggaggactccggcttctgggaactcgtggataaggagcggaaccttcatctggaagggaagtgcgagacctgtgtctataatatgatgggaaaaagagagaagaaattaggtgaatttggcaaggcaaaagggtctagggccatttggtacatgtggctgggagctcgcttcttggagtttgaagccctcggcttcctgaacgaggaccactggtttagccgtgaaaatagtctatccggtgttgagggggagggacttcataagctgggctacatcctccgggatgtgagcaagaaagaaggcggggcgatgtatgcagacgatactgccggatgggacacaagaattaccctggaggatttgaagaacgaagagatggtaacaaatcacatggaaggtgagcataaaaagctggctgaggccatcttcaaactcacttaccagaacaaggtggtcagggtgcagcgccctacaccccgaggcacggttatggacataatctctcggagagaccagagggggtcaggacaagtggtcacctatggccttaatacattcactaacatggaagcacagctgattcgccagatggagggtgaaggggtgtttaagagtatccaacacttaaccgtaacagaggagattgctgttaaaaactggctggtgagagtcggacgggaaaggttgtcccgtatggccatcagcggcgatgactgcgtggtgaagccactcgatgaccgattcgcttctgccctgactgcactaaatgatatgggcaaagtccgcaaggacattcagcagtgggagccctcgagagggtggaacgattggacccaggttcctttttgctcacaccatttccacgaacttataatgaaagacggacgggtgctggtagtgccatgtaggaatcaagatgagctcatcggtcgcgcgagaattagccagggcgccgggtggtccctgcgggaaacggcttgcttgggaaagagttacgcccagatgtggtctttaatgtattttcataggcgagacctgcgtctcgcagctaacgccatctgtagcgcagtcccgtcccactgggtgcccacatcaagaaccacttggagtatccacgccacacatgagtggatgaccactgaggatatgcttaccgtttggaatcgcgtgtggattcaggaaaacccttggatggaggacaagacaccagtcgaatcttgggaggaaataccctacctgggcaaacgggaggatcaatggtgcggtagcctaatcgggctgacgtccagggcgacctgggctaagaatattcagactgccatcaaccaggtgagatcactcattggaaatgaggaatatacagactacatgcctagcatgaaacgcttccggagggaggaagaggaagcaggcgtattgtggtga

SEQ ID NO: 15069 - RNA, 9876 nt, synthetic construct
  misc_feature 1..9876: note = derived and/or modified CDS sequence (opt3) from DENV-2__AF169678__SS-prME
  source 1..9876: mol_type = other RNA
agcgcaggcatgataattatgctgatacccaccgtgatggctttccacctcaccactagaaacggggaacctcatatgatcgtatccattcaggaaaagggaaaatctcttctgtttaagacggaggacggtgttaatatgtgcaccttgatggcaatggatttaggcgaactgtgtgaggacacaatcacttacaaatgcccattactcagacaaaacgaaccggaggatattgactgttggtgcaattcaaccagtacatgggtgacctatgggacttgtacaaccacgggagagcaccggcgcgaaaagcgaagcgtagccctggtgccccatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaagaacaggacaagcgctttgtttgcaagcattccatggtggatcgaggatggggcaatggttgtgggctattcggaaaaggcggcatcgtcacttgcgccatgtttacctgcaagaaaaacatggaagggaagattgtgcagcctgagaatctcgaatacacaatagtggtcaccccacactcaggagaggagcatgctgttggtaacgacactggcaaacacgggaaggaaatcaaagtgacgccgcagagtagcattacagaggccgaactgaccggatatggcactgtaaccatggagtgttctcccagaacaggtcttgatttcaatgaaatggtgctgttgcaaatggagaacaaggcatggctcgtccacaggcagtggtttctggacttacctctgccatggctccccggggctgatacccagggctccaattggatccagaaggagactcttgtgacattcaaaaaccctcatgccaagaaacaagacgttgtggtcctgggatcacaggaaggcgcgatgcacacggccttgaccggggcaactgagatacagatgagcagtggaaatctactgtttacaggtcatctcaagtgccggctgcgtatggacaaacttcaactgaagggcatgtcttactccatgtgtaccgggaagttcaaagtggtaaaggaaattgctgagacacagcacggaactatcgttatccgcgtgcagtatgagggcgatggtagcccatgcaaaattcccttcgaaatcatggacttggagaagagatacgtcctcgggaggctgattaccgtgaacccgatagtcacggaaaaagattcgcctgtgaacatcgaggccgaacccccatttggcgactcttacattatcatcggagttgagcctggccagttaaagctgaattggttcaagaaagggtcctcaattggacaaatgtttgagaccacaatgcggggtgctaagcgaatggccatactaggcgatactgcatgggacttcgggagtctcggaggcgtgtttaccagcatcggtaaagccctgcatcaggtattcggggctatttatggcgcggcattttccggagtctcttggacaatgaagatccttattggcgtgatcataacttggatcgggatgaacagccgctcaaccagtttgtccgttagcctggtgctcgtcggaattgtgacgctgtaccttggcgtaatggtgcaggccgattctggttgtgttgtctcatggaaaaataaggaactgaagtgcgggagtggaatcttcattacagacaacgtgcacacctggactgagcagtataaatttcaacccgaaagcccatccaagttggcttctgccatccagaaagcacaggaggaaggcatatgtggtattagatcggtgacaaggctcgagaatctgatgtggaagcagatcacccccgagttaaaccacattctggccgaaaatgaggtcaaactaactatcatgaccggcgatataaaggggatcatgcaagctggaaaacggagcctccgccctcagccaacagaactgaagtactcctggaagacgtggggcaaagccaagatgctttcaaccgagagtcataaccagactttcttgattgacgggccggaaacagcagagtgccccaataccaacagagcgtggaactctctggaggttgaagattatggatttggcgtgttcacaactaacatctggctcaaactgaaggagaaacaggacgctttttgtgacagcaagttaatgtccgccgcaattaaggataatagggccgtgcacgctgacatgggttactggatcgaatcagccctgaacgatacctggaaaatagagaaggccagcttcattgaggtcaagaattgccattggcctaagtctcacacgctttggtccaacggggtcttggaaagtgagatgatcatccccaagaatctcgctggacccgtgagccaacacaattatcgtcctggctaccatacacagattgccggtccatggcacctgggcaagctagaaatggacttcgatttttgtgacgggaccactgttgtggtcaccgaggattgcggaaaccggggcccctctctgcgaacaactaccgcgtccgggaagctcatcacagaatggtgctgtagatcatgcacgctgccgcctcttaggtaccgcggagaggacggctgttggtatggtatggagattcggccattgaaagaaaaggaggaaaatctggtgaacagtttagttaccgccgggcatggacaggtggataatttcagcctcggcgtactgggtatggctctttttctggaggaaatgttgagaactagggtcggcacaaaacacgcaatactcctggtggccgtgtcgttcgtcaccctaatcactgggaacatgtcctttaaggacctgggacgcgttgtggtaatggtgggcgctacaatgaccgatgacattgggatgggagtcacgtacctcgccctgcttgcagcgttcaaagtgcgacccacttttgccgctggcttgctgttacggaagctcacctctaaggagctgatgatgacaaccatcggtattgttcttctgagccaatcaactatccctgagacaatactagaactcaccgatgccctggcattggggatgatggtgctgaaaatcgtccgtaatatggagaagtatcagttagctgtgacaattatggccatcctctgcgttcccaacgcagtgattctgcagaatgcctggaaagtcagttgtactatccttgctgtagtgtccgtttctccactgatattgaccagctcccagcaaaagacggactggattcctctcgcgctgacaatcaaaggactaaaccccaccgccatcttcctgactaccctttcaagaacaaataagaaaaggagctggccactcaacgaagcaattatggctgtgggcatggtcagtatactggcctcttccttgctgaagaatgacatcccgatgactggccctttagtggccgggggactcctgaccgtatgctacgtgcttacgggtcgcagcgctgatctggagttggaacgggcagccgacgtcaagtgggaggatcaggcggagatttcgggctcatctcccatcctcagtattacaatctccgaagacgggagcatgtctatcaaaaatgaggaagaggagcagaccctgactatcctaattagaacaggactgcttgttatcagcggcctctttccagtgtccattcccatcaccgctgccgcatggtatctgtgggaagtgaagaaacagagggccggtgtcttgtgggatgtgccttcaccaccccctatggggaaggctgagttagaagacggagcataccgaataaaacaaaagggcattctgggctatagtcagatcggggccggagtttacaaggagggtactttccatacaatgtggcacgtaacccgcggcgcggtgctcatgcacaaagggaagcggatcgaaccgagctgggctgatgtcaaaaaggacctgatttcttacggaggcggttggaaacttgagggggagtggaaggaaggagaggaagtgcaggttctggccttggagccaggcaagaatcccagagcagtgcagacgaaacctggcctatttaagactaacaccgggacaatcggagccgtctccctggatttctcaccaggtaccagtggcagccccataattgacaaaaaggggaaagtggtaggactctatggcaacggtgtcgtgacaaggtccggggcttacgtttctgccatcgcacaaactgaaaagtcgattgaggataatcctgagatcgaagacgatatatttcgtaagaaacgcctgaccattatggaccttcatccgggagctggcaagacgaaacggtatttacccgccatcgtgagagaggcgatcaagaggggcctgcgaacactcattttggccccaactcgggtcgtggcagctgaaatggaggaagccctgcgcgggctccctatcagataccagacccccgctattagggcagagcacacaggacgggagatagttgacctgatgtgtcatgccaccttcactatgcgacttctgagcccagtgagagtccctaactataatttgatcattatggatgaagcccacttcaccgaccccgcttcaatcgcggcacgcggttacatctccacaagggtggagatgggcgaagccgctgggatttttatgacggccactccaccgggaagtcgtgatcctttcccccagtctaacgcaccaataatcgacgaggagcgggaaattcccgagagaagctggaactccggccatgaatgggtaaccgattttaaaggtaagacagtgtggttcgttccttcaatcaaggccgggaacgacattgctgcgtgcctaaggaaaaatggaaagaaagtcatccaactgtctcgcaagacctttgatagcgagtatgtgaaaactcgaacaaacgactgggatttcgtggtcaccacggacataagtgaaatgggcgccaattttaaggcagagagagtaatcgatccacggaggtgtatgaaacccgtgattctcactgacggcgaggaacgcgttatcttagctgggcctatgccggtgacacactccagcgccgcacagcgtagaggacggattggtaggaacccaaagaatgagaacgaccagtacatctacatgggcgaacccctggagaatgatgaagactgcgcccactggaaggaggctaaaatgcttctggataacataaatacccctgaggggattatcccctctatgttcgaaccagagcgcgaaaaggtcgacgccattgatggagagtatcgactcagaggcgaagcgcggaaaacctttgtggacttgatgaggcgcggtgatctgcctgtttggctcgcatacaaggtggccgctgaggggatcaactatgccgacagaaggtggtgtttcgatggcatacagaacaatcaaatcctggaggaaaacgtcgaggtggaaatttggactaaagagggagagcggaagaaacttaaaccccgttggctagacgctcgcatctactcagatccactggcattgaaggaatttaaagagttcgccgctggccgaaagtccttaacactgaatctcattaccgaaatggggagactgcctacattcatgactcagaaagccagggacgcacttgataacctggcggtactccatacggccgaggctggaggtcgggcctataatcacgcattgagtgaactgccggagaccctagagacactgctccttctgactttattggctaccgtgacaggcgggatctttctgttcctcatgagcggacgcggcataggtaagatgaccctggggatgtgctgcattatcactgcctcgatccttctgtggtacgcacagattcagccccattggatcgccgcttctataattctcgaatttttcttgatcgttctgttaattccagagcctgaaaagcaaagaacgccccaggacaaccagctaacctatgtcgtgatcgcgatactgacagtggtcgccgcaactatggctaatgagatgggctttctcgagaaaaccaagaaagaccttggattcggctccatcgccacacagcaaccagagagcaacattctggatatcgacttgaggcctgcctcagcatggaccctgtacgctgttgccactacatttgtgacgcccatgctccggcacagtattgaaaattcttccgtaaacgtgagcctgaccgcgatcgctaatcaggccactgtccttatggggctcggaaagggttggccgctgtcaaaaatggatattggcgtgccattgctggcaatcgggtgttacagtcaggttaaccctataacattaaccgccgctctactgctccttgtggcacactatgccattatcggacccggcctgcaggcgaaggctacccgagaagcccaaaagagagcagccgctggtatcatgaaaaatccaacagtcgacgggattactgtaatagatttggaccccatcccttacgatccgaagttcgagaaacagctgggccaggtgatgctcctggttctttgcgtgacgcaagtcttaatgatgcgcaccacatgggccctgtgtgaagcactcactttggctaccggacccattagcacactgtgggagggcaacccagggaggttttggaataccactatcgccgtgtccatggcgaacattttccggggatcttatctagccggcgcaggtctgctctttagcatcatgaagaatacgacaaacacccgtagagggactggaaacataggcgaaacccttggtgagaaatggaagtccaggctgaatgctttgggcaaatcagagttccagatctacaagaagtctgggattcaggaagtcgaccgcacactggccaaagagggaatcaagcggggcgaaactgatcatcacgcagtgagtcgagggtcggctaaactcagatggtttgttgagaggaacatgattacccctgagggaaaggtggtagacctgggctgcggtcgcgggggatggagctattactgtggcggtcttaaaaatgtgcgggaagtcaagggcctaacaaaagggggacccggccatgaggaacctatcccaatgtccacgtatgggtggaacctggttagactccagtctggagtggatgtcttcttcacaccacctgagaaatgcgacactctactgtgtgatataggcgaatcaagcccaaatcccacagtggaggccggtcgtaccttgagggtactgaacctcgtggagaattggcttaacaataacactcaattttgcattaaggttctgaatccgtacatgccttccgtgatcgagaaaatggaggccttgcagcggaagtacgggggagcgctggtccgcaacccactcagtcgaaattctacacacgaaatgtattgggtgagcaacgcttcaggcaatatcgtctccagtgtgaacatgattagcagaatgttaataaacaggttcaccatgaaacataagaaggcaacgtacgagcccgacgttgacctgggctctgggacccggaatatcggaattgaatccgaggtacctaaccttgatatcattggtaaacgcatcgagaagataaaacaggaacacgagacatcatggcactatgaccaggatcatccatacaagacttgggcctatcacggcagctacgaaaccaaacaaacagggtcggcttctagtatggtgaatggagtcgtgagactgctaactaagccctgggacgttctcccgaccgtgacacagatggccatgaccgatactacgccttttggccagcagagggtcttcaaggagaaagtggacacacgaacccaagaacccaaggagggtactaaaaagctgatgaaaatcaccgcagagtggttgtggaaggaactggggaaaaagaagacaccacggatgtgtacgcgtgaggaatttaccagaaaagtacgctccaacgccgctctcggagcgattttcactgatgagaataagtggaaaagcgccagggaggcagtggaagactcacggttttgggagcttgttgataaggaaagaaacctgcatttagagggcaaatgcgaaacatgtgtctataatatgatgggcaagcgcgagaagaaactgggggagttcggaaaggctaaaggttccagggccatctggtacatgtggttgggcgcacgatttctcgagttcgaggccctggggtttctaaacgaagaccactggttctctcgggagaatagccttagtggagtggaaggcgagggtctgcacaagctcgggtacattctgagagatgtgtccaaaaaggagggaggcgctatgtatgccgacgacaccgcgggctgggatactaggatcacattggaagacctgaagaacgaggaaatggtcaccaatcatatggagggggaacacaaaaagctcgcagaggccatttttaaacttacataccagaacaaggttgtgcgcgtacagcgtcctactccccggggaaccgtgatggatataatcagcagaagggaccaacgcggttctggccaggtcgggacgtatggactgaataccttcacaaacatggaggctcagttaattcgacagatggaaggcgagggtgtgttcaaaaatatccaacatctgactgccaccgaagagatcgcagttcagaactggttggctcgggtggggagagagaggctctcacgcatggccattagtggagatgactgcgtcgtgaagccactggatgacagatttgcttccgccctaacagcacttaacgatatgggcaaggtacggaaagacatacagcagtgggaacccagcaggggctggaatgattggactcaagttcctttctgctctcaccattttcacgagctgatcatgaaggacgggcgtgtgctcgtcgtgccatgtcgaaaccaggatgaactgattggacgcgcgagaatctcgcagggtgccggctggtcattgcgggagaccgcttgcttagggaaaagctacgcccagatgtggtccctgatgtatttccacaggcgcgacctcagacttgcagctaatgccatttgtagtgcagtgccgtctcattgggtccccacgagccggacaacctggtccatccacgccaagcatgaatggatgactacagaggacatgctgaccgtttggaacagggtgtggatacaagagaatccttggatggaagataaaactccagtagagtcatgggaagagatcccctacctaggaaagcgagaagaccagtggtgcggcagtctgattggtctcacctctcgtgcgacatgggctaagaacatccaggccgcaattaatcaggtgaggagcttgatcgggaacgaggagtatacggattacatgccttccatgaaacgctttcggagggaagaggaagaggccggagtcctgtggtga

SEQ ID NO: 15070 - RNA, 9876 nt, synthetic construct
  misc_feature 1..9876: note = derived and/or modified CDS sequence (opt3) from DENV-2__AF169679__SS-prME
  source 1..9876: mol_type = other RNA
agcgccggcatgatcattatgctgatacccaccgtgatggctttccacctcacaactagaaacggggagcctcatatgatcgtctccattcaggaaaagggaaaatctcttctgtttaagacggaggacggtgttaatatgtgcaccttgatggcaatggatttaggcgaactgtgtgaggacacaatcacttacaaatgcccactactcaggcaaaacgaaccggaggatattgactgttggtgcaattcaaccagtacatgggtgacctatgggacttgtacaaccacgggagagcaccggcgcgaaaagcgaagcgtagccctggtgccccatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaagagcaggacaagcgctttgtttgcaagcattccatggtggatcgaggatggggcaatggttgtgggctattcggaaaaggcggcatcgtcacttgcgccatgtttacctgcaagaaaaacatggaagggaagattgtgcagcctgagaatctcgaatacacaatagtggtcaccccacactcaggagaggagcatgctgttggtaacgacactggcaaacacgggaaggaaatcaaagtgacgccgcagagtagcattacagaggccgaactgaccggatatggcactgtaaccatggagtgttctcccagaacaggtcttgatttcaatgaaatggtgctgttgcaaatggagaacaaggcatggctcgtccacaggcagtggtttctggacttacctctgccatggctccccggggctgatacccagggctccaattggatccagaaggagactcttgtgacattcaaaaaccctcatgccaagaaacaagacgttgtggtcctgggatcacaggaaggcgcgatgcacacggccttgaccggggcaactgagatacagatgagcagtggaaatctactgtttacaggtcatctcaagtgccggctgcgtatggacaaacttcaactgaagggcatgtcttactccatgtgtaccgggaagttcaaagtggtaaaggaaattgctgagacacagcacggaactatcgttatccgcgtgcagtatgagggcgatggtagcccatgcaaaattcccttcgaaatcatggacttggagaagagatacgtcctcgggaggctgattaccgtgaacccgatagtcacggaaaaagattcgcctgtgaacatcgaggccgaacccccatttggcgactcttacattatcatcggagttgagcctggccagttaaagctgaattggttcaagaaagggtcctcaattggacaaatgtttgagaccacaatgcggggtgctaagcgaatggccatactaggcgatactgcatgggacttcgggagtctcggaggcgtgtttaccagcatcggtaaagccctgcatcaggtattcggggctatttatggcgcggcattttccggagtctcttggacaatgaagatccttattggcgtgatcataacttggatcgggatgaacagccgctcaaccagtttgtccgttagcctggtgctcgtcggaattgtgacgctgtaccttggcgtaatggtgcaggccgattctggttgtgttgtctcatggaaaaataaggaactgaagtgcgggagtggaatcttcattacagacaacgtgcacacctggactgagcagtataaatttcaacccgaaagcccatccaagttggcttctgccatccagaaagcacaggaggaaggcatatgtggtattagatcggtgacaaggctcgagaatctgatgtggaagcagatcacccccgagttaaaccacattctggccgaaaatgaggtcaaactaactatcatgaccggcgatataaaggggatcatgcaagctggaaaacggagcctccgccctcagccaacagaactgaagtactcctggaagacgtggggcaaagccaagatgctttcaaccgagagtcataaccagactttcttgattgacgggccgaaaacagcagaatgccccaataccaacagagcgtggaattctctggaggttgaggattatggatttggcgtgttcacaactaacatctggctcaagctgaaagaaaagcaggacgctttttgtgacagcaagttaatgtccgccgcaattaaagataatagggccgtgcacgctgacatgggttactggatcgagtcagccctgaacgatacctggaagatagaaaaagcaagcttcattgaggtaaagaattgccattggcctaaatctcacacgctttggtccaacggggtcttggagagtgaaatgatcatcccaaagaacctcgctggacccgtgagccaacacaattatcgtcctggctaccatacacagattgccggtccatggcacctgggcaagctagagatggacttcgatttttgtgacgggaccactgttgtggtcaccgaagattgcggaaaccggggcccctctctgcgaacaactaccgcgtccgggaaactcatcacagagtggtgctgtagatcatgcacgctgccgcctcttaggtaccgcggagaagacggctgttggtatggtatggagattcggccattgaaggagaaagaagagaatctggtgaacagtttagttaccgccgggcatggacaggtggataatttcagcctcggcgtactgggtatggctctttttctggaagagatgttgagaactagggtcggcacaaagcacgcaatactcctggtggccgtgtcgttcgtcaccctaatcactgggaacatgtcctttaaagacctgggacgcgttgtggtaatggtgggcgctacaatgaccgatgacattgggatgggagtcacgtacctcgccctgcttgcagcgttcaaggtgcgacccacttttgccgctggcttgctgttacggaagctcacctctaaagaactgatgatgacaaccatcggtattgttcttctgagccaatcaactatccctgagacaatactagagctcaccgatgccctggcattggggatgatggtgctgaagatcgtccgtaatatggaaaaatatcagttagctgtgacaattatggccatcctctgcgttcccaacgcagtgattctgcagaatgcctggaaggtcagttgtactatccttgctgtagtgtccgtttctccactgatattgaccagctcccagcaaaaaacggactggattcctctcgcgctgacaatcaagggactaaaccccaccgccatcttcctgactaccctttcaagaacaaataaaaagaggagctggccactcaacgaggcaattatggctgtgggcatggtcagtatactggcctcttccttgctgaagaatgacatcccgatgactggccctttagtggccgggggactcctgaccgtatgctacgtgcttacgggtcgcagcgctgatctggaattggagcgggcagccgacgtcaaatgggaagatcaggcggagatttcgggctcatctcccatcctcagtattacaatctccgaggacgggagcatgtctataaagaacgaagaggaagagcagaccctgactatcctaattagaacaggactgcttgttatcagcggcctctttccagtgtccattcccatcaccgctgccgcatggtatctgtgggaggtgaaaaagcagagggccggtgtcttgtgggatgtgccttcaccaccccctatggggaaagctgaattagaggacggagcataccgaataaagcaaaagggcattctgggctatagtcagatcggggccggagtttacaaagaaggtactttccatacaatgtggcacgtaacccgcggcgcggtgctcatgcacaaggggaaacggatcgagccgagctgggctgatgtcaagaaagacctgatttcttacggaggcggttggaagcttgaaggggagtggaaggagggagaagaggtgcaggttctggccttggaaccaggcaaaaatcccagagcagtgcagacgaagcctggcctatttaaaactaacaccgggacaatcggagccgtctccctggatttctcaccaggtaccagtggcagccccataattgacaagaaagggaaggtggtaggactctatggcaacggtgtcgtgacaaggtccggggcttacgtttctgccatcgcacaaactgagaagtcgattgaagataatcctgagatcgaggacgatatatttcgtaaacgccggctgaccattatggaccttcatccgggagctggcaagacgaaaagatatttacccgccatcgtgagggaagcgatcaagcgaggcctgcggacactcattttggccccaactcgcgtcgtggcagctgagatggaagaggccctgagagggctccctatcaggtaccagacccccgctattcgggcagaacacacaggacgagagatagttgacctgatgtgtcatgccaccttcactatgagacttctgagcccagtgcgcgtccctaactataatttgatcattatggatgaggcccacttcaccgaccccgcttcaatcgcggcaaggggttacatctccacacgtgtggaaatgggcgaggccgctgggatttttatgacggccactccaccgggaagtcgggatcctttcccccagtctaacgcaccaataatggacgaagagagagagatccccgaaaggagctggaattccggccatgagtgggtaaccgattttaaaggtaagacagtgtggttcgttccttcaattaaggccgggaacgacatcgctgcgtgcctacgcaaaaatggaaagaaagtcattcaactgtctcgaaagacctttgatagcgaatatgtgaaaactagaacaaacgactgggatttcgtggtcaccacggacatcagtgagatgggcgccaattttaaggcagaacgggtaatagatccaaggcgctgtatgaaacccgtgatcctcactgacggcgaggagcgtgttattttagctgggcctatgccggtgacacactccagcgccgcacagagacggggaaggatcggtcgcaacccaaagaatgaaaacgaccagtacatttacatgggcgagcccctggaaaatgatgaggactgcgcccactggaaggaagctaaaatgcttctggataacatcaatacccctgaggggataattccctctatgttcgagccagaacgagagaaggtcgacgccatcgatggagaatatagactccggggcgaggcgaggaaaacctttgtggacttgatgcgcagaggtgatctgcctgtttggctcgcatacaaggtggccgctgaagggattaactatgccgacaggcggtggtgtttcgatggcatccgtaacaatcagatactggaggagaacgtcgaagtggagatctggactaaagaaggagagcgcaagaagcttaaaccccgatggctagacgctagaatttactcagatccactggcattgaaggagtttaaagaattcgccgctggcaggaagtccttaacactgaatctcatcaccgagatggggcggctgcctacattcatgactcaaaaagcccgcgacgcacttgataacctggcggtactccatacggccgaagctggaggtagagcctataatcacgcattgagtgagctgccggaaaccctagagacactgctccttctgactttattggctaccgtgacaggcgggatttttctgttcctcatgagcggaaggggcatcggtaagatgaccctggggatgtgctgcataattactgcctcgatccttctgtggtacgcacagatccagccccattggattgccgcttctatcatactcgagtttttcttgattgttctgttaatcccagaacctgagaagcagcggacgccccaagacaaccagctaacctatgtcgtgattgcgatcctgacagtggtcgccgcaactatggctaatgaaatgggctttctcgagaaaaccaagaaagaccttggattcggctccatagccacacagcagccagaaagcaacatcctggatattgacttgcgacctgcctcagcatggaccctgtacgctgttgccactacatttgtgacgcccatgctcagacacagtatcgagaattcttccgtaaacgtgagcctgaccgcgattgctaatcaagccactgtccttatggggctcggaaagggttggccgctgtcaaaaatggatatcggcgtgccattgctggcaattgggtgttacagtcaggttaaccctatcacattaaccgccgctctactgctccttgtggcacactatgccataattggacccggcctgcaggcgaaggctacccgcgaggcccagaagagggcagccgctggtatcatgaaaaatccaacagtcgacgggatcactgtaattgatttggaccccataccttacgatccgaagttcgaaaaacaactgggccaggtgatgctcctggttctttgcgtgacgcaggtcttaatgatgcggaccacatgggccctgtgtgaggcactcactttggctaccggacccatcagcacactgtgggaaggcaacccagggcgtttttggaataccactattgccgtgtccatggcgaacatcttcagaggatcttatctagccggcgcaggtctgctctttagcattatgaagaatacgacaaacaccaggcgcgggactggaaacatcggcgagacccttggtgaaaaatggaagtcccggctgaatgctttgggcaaatcagagttccaaatatacaagaagtctgggatccaggaggtcgaccgaacactggccaaagaaggaattaagagaggcgagactgatcatcacgcagtgagtagggggtcggctaaactccgctggtttgttgaacggaacatgatcacccctgagggaaaggtggtagacctgggctgcggtagagggggatggagctattactgtggcggtttaaaaaatgtgcgtgaggtcaagggccttacaaaggggggacccggccatgaagagcctattccaatgtccacgtatgggtggaacctggttaggctccagtctggagtggatgtcttcttcaccccccctgaaaaatgcgacactctactgtgtgatatcggcgagtcaagcccaaatcccacagtggaagccggtcggaccttgcgcgtactgaacctcgtggagaattggcttaacaataacactcagttttgcataaaggttctgaatccgtacatgccttccgtgattgagaaaatggaagccttgcaacgaaagtacgggggagcgctggtcagaaacccactcagtaggaattctacacacgagatgtattgggtgagcaacgcttcaggcaatatcgtctccagtgtgaacatgatcagccggatgttaattaaccgcttcaccatgaaacataagaaggcaacgtacgaacccgacgttgacctgggctctgggaccagaaatataggaatcgagtccgaagtacctaaccttgatattatcggtaaaaggattgagaagatcaaacaggagcacgaaacatcatggcactatgaccaggatcatccatacaagacttgggcctatcacggcagctacgagaccaaacagacagggtcggcttctagtatggtgaatggagtcgtgcgactgctaactaagccctgggacgttctcccgaccgtgacacaaatggccatgaccgatactacgccttttggccagcagcgggtcttcaaggaaaaagtggacacacgtacccaggagcccaaggaaggtactaaaaagctgatgaaaataaccgcagagtggttgtggaaggagctggggaaaaagaagacaccaagaatgtgtacgcgcgaagagtttaccaggaaagtacggtccaacgccgctctcggagcgatcttcactgatgaaaataagtggaaaagcgccagagaggcagtggaggactcacgcttttgggaacttgttgataaggagaggaacctgcatttagaaggcaaatgcgagacatgtgtctataatatgatgggcaagcgagaaaagaaactgggggagttcggaaaggctaaaggttcccgggccatttggtacatgtggttgggcgcaagatttctcgagttcgaagccctggggtttctaaacgaggaccactggttctctagggaaaatagccttagtggagtggagggcgaaggtctgcacaagctcgggtacatcctgcgcgatgtgtccaaaaaggagggaggcgctatgtatgccgacgacaccgcgggctgggatactcgtattacattggaggacctgaagaacgaagagatggtcaccaatcatatggaaggggagcacaaaaagctcgcagaagccatctttaaacttacataccaaaacaaggttgtgcgggtacagagacctactcccaggggaaccgtgatggatattataagccgccgagaccagcggggttctggccaagtcgggacgtatggactgaataccttcacaaacatggaggctcagttaatcagacagatggagggcgaaggtgtgttcaaaaatattcagcatctgactgccaccgaggaaatcgcagttcaaaactggttggctagggtggggcgcgagagactctcacggatggccatcagtggagatgactgcgtcgtgaagccactggatgacaggtttgcttccgccctaacagcacttaacgatatgggcaaggtacgtaaagacattcagcagtgggagcccagccgaggctggaatgattggactcaggttcctttctgctctcaccattttcacgaactgataatgaaggacgggcgcgtgctcgtcgtgccatgtagaaaccaagatgagctgatcggacgggcgaggatttcgcagggtgccggctggtcattgcgcgaaaccgcttgcttagggaaaagctacgcccagatgtggtccctgatgtatttccacagacgggacctcaggcttgcagctaatgccatctgtagtgcagtgccgtctcattgggtccccacgagccgaacaacctggtccattcacgccaagcatgagtggatgactacagaagacatgctgaccgtttggaaccgtgtgtggatccaggagaatccttggatggaggataaaactccagtagaatcatgggaggaaataccctacctaggaaagagagaggaccaatggtgcggcagtctgatcggtctcacctctcgcgcgacatgggctaagaacattcaggccgcaatcaatcaggtgcggagcttgattgggaacgaagagtatacggattacatgccttccatgaaaaggtttagacgcgaggaagaggaagccggagtcctgtggtga

SEQ ID NO: 15071 - RNA, 9876 nt, synthetic construct
  misc_feature 1..9876: note = derived and/or modified CDS sequence (opt3) from DENV-2__AF169680__SS-prME
  source 1..9876: mol_type = other RNA
agcgccggcatgatcattatgctgatacccaccgtgatggctttccacctcacaactagaaacggggagcctcatatgatcgtctccattcaggaaaagggaaaatctcttctgtttaagacggaggacggtgttaatatgtgcaccttgatggcaatggatttaggcgaactgtgtgaggacacaatcacttacaaatgcccactactcaggcaaaacgaaccggaggatattgactgttggtgcaattcaaccagtacatgggtgacctatgggacttgtacaaccacgggagagcaccggcgcgaaaagcgaagcgtagccctggtgccccatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaagagcaggacaagcgctttgtttgcaagcattccatggtggatcgaggatggggcaatggttgtgggctattcggaaaaggcggcatcgtcacttgcgccatgtttacctgcaagaaaaacatggaagggaagattgtgcagcctgagaatctcgaatacacaatagtggtcaccccacactcaggagaggagcatgctgttggtaacgacactggcaaacacgggaaggaaatcaaagtgacgccgcagagtagcattacagaggccgaactgaccggatatggcactgtaaccatggagtgttctcccagaacaggtcttgatttcaatgaaatggtgctgttgcaaatggagaacaaggcatggctcgtccacaggcagtggtttctggacttacctctgccatggctccccggggctgatacccagggctccaattggatccagaaggagactcttgtgacattcaaaaaccctcatgccaagaaacaagacgttgtggtcctgggatcacaggaaggcgcgatgcacacggccttgaccggggcaactgagatacagatgagcagtggaaatctactgtttacaggtcatctcaagtgccggctgcgtatggacaaacttcaactgaagggcatgtcttactccatgtgtaccgggaagttcaaagtggtaaaggaaattgctgagacacagcacggaactatcgttatccgcgtgcagtatgagggcgatggtagcccatgcattatccccttcgaaattatggacttggagaaaagatacgtcctcgggaggctgataaccgtgaacccgatcgtcacggaaaaggattcgcctgtgaacattgaggccgaacccccatttggcgactcttacatcatcattggagttgagcctggccagttaaaactgaattggttcaagaaggggtcctcaataggacaaatgtttgagaccacaatgcggggtgctaaacgaatggccatcctaggcgatactgcatgggacttcgggagtctcggaggcgtgtttaccagcattggtaaggccctgcatcaggtattcggggctatctatggcgcggcattttccggagtctcttggacaatgaaaattcttatcggcgtgataatcacttggattgggatgaacagccgctcaaccagtttgtccgttagcctggtgctcgtcggaatcgtgacgctgtaccttggcgtaatggtgcaggccgattctggttgtgttgtctcatggaagaataaagaactgaagtgcgggagtggaattttcatcacagacaacgtgcacacctggactgagcagtataagtttcaacccgaaagcccatccaaattggcttctgccatacagaaggcacaggaggaaggcatttgtggtatcagatcggtgacaaggctcgagaatctgatgtggaaacagattacccccgagttaaaccacatcctggccgaaaatgaggtcaagctaactataatgaccggcgatatcaaagggattatgcaagctggaaagcggagcctccgccctcagccaacagaactgaaatactcctggaagacgtggggcaaggccaaaatgctttcaaccgagagtcataaccagaatttcttgatcgacgggccggaaactgcagagtgccccaacacaaatagagcgtggaactctctggaggttgaagattatggatttggcgtgttcaccacaaatgtgtggctcaagctgaaagagaagcaggacgctttttgtgacagcaaattaatgtccgccgcaattaaggataacagggccgtacacgctgacatgggttactggatcgaatcagccctgaatgatacttggaagatagagaaagcaagcttcattgaggtcaagaactgccattggcctaaatctcacaccctttggtccaacggggtgttggaaagtgagatgatcatcccaaagaatctcgctggacccgttagccaacacaactatcgtcctggctaccatacgcagattgccggtccatggcacctgggcaaactagaaatggacttcgatttttgtgacgggacaaccgtggtcgtgactgaggattgcggaaatcggggcccctctctgcgaaccacaactgcgtccgggaagctcatcaccgaatggtgctgtagatcatgcacactgccgcctcttaggtaccgcggagaggacggctgttggtatggtatggagattcggccattgaaggaaaaagaggaaaacctggttaatagtttagtgacggccgggcatggacaggtagataacttcagcctcggcgtcctgggtatggctctttttctggaggaaatgttgagaaccagggtgggcactaagcacgcaatactcctggtggccgtctcgttcgttacactaatcaccgggaatatgtcctttaaagacctgggacgcgtggtagtgatggtcggcgctactatgacagatgacattgggatgggagtgacctacctcgccctgcttgcagcgttcaaggttcgacccacgtttgccgctggcttgctgttacggaaactcacttctaaggagctgatgatgaccacaatcggtattgtgcttctgagccaatcaaccatccctgagactatactagaactcacagatgccctggcattggggatgatggtcctgaagatcgtgcgtaacatggagaaatatcagttagctgttaccattatggccatcctctgcgtgcccaatgcagtcattctgcagaacgcctggaaggtaagttgtacaatccttgctgtggtttccgtgtctccactgatattgactagctcccagcaaaaaaccgactggattcctctcgcgctgacgatcaagggactaaatcccacagccatcttcctgaccactctttcaagaaccaacaaaaagaggagctggccactcaatgaagcaattatggctgtcggcatggtgagtatactggcctcttccttgctgaaaaacgacatcccgatgacaggccctttagtagccgggggactcctgactgtgtgctacgtccttaccggtcgcagcgctgatctggagttggaacgggcaacggacgttaagtgggagagacaggccgagatttcgggctcatctcccatcctcagtattacaatctccgaagatgggagcatgtctataaagaatgaggaagaggagcagaccctgactatcctaattaggacaggactgcttgtgatcagcggcctctttccagtgtccattcccatcaccgcggctgcctggtatctgtgggaagtcaaaaagcagcgagcaggtgtgttgtgggacgttccttcaccaccccctatggggaaagccgagttagaagatggagcttaccgcataaagcaaaaaggcattctgggctatagtcagatcggggcaggagtatacaaggagggtactttccatacaatgtggcacgtgacccggggcgccgtcctcatgcacaaggggaaaagaatcgaaccgagctgggcggacgtgaagaaagatctgatttcttacggaggcggttggaagcttgagggggagtggaaagaaggagaggaagttcaggtgctggctttggagccaggcaagaaccccagggccgtccagacgaagcctggcctatttaaaactaacaccgggacaatcggagcagtgtccctggacttctcaccaggtaccagtggcagccccataattgataagaaagggaaggtagtcggactctatggcaatggtgtggttacacgttccggggcctacgtgtctgctatcgcccaaactgaaaaatcgattgaggacaaccctgagatcgaagatgacatatttcgcaagcggaagatgaccattatggatctgcatccgggagcaggcaaaacgaagagatatcttcccgctatcgtcagggaggccatcaaacgaggcttacggacactgattctcgcgccaactcgcgtggttgccgcagaaatggaggaagctttgagagggctgcctatcaggtaccagacccccgccattcgggctgagcacacaggacgagagatagtggacctcatgtgtcatgcaaccttcactatgagactgcttagcccagtccgcgtgcctaattataacctgatcattatggacgaagcccacttcaccgatcccgcctcaatcgctgcgaggggttacatctccacacgtgtagagatgggcgaagcagccgggatttttatgacggctactccaccgggaagtcgggaccctttcccccagtctaatgccccaataatcgatgaggagagagaaattcccgagaggagctggaactccggccatgaatgggtgaccgactttaagggtaaaacagtttggttcgtcccttcaatcaaggcagggaatgatattgccgcttgcttgcgcaagaacggaaaaaaggtgatccaactatctcgaaaaacctttgacagcgagtatgtgaagactagaacaaatgattgggacttcgtcgtaaccacggatataagtgaaatgggcgcgaactttaaagccgagcgggtgatcgacccaaggcgctgtatgaagcccgttattctgactgatggcgaggaacgtgtgatcctcgcagggcctatgccggtcacacactccagcgctgcccagagacggggaaggattggtcgcaatccaaaaaacgagaatgaccagtacatctacatgggcgaacccttagagaacgacgaagattgcgcacactggaaggaggccaagatgctgcttgacaatataaacacccctgaggggattatcccctctatgttcgaaccagagcgagaaaaagtggatgctattgacggagagtatagactgcggggcgaagccaggaagacctttgttgatctcatgcgcagaggtgacttgcctgtgtggctggcgtacaaagtcgcagccgaggggatcaactatgctgataggcggtggtgtttcgacggcatacgtaataaccagatcctcgaggaaaatgtggaggtagaaatttggactaaggagggagagcgcaaaaagctgaagccccgatggcttgatgccagaatctactcagacccactagctctgaaagaatttaaggagttcgcagccggcaggaaatccttgacattaaacctgattaccgaaatggggcggctccctacattcatgactcaaaaggctcgcgatgccctggacaatcttgcagtgctgcatacggcggaggccggaggtagagcttataaccacgccctcagtgaattgccggagaccctggagacactactgctccttactctgttagcaaccgttacaggcgggatctttttgttcctgatgagcggaaggggcataggtaaaatgaccctcgggatgtgctgcattatcactgcttcgatcctgctttggtacgcccagattcagccccattggatcgcagcctctataattctggaatttttcctcatcgtcttgctgattccagagcctgaaaagcagcggacgccccaagataatcagttaacctatgtggtgatcgctatactaacagtcgttgcggccactatggcaaacgagatgggctttctggaaaagaccaaaaaggacctcggattcggctccatcgctacacagcagccagagagcaatattcttgacatcgatctgcgacctgcctcagcctggaccttgtacgcagtggctactacatttgtaacgcccatgctgagacacagtattgagaactcttccgtgaatgtcagcctcaccgccatcgcgaaccaagctactgtgctgatggggcttggaaaaggttggccgctctcaaagatggacattggcgttccactgttggccatcgggtgttacagtcaggtgaatcctataacactgaccgcagccttactactgctcgtcgctcactatgcaattatcggacccggccttcaggccaaagcgacccgcgaagctcagaagagggccgcagccggtatcatgaagaacccaagcgtagatgggattacagtgatagacctggatcccatcccttacgacccgaaattcgagaagcaattgggccaggttatgctgctcgtgctgtgcgtcactcaggtgcttatgatgcggacgacctgggctttatgtgaagccctgacactcgcaactggacccatttccaccttgtgggagggcaatccagggcgtttttggaacacaaccatcgctgtctctatggccaatattttcagaggaagctatctggcgggcgccggtctactgttttccatcatgaaaaacactacgaacacaaggcgcgggaccggaaatataggcgaaactctcggtgagaagtggaaatcacggcttaacgcactgggcaagtctgagttccaaatctacaaaaagagtgggattcaggaagtggatcgaaccttggctaaggagggaatcaaaagaggcgaaacagaccatcacactgtttcgagggggagcgccaagctgcgctggtttgtggagcggaatatgattacccctgagggaaaagtactcgatctgggctgcggtagagggggatggtcctattactgtggcggtttaaagaacgtgcgtgaagtcaaaggccttacaaaggggggacccggccatgaggaacctatcccaatgtctacgtatgggtggaatctggttaggctccagtcaggagtggacgtcttcttcaccccccctgagaagtgcgatactctactgtgtgacataggcgaaagctccccaaaccccacagtggaggcaggtcggaccttgcgcgtactgaatctcgtggagaactggcttaataacaatactcagttttgcattaaagttctgaacccgtacatgcctagtgtgatcgaaaagatggaggctttgcaacgaaaatacgggggagccctggtcagaaatccactctctaggaacagcacacacgaaatgtattgggtgtcaaatgcctccggcaacatcgtcagtagcgtgaacatgatttctcggatgttaataaatcgcttcaccatgaagcataaaaaggcgacgtacgagcccgatgttgacctgggctccgggaccagaaacatcggaattgaatcagaggtacctaatcttgacatcattggtaagaggatcgagaaaataaagcaggaacacgagacaagctggcactatgatcaggaccatccatacaaaacttgggcttatcacggctcgtacgaaaccaagcagacagggtctgcaagttccatggtgaacggagtcgtgcgactgctaactaaaccctgggatgttctcccgaccgtgacacaaatggccatgaccgacactacgccttttggccagcagcgggtcttcaaggagaaggtggatacacgtacccaggaacccaaagagggtactaagaaactgatgaagatcaccgctgagtggttgtggaaagaactggggaagaaaaagacaccaagaatgtgtacgcgcgaggaatttaccaggaaggtacggagcaatgccgcactcggagccattttcactgacgagaacaaatggaagtcagctagagaggcggtggaagattcccgcttttgggagcttgttgacaaagaaaggaatctgcatttagagggcaagtgcgaaacatgtgtctataacatgatgggcaaacgagagaagaagctgggggagttcggaaaagccaagggttctcgggcaatctggtacatgtggttgggcgctagatttctcgaattcgaggccctggggtttctaaatgaagatcactggttcagcagggagaacagtctttccggagtggaaggcgagggtctgcacaaactcgggtacattctgcgcgacgtgagcaagaaagagggaggcgcaatgtatgccgatgacaccgctggctgggacactcgtatcacattggaagatctgaagaatgaggaaatggtcaccaaccatatggagggggaacacaagaaactcgccgaggcgatttttaagcttacataccaaaataaagttgtgcgggtacagagacctactcccaggggaaccgtgatggacataatctctcgccgagatcagcggggttcaggccaagtcgggacgtatggactgaacaccttcacaaatatggaggcacagttaattagacagatggaaggcgagggtgtgttcaagaacatccagcatctgactgccaccgaagagatcgctgttcaaaactggttggccagggtggggcgcgagagactcagtcggatggcaatttccggagacgattgcgtcgtgaaaccactggacgataggtttgctagcgccctaacagctcttaatgacatgggcaaggtacgtaaggatatacagcagtgggaaccctctcgaggctggaacgactggactcaggttcctttctgctcgcaccattttcacgagctgatcatgaaagatgggcgcgtgctcgtcgtgccatgtagaaatcaagacgaactgattggacgggccaggatctcacagggtgcaggctggagcttgcgcgagaccgcgtgcttagggaagtcctacgcccagatgtggagtctgatgtatttccacagacgggatctcaggcttgctgccaacgcaatttgttctgctgtgccgagccattgggtccccacgtcccgaacaacctggtcaatccacgccaaacatgaatggatgactacagaggacatgctgaccgtttggaatcgtgtgtggatacaggagaacccttggatggaagacaagactccagtagagagttgggaagagatcccctacctaggaaaaagagaagatcaatggtgcggctctctgattggtctcaccagccgcgcaacatgggccaagaatatccaggcggctattaaccaggtgcggtccttgatcgggaatgaggagtatacggactacatgccttcaatgaagaggtttagacgcgaagaggaagaggccggagtcctgtggtga

SEQ ID NO: 15072 - RNA, 9876 nt, synthetic construct
  misc_feature 1..9876: note = derived and/or modified CDS sequence (opt3) from DENV-2__AF169682__SS-prME
  source 1..9876: mol_type = other RNA
agcgcaggcatgatcattatgctgatacccaccgtgatggctttccacctcacaactagaaatggggagcctcatatgatcgtctccattcaggaaaagggaaagtctcttctgtttaagacggaggacggtgttaatatgtgcaccttgatggcaatggatttaggcgaactgtgtgaggacacaatcacttacaagtgcccactactcagacaaaatgaaccggaggatattgactgttggtgcaattcaaccagtacatgggtgacctatgggacttgtacaaccacgggagagcaccggcgcgaaaagcgaagcgtagcactggtgccccatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgttaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaggaacaagacaagcgctttgtttgcaagcattccatggtggatcgaggatggggcaatggttgtgggctattcggaaaaggcggcatcgtcacttgcgccatgtttacctgcaagaaaaacatggaagggaagattgtgcagcctgagaatctcgaatacacaatagtggtcaccccacactcaggagaggagcatgctgttggtaacgacactggcaaacacgggaaggaaatcaaagtgacgccgcagagtagcattacagaggccgaactgaccggatatggcactgtaaccatggagtgttctcccagaacaggtcttgatttcaatgaaatggtgctgttgcaaatggagaacaaggcatggctcgtccacaggcagtggtttctggacttacctctgccatggctccccggggctgatacccagggctccaattggatccagaaggagactcttgtgacattcaaaaaccctcatgccaagaaacaagacgttgtggtcctgggatcacaggaaggcgcgatgcacacggccttgaccggggcaactgagatacagatgagcagtggaaatctactgtttacaggtcatctcaagtgccggctgcgtatggacaaacttcaactgaagggcatgtcttactccatgtgtaccgggaagttcaaagtggtaaaggaaattgctgagacacagcacggaactatcgttatccgcgtgcagtatgagggcgatggtagcccatgcaggattcccttcgaaatcatggacttggagaaaaggtacgtcctcgggcggctgattaccgtgaacccgatagtcacggaaaaggattcgcctgtgaacatcgaggccgaacccccatttggcgactcttacattatcatcggagttgagcctggccagttaaaactgaattggttcaagaaggggtcctcaattggacaaatgtttgagaccacaatgcgaggtgctaaacgcatggccatactaggcgatactgcatgggacttcgggagtctcggaggcgtgtttaccagcatcggtaaggccctgcatcaggtattcggggctatttatggcgcggcattttccggagtctcttggacaatgaaaatccttattggcgtgatcataacttggatcgggatgaacagcagatcaaccagtttgtccgttagcctggtgctcgtcggaattgtgacgctgtaccttggcgtaatggtgcaggccgattctggttgtgttgtctcatggaagaataaagaactgaagtgcgggagtggaatcttcattacagacaacgtgcacacctggactgagcagtataagtttcaacccgaaagcccatccaaattggcttctgccatccagaaggcacaggaggaaggcatatgtggtattaggtcggtgacacggctcgagaatctgatgtggaaacagatcacccccgagttaaaccacattctggccgaaaatgaggtcaagctaactatcatgaccggcgatataaaagggatcatgcaagctggaaagcgcagcctcagacctcagccaacagaactgaaatactcctggaagacgtggggcaaggccaaaatgctttcaaccgagagtcataaccagactttcttgattgacgggccggaaacagcagagtgccccaataccaacagggcgtggaactctctggaggttgaagattatggatttggcgtgttcacaactaacatctggctcaagctgaaagagaagcaggacgctttttgtgacagcaaattaatgtccgccgcaattaaggataatcgtgccgtgcacgctgacatgggttactggatcgaatcagccctgaacgatacctggaagatagagaaagccagcttcattgaggtaaagaattgccattggcctaaatctcacacgctttggtccaacggggtcttggaaagtgagatgatcatcccaaagaacctcgctggacccgtgagccaacacaattatcggcctggctaccatacacagattgccggtccatggcacctgggcaaactagaaatggacttcgatttttgtgacgggaccactgttgtggtcaccgaggattgcggaaaccgaggcccctctctgagaacaactaccgcgtccgggaagctcatcacagaatggtgctgtaggtcatgcacgctgccgcctcttcgctaccggggagaggacggctgttggtatggtatggagattagaccattgaaggaaaaagaggaaaatctggtgaacagtttagttaccgccgggcatggacaggtggataatttcagcctcggcgtactgggtatggctctttttctggaggaaatgttgaggactcgcgtcggcacaaagcacgcaatactcctggtggccgtgtcgttcgtcaccctaatcactgggaacatgtcctttaaagacctgggacgagttgtggtaatggtgggcgctacaatgaccgatgacattgggatgggagtcacgtacctcgccctgcttgcagcgttcaaggtgcggcccacttttgccgctggcttgctgttacgtaaactcacctctaaggagctgatgatgacaaccatcggtattgttcttctgagccaatcaactatccctgagacaatactagaactcaccgatgccctggcattggggatgatggtgctgaagatcgtcagaaatatggagaaatatcagttagctgtgacaattatggccatcctctgcgttcccaacgcagtgattctgcagaatgcctggaaggtcagttgtactatccttgctgtagtgtccgtttctccactgatattgaccagctcccagcagaagacggactggattcctctcgcgctgacaatcaagggactaaaccccaccgccatcttcctgactaccctttcaaggacaaataaaaagcgcagctggccactcaacgaagcaattatggctgtgggcatggtcagtatactggcctcttccttgctgaaaaatgacatcccgatgactggccctttagtggccgggggactcctgaccgtatgctacgtgcttacgggtcggagcgctgatctggagttggaaagagcaacagacgtcaagtgggaggatcaggccgagatttcgggctcatctcccagtctctccatcaccattagcgaagacgggtctatgagcatcaagaacgaggaagaggagcagactctgacaatactaatcaggaccggactgcttgttatttccggcctctttccagtgtcaatccccattactgcggctgcctggtatctgtgggaagtgaaaaagcagcgagccggtgtcttgtgggatgtgcctagtccaccccctatggggaaagccgagttagaagacggagcttaccgcatcaagcaaaaaggcatactgggctatagccagattggggcaggagtttacaaggagggtacattccataccatgtggcacgtaacgcggggcgccgtgctcatgcacaaggggaaaagaatcgaaccgtcttgggcggatgtcaagaaagacctgatctcctacggaggcggttggaaacttgagggggagtggaaagaaggagaggaagtgcaggttctggctttggagccaggcaagaatcccagggccgtgcagactaagcctggcctatttaaaaccaacacagggaccattggagcagtctcactggatttcagtccaggtacaagcggctcccccatcatagacaagaaagggaaggtggtaggactctatggcaacggtgtcgtgactcgttctggggcctacgtttcggctattgcccaaaccgagaaaagcatcgaagataatcctgagattgaagacgatatctttcgcaagcggagactgacgataatggaccttcatccgggagcaggcaagacaaaaaggtatttacccgctattgtgcgagaggccatcaagcggggcctgcgcactctcatcttggcgccaaccagagtcgtggccgcagaaatggaggaagctctgagggggctccctattcggtaccagacacccgccatccgagctgagcacaccggaagagagattgttgacctgatgtgtcatgcaactttcaccatgcgccttctgtcaccagtgagggtccctaactataatttgataatcatggatgaagcccacttcacagaccccgcctccattgctgcgcgtggttacatcagtacgcgggtggagatgggcgaagcagccgggatctttatgactgctaccccaccgggatctagagatcctttcccccagagcaacgccccaattatagacgaggagagggaaatccccgagcgctcctggaactcaggccatgaatgggtaacagattttaaaggtaagaccgtgtggttcgttccttctattaaagcagggaacgacatcgccgcttgcctacgaaagaatggaaagaaagtcattcaactgagcagaaagacttttgatagtgagtatgtgaaaacacggaccaacgactgggatttcgtggtcacgactgacatctccgaaatgggcgcgaattttaaggccgagagggtaatagatccacgccgttgtatgaaacccgtgatcctcacagacggcgaggaaagagttattttagcagggcctatgccggtgacccacagctctgctgcccagcggaggggacgcatcggtcgaaacccaaagaatgagaacgaccagtacatttacatgggcgaacccctggagaatgatgaagactgcgcacactggaaagaggccaagatgcttctggataacatcaatacccctgaggggataattccctcaatgttcgaaccagagagagaaaaggtcgacgctatcgatggagagtatcggctcaggggcgaagcccgcaaaacttttgtggacttgatgagaaggggtgatctgcctgtttggctcgcgtacaaggtggcagccgaggggattaactatgctgaccggcgttggtgtttcgatggcatcaaaaacaatcagatactggaggaaaacgtcgaggtggaaatctggacaaaggagggagagcgcaagaaacttaaaccccgatggctagacgccagaatttactccgatccactggctttgaaagaatttaaggagttcgcagccggcaggaaaagtttagctctgaatctcatcaccgaaatggggcggctgcctacattcatgactcaaaagacgcgcgacgcccttgataacctggcagtactccataccgcggaggccggaggtagagcttataatcacgccttgagcgaactgccggagacactagagactctgctccttctgaccttattggcaacagtgaccggcgggatttttctgttcctcatgtcgggaaggggcatcggtaaaatgactctggggatgtgctgcataattacggcttctatccttctgtggtacgcccagatccagccccattggattgcagcctccatcatactcgtatttttcttgattgtcctgttaatcccagaacctgagaagcagcggacaccccaagacaaccagctaacatatgtggtgattgctatcctgactgtcgttgcggccaccatggcaaatgaaatgggctttctcgagaagaccaagaaggaccttggattcggcagcatagctacccagcagccagaatcaaacatcctggatattgacttgcgacctgccagtgcctggactctgtacgcagtggctacaacgtttgtaacccccatgctcagacactctatcgaaaattccagcgtgaacgtctcactgactgccattgcgaatcaagctacagtgcttatggggctcggaaaaggttggccgctgagtaagatggatatcggcgttccattgctggccattgggtgttacagccaggtgaaccctatcaccttaaccgcagccctactgctccttgtcgctcactatgcaataattggacccggcctgcaggccaaagcgacacgcgaggctcagaagagggccgcagccggtatcatgaagaatccaactgtagacgggatcacggtgattgatttggaccccataccttacgatccgaaattcgaaaagcaactgggccaggttatgctcctggtgctttgcgtcacccaggtgttaatgatgcggacaacttgggctctgtgtgaggccctcaccttggcaacaggacccatctccaccctgtgggaaggcaacccagggcgtttttggaatactacgattgctgtctctatggccaacatcttcagaggaagctatctagcgggcgccggtctgctcttttccattatgaaaaatacaaccaacactaggcgcgggaccggaaacatcggcgagacacttggtgaaaagtggaaatcacggctgaatgcattgggcaagtctgagttccaaatatacaaaaagagtgggatccaggaggtggaccgaactctggctaaggaaggaattaaaagaggcgagaccgatcatcacgccgtttcgagggggagcgcaaagctccgctggtttgtggaacggaacatggtaacacctgagggaaaagtggtcgacctgggctgcggtagagggggatggtcctattactgtggcggtttaaagaatgttcgtgaggtgaaaggccttacgaaagggggacccggccatgaggagcctatcccaatgtctacctatgggtggaacctggtcaggctccagtcaggagtggatgtattcttcactccccctgaaaagtgcgacacactactgtgtgatattggcgagagctccccaaatcccaccgtggaagctggtcggactttgcgcgttctgaacctcgtggagaattggcttaacaataacacacagttttgcatcaaagtcctgaatccgtacatgcctagtgtgatagagaagatggaagccttgcaacgaaaatacgggggagccctggtcagaaacccactctctaggaatagcacccacgagatgtattgggtgtcaaacgcgtccggcaatattgttagtagcgtaaacatgatctctcggatgttaatcaaccgcttcacgatgaagcataaaaaggctacctacgaacccgacgtggacctgggctccgggacaagaaatattggaatagagtcagaagtccctaaccttgatatcattggtaagaggatcgagaaaattaagcaggagcacgaaactagctggcactatgaccaggatcatccatacaaaacctgggcatatcacggctcgtacgagacaaagcagactgggtctgccagttccatggtgaatggagttgtgcgactgctaaccaaaccctgggacgtcctcccgacagtgacccaaatggctatgactgatacgacaccttttggccagcagcgggtattcaaggaaaaggtggacacccgtactcaggagcccaaagaaggtaccaagaaactgatgaagatcacagccgagtggttgtggaaagagctggggaagaaaaagacgccaagaatgtgtacccgcgaagagtttactaggaaggttcggagcaacgcagccctcggagctatattcacagatgaaaataaatggaagtcagcgagagaggccgtcgaggactcccgcttttgggaacttgtggataaagagaggaacctgcatttagaaggcaagtgcgagacctgtgtgtataatatgatgggcaaacgagaaaagaagctgggggagttcggaaaagcaaagggttctcgggctatctggtacatgtggttgggcgccagatttctcgagttcgaagcactggggtttctaaacgaggaccactggttcagcagggaaaatagtctttccggagtcgagggcgaaggtctgcacaaactcgggtacattctgcgcgatgttagcaagaaagagggaggcgccatgtatgctgacgacactgccggctgggatacacgtatcaccttggaggacctgaagaacgaagagatggtgacaaatcatatggaaggggagcacaagaaactcgcggaagcaatttttaaacttacttaccaaaacaaagtagtgcgggtccagagacctacccccaggggaacggtgatggatatcatttctcgccgagaccagcggggttcaggccaagttgggacctatggactgaatacattcactaacatggaggcccagttaataagacagatggagggcgaaggtgtgttcaagaatatccagcatctgaccgctacagaggaaattgccgtccaaaactgcttggcaaggctcgggcgcgagagactgagtcggatggctatctccggagatgactgcgtggtaaaaccactagatgacaggtttgccagcgctcttactgccctgaacgatatgggcaagatccgtaaggacattcagcagtgggagccctctcgaggctggaatgattggacccaggttcctttctgttcgcaccattttcacgaactcataatgaaagacgggcgcgtgctggtcgtgccatgcagaaaccaagatgagttgatcggacgggcaaggatttcacagggtgcgggctggagcttacgcgaaacggcctgtctggggaagtcctacgctcagatgtggagtctcatgtatttccacagacgggaccttaggctggccgcaaatgctatctgctctgccgtgccgagccattgggtccccacatcccgaaccacttggtcaattcacgcaaaacatgagtggatgacaaccgaagacatgctaactgtttggaaccgtgtgtggatccaggagaatccttggatggaggataagaccccagtagaaagttgggaggaaataccctacctgggaaaaagagaggaccaatggtgtggctctctcatcggtttgacaagccgcgccacgtgggcgaagaacattcaggctgccatcaatcaggtgcggtccctgattgggaacgaagagtataccgattacatgccttcaatgaagaggtttagacgcgaggaagaggaagcaggagtcctttggtga

SEQ ID NO: 15073 - RNA, 9876 nt, synthetic construct
  misc_feature 1..9876: note = derived and/or modified CDS sequence (opt3) from DENV-2__AF169681__SS-prME
  source 1..9876: mol_type = other RNA
agcgcaggaatgatcattatgctgatacccaccgtgatggctttccacctcacaactagaaacggggagcctcatatgatcgtctccattcaggaaaagggaaaatctcttctgtttaagacggaggacggtgttaatatgtgcaccttgatggcaatggatttaggcgaactgtgtgaggacacaatcacttacaaatgcccactactcaggcaaaacgaaccggaggatattgactgttggtgcaattcaaccagtacatgggtgacctatgggacttgtacaaccacgggagagcaccggcgcgaaaagcgaagcgtagccctggtgccccatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaagaacaagacaagcgctttgtttgcaagcattccatggtggatcgaggatggggcaatggttgtgggctattcggaaaaggcggcatcgtcacttgcgccatgtttacctgcaagaaaaacatggaagggaagattgtgcagcctgagaatctcgaatacacaatagtggtcaccccacactcaggagaggagcatgctgttggtaacgacactggcaaacacgggaaggaaatcaaagtgacgccgcagagtagcattacagaggccgaactgaccggatatggcactgtaaccatggagtgttctcccagaacaggtcttgatttcaatgaaatggtgctgttgcaaatggagaacaaggcatggctcgtccacaggcagtggtttctggacttacctctgccatggctccccggggctgatacccagggctccaattggatccagaaggagactcttgtgacattcaaaaaccctcatgccaagaaacaagacgttgtggtcctgggatcacaggaaggcgcgatgcacacggccttgaccggggcaactgagatacagatgagcagtggaaatctactgtttacaggtcatctcaagtgccggctgcgtatggacaaacttcaactgaagggcatgtcttactccatgtgtaccgggaagttcaaagtggtaaaggaaattgctgagacacagcacggaactatcgttatccgcgtgcagtatgagggcgatggtagcccatgcaggattccattcgaaatcatggacttggagaaaagatacgtcctcgggcggctgattaccgtgaacccgatagtcacggaaaaggattcgcctgtgaacatcgaggccgaacccccatttggcgactcttacattatcatcggagttgagcctggccagttaaaactgaattggttcaagaaggggtcctcaattggacaaatgtttgagaccacaatgcgaggtgctaaacgcatggccatactaggcgatactgcatgggacttcgggagtctcggaggcgtgtttaccagcatcggtaaggccctgcatcaggtattcggggctatttatggcgcggcattttccggagtctcttggacaatgaaaatccttattggcgtgatcataacttggatcgggatgaacagcagatcaaccagtttgtccgttagcctggtgctcgtcggaattgtgacgctgtaccttggcgtaatggtgcaggccgattctggttgtgttgtctcatggaagaataaagaactgaagtgcgggagtggaatcttcattacagacaacgtgcacacctggactgagcagtataagtttcaacccgaaagcccatccaaattggcttctgccatccagaaggcacaggaggaaggcatatgtggtattaggtcggtgacacggctcgagaatctgatgtggaaacagatcacccccgagttaaaccacattctggccgaaaatgaggtcaagctaactatcatgaccggcgatataaaagggatcatgcaagctggaaagcgcagcctcagacctcagccaacagaactgaaatactcctggaagacgtggggcaaggccaaaatgctttcaaccgagagtcataaccagactttcttgattgacgggccgaagacagcagaatgccccaataccaacagggcgtggaactctctggaggttgaggattatggatttggcgtgttcacaactaacatctggctcaaactgaaggaaaaacaggacgctttatgtgacagcaagctgatgtccgccgcaattaaggataatcgtgccgtgcacgctgacatgggttactggatcgagtcagcccttaacgatacctggaaaatagaaaaggccagctttattgaggtcaagaattgccattggcctaagtctcacacgttgtggtccaacggggtcctcgagagtgaaatgatcatccccaagaatctggctggacccgtgagccaacacaattatcggcctggctaccatacacagattgccggtccatggcacctaggcaagctggagatggacttcgatttctgtgacgggaccactgttgtggtcaccgaagattgcggaaaccgaggcccctctctcagaacaactaccgcgtccgggaagctgatcacagagtggtgctgtaggtcatgcacgcttccgcctttgcgctaccggggagaagacggctgttggtatggtatggagattagaccactgaaagagaaggaagagaatttagtgaacagtctcgttaccgccgggcatggacaggtggataattttagcctgggcgtacttggtatggctctgttcttggaagagatgctcaggactcgcgtcggcacaaaacacgcaatactgctagtggccgtgtcgtttgtcaccctgatcactgggaacatgtccttcaaggacctcggacgagttgtggtaatggtgggcgctacaatgaccgatgacattgggatgggagtcacgtacctggcccttttggcagcgtttaaagtgcggcccactttcgccgctggcctgttactccgtaagctgacctctaaggaacttatgatgacaaccatcggtattgttctgctaagccaatcaactatccctgagacaatactcgagctgaccgatgccttggcactggggatgatggtgttaaaaatcgtcagaaatatggaaaagtatcagctcgctgtgacaattatggccatcctgtgcgttcccaacgcagtgattcttcagaatgcctggaaagtcagttgtactatcctggctgtagtgtccgtttctccattgatactcaccagctcccagcaaaagacggactggattcctctggcgctaacaatcaaaggactgaaccccaccgccatctttcttactaccctctcaaggacaaataagaaacgcagctggccactgaacgaggcaattatggctgtgggcatggtcagtatattggcctcttccctgttaaagaatgacatcccgatgactggccctctcgtggccgggggactgcttaccgtatgctacgtgctgacgggtcggagcgctgatttggaactcgagagagcaacagacgtcaagtgggaaaaccaggccgagatttcgggctcatctcccatcctgagtattaccatctccgaggatgggagcatgtctatcaaaaatgaagaggaagaacagactctaacaatcctgattaggaccggacttctcgttatcagcggcctgttcccagtgtccattcccatcactgcggctgcctggtatttgtgggaggtgaagaaacagcgagccggtgtattatgggacgtgccttcaccaccccctatggggaaggcagaactggaggatggagcttaccgcataaaacaaaagggcattctcggctatagtcagatcggggcaggagtttacaaggaaggtacatttcataccatgtggcacgtaacgcggggcgccgtgctgatgcacaaagggaagagaatcgagccgagctgggcggacgtcaaaaaggatcttatttcttacggaggcggttggaaactggaaggggagtggaaggagggagaagaggtgcaggttttggctctagaaccaggcaagaaccccagggccgtgcagactaaacctggcctgttcaagaccaacacagggaccatcggagcagtctccctcgacttttcaccaggtacaagtggcagccccataattgataaaaaggggaaagtggtaggactgtatggcaatggtgtcgtgactcgttccggggcctacgtttctgctatcgcccaaaccgagaagtcgattgaagacaaccctgagatcgaggatgacatattccgcaagcggagacttacgattatggatttacatccgggagcaggcaaaacaaagaggtatctgcccgctatcgtgcgagaagccatcaaacggggcctccgcactttgattctggcgccaaccagagtcgtggccgcagagatggaagaggctctcagggggctgcctatccggtaccagacacccgccattcgagctgaacacaccggaagagagatagttgaccttatgtgtcatgcaacttttaccatgcgcctgttgagcccagtgagggtccctaattataacctaatcattatggacgaggcccacttcacagatcccgcctcaatcgctgcgcgtggttacatctccacgcgggtggaaatgggcgaggcagccgggattttcatgactgctaccccaccgggaagtagagacccttttccccagtctaatgccccaataatcgatgaagagagggagattcccgaacgcagctggaactccggccatgagtgggtaacagacttcaagggtaaaaccgtgtggtttgttccttcaatcaaggcagggaatgatattgccgcttgcctgcgaaagaacggcaaaaaggtcatccaactctctagaaaaactttcgacagcgaatatgtgaagacacggaccaatgattgggactttgtggtcacgactgatataagtgagatgggcgcgaacttcaaagccgaaagggtaatcgacccacgccgttgtatgaagcccgtgattttaacagatggcgaggagagagttatcctggcagggcctatgccggtgacccactccagcgctgcccagcggaggggacgcattggtcgaaatcccaaaaacgaaaatgaccagtacatctacatgggcgagccccttgaaaacgacgaggattgcgcacactggaaggaagccaagatgctgctcgacaatataaacacccctgaggggattatcccctctatgtttgagccagaaagagagaaagtcgatgctattgacggagaatatcggttgaggggcgaggcccgcaagactttcgtggatctgatgagaaggggtgacctccctgtttggctggcgtacaaagtggcagccgaagggatcaactatgctgatcggcgttggtgttttgacggcataaagaataaccagatccttgaggagaatgtcgaagtggagatttggacaaaagaaggagagcgcaagaagctaaaaccccgatggctggatgccagaatctactcagacccattggctttaaaggagttcaaagaatttgcagccggcaggaagtccctggctctcaacctgattaccgagatggggcggcttcctacattcatgactcagaaaacgcgcgatgccctggacaatctcgcagtattgcataccgcggaagccggaggtagagcttataaccacgccctgagtgagctaccggaaacactggagactctccttctgttaaccttgctggcaacagtgaccggcgggatcttcctctttctgatgagcggaaggggcataggtaagatgactcttgggatgtgctgcattatcacggcttcgatcctgctctggtacgcccagattcagccccattggatcgcagcctctataattttggttttctttctgatcgtcttactaattccagagcctgaaaagcagcggaccccacaagataatcagctgacatatgtggtgatcgctatactcactgtcgttgcggccaccatggcaaacgagatgggcttccttgagaaaacaaagaaagacctgggatttggctccatcgctacccagcagccagagagcaatattttggacatcgatctgcgacctgcctcagcctggactctctacgcagtggctacaacgttcgtaacccccatgctgagacacagtattgaaaactcttccgtgaatgtcagccttactgccatcgcgaaccaagctacagtgctcatggggctgggaaagggttggccgttgtcaaaaatggacattggcgttccactgttagccatcgggtgttacagtcaggtgaatcctataaccctaaccgcagccctgctccttctggtcgctcactatgcaattatcggacccggcttgcaggccaaggcgacacgcgaggctcagaagagggccgcagccggtatcatgaaaaacccaactgtagatgggattacggtgatagacctggatcccatcccttacgacccgaagtttgagaaacaactcggccaggttatgctgcttgtgttatgcgtcacccaggtgctgatgatgcggacaacttgggctctctgtgaagccttgaccctggcaacaggacccattagcaccctatgggagggcaatccagggcgtttctggaacactacgatcgctgtctccatggccaatatttttagaggatcttatctggcgggcgccggtctccttttcagcatcatgaagaacacaaccaacactaggcgcgggaccggaaatataggcgaaacactgggtgagaaatggaagtcccggttgaacgcactgggcaaatcagaatttcaaatctacaagaagtctgggattcaggaggtggatcgaactctcgctaaagagggaatcaagagaggcgaaaccgaccatcacgccgttagtagggggtcggcaaaactgcgctggttcgtggagcggaatatggtaacacctgaaggaaaggtggtcgatttaggctgcggtagagggggatggagctattactgtggcggtcttaaaaacgttcgtgaggtgaagggcctgacgaaagggggacccggccatgaggaacctattccaatgtccacctatgggtggaatctcgtcaggctacagtctggagtggacgtatttttcataccccctgagaaatgcgatactctgttgtgtgacataggcgaatcaagcccaaaccccacagtggaggctggtcggaccctgcgcgttctcaatcttgtggaaaactggctgaataacaatactcagttctgcattaaggtcttgaacccgtacatgccttccgtgatcgagaaaatggaggccctgcaacgaaagtacgggggagccctcgtcagaaatccattaagtaggaactctacacacgaaatgtattgggtgagcaatgcgtcaggcaacatcgtttccagtgtaaacatgattagccggatgctgataaatcgctttaccatgagacataaaaaggctacgtacgagcccgatgtggaccttggctctgggaccaggaacatcggaattgaatccgagatccctaatctggacattatcggtaagcgaatagagaaaatcaagcaggaacacgagacatcatggcactatgatcaggaccatccatacaaaacttgggcatatcacggcagctacgaaaccaagcagacagggtcggcctctagtatggtcaacggagtggttcggctactcactaaaccctgggatgtgctgccgaccgtcacacaaatggctatgaccgacactacgcctttcggccagcagcgtgtgtttaaggagaaggtagatacaagaacccaggaacccaaagagggtactaagaaattgatgaagattaccgccgaatggctgtggaaagagctcgggaagaaaaagacaccacgcatgtgtacgagggaggagttcacccggaaggtgagatccaatgcagcccttggagctatctttactgacgagaacaaatggaaaagcgcgcgcgaagccgttgaggattcaaggttctgggagctggtcgacaaagaacgaaatttacatctggagggcaagtgcgaaacatgtgtgtataacatgatgggcaaacgggagaagaagttgggggaatttggaaaagcaaagggttccagagctatttggtacatgtggctcggcgccaggttcctggagtttgaggcactagggttccttaatgaagatcactggttttctcgcgagaacagcctgagtggagtggaaggcgagggtctccacaaactgcgttacatcttgcgggacgtctccaagaaagaagggggagccatgtatgctgatgacaccgccggctgggacactagaattacactggaggatctcaagaatgaggaaatggttaccaaccatatggagggcgaacacaagaaacttgcggaggcaatattcaagctgacataccaaaataaagtggtaagggtgcagcgccctactccccgagggaccgtcatggacatcattagccggagagatcagaggggatctggtcaagtgggcacgtatgggttaaacacctttacaaatatggaagcccagctgatccgccagatggagggagagggcgttttcaagaacatccagcatttgactgctaccgaagagattgccgtgcaaaactggctcgcaagagtcggtcgggaaaggctgtcacgtatggctataagtggggacgattgcgtggtaaaaccactagacgatcgattcgcctccgctcttacagccctgaatgacatgggaaagatccgcaaggatattcagcagtgggagcccagcagaggctggaacgactggactcaggttcctttttgctctcaccatttccacgagctcatcatgaaagatggccgggtgctggtcgtgccatgtaggaatcaagacgaattgattgggcgcgcaagaatctcgcagggagcgggttggtcattacgggagaccgcctgcctgggcaagagctacgctcagatgtggtccctcatgtattttcacaggcgagatcttcgtctggccgcaaacgctatatgtagtgccgtgccgtctcattgggtccccacgagcagaacaacctggtccatccacgcaaaacatgaatggatgactacagaggacatgctaaccgtttggaatcgcgtgtggattcaggaaaacccttggatggaggacaagactccagtagagtcatgggaagagatcccctacctggggaaacgggaagatcaatggtgcggaagtctcattggcttgacctctagggccacatgggcgaagaatatccaggctgccataaaccaggtgagaagcctgattggtaatgaggaatatacggactacatgccttccatgaagcgcttccggagggaggaggaagaggcaggggtcctttggtga

SEQ ID NO: 15074 - RNA, 9876 nt, synthetic construct
  misc_feature 1..9876: note = derived and/or modified CDS sequence (opt3) from DENV-2__AF169683__SS-prME
  source 1..9876: mol_type = other RNA
agcgcaggcatgataattatgctgatacccaccgtgatggctttccacctcacaactagaaatggggagcctcatatgatcgtctccattcaggaaaagggaaaatctcttctgtttaagacggaggacggtgttaatatgtgcaccttgatggcaatggatttaggcgaactgtgtgaggacacaatcacttacaaatgcccactgctcaggcaaaacgaaccggaggatattgactgttggtgcaattcaaccagtacatgggtgacctatgggacttgtacaaccacgggagagcaccggcgcgaaaagcgaagcgtagcactggtgccccatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaagaacaggacaagcgctttgtttgcaagcattccatggtggatcgaggatggggcaatggttgtgggctattcggaaaaggcggcatcgtcacttgcgccatgtttacctgcaagaaaaacatggaagggaagattgtgcagcctgagaatctcgaatacacaatagtggtcaccccacactcaggagaggagcatgctgttggtaacgacactggcaaacacgggaaggaaatcaaagtgacgccgcagagtagcattacagaggccgaactgaccggatatggcactgtaaccatggagtgttctcccagaacaggtcttgatttcaatgaaatggtgctgttgcaaatggagaacaaggcatggctcgtccacaggcagtggtttctggacttacctctgccatggctccccggggctgatacccagggctccaattggatccagaaggagactcttgtgacattcaaaaaccctcatgccaagaaacaagacgttgtggtcctgggatcacaggaaggcgcgatgcacacggccttgaccggggcaactgagatacagatgagcagtggaaatctactgtttacaggtcatctcaagtgccggctgcgtatggacaaacttcaactgaagggcatgtcttactccatgtgtaccgggaagttcaaagtggtaaaggaaattgctgagacacagcacggaactatcgttatccgcgtgcagtatgagggcgatggtagcccatgcaggattcccttcgaaatcatggacttggagaaaaggtacgtcctcgggcggctgattaccgtgaacccgatagtcacggaaaaggattcgcctgtgaacatcgaggccgaacccccatttggcgactcttacattatcatcggagttgagcctggccagttaaaactgaattggttcaagaaggggtcctcaattggacaaatgtttgagaccacaatgcgaggtgctaaacgcatggccatactaggcgatactgcatgggacttcgggagtctcggaggcgtgtttaccagcatcggtaaggccctgcatcaggtattcggggctatttatggcgcggcattttccggagtctcttggacaatgaaaatccttattggcgtgatcataacttggatcgggatgaacagcagatcaaccagtttgtccgttagcctggtgctcgtcggaattgtgacgctgtaccttggcgtaatggtgcaggccgattctggttgtgttgtctcatggaagaataaagaactgaagtgcgggagtggaatcttcattacagacaacgtgcacacctggactgagcagtataagtttcaacccgaaagcccatccaaattggcttctgccatccagaaggcacaggaggaaggcatatgtggtattaggtcggtgacacggctcgagaatctgatgtggaaacagatcacccccgagttaaaccacattctggccgaaaatgaggtcaagctaactatcatgaccggcgatataaaagggatcatgcatgctggaaagcgcagcctcagacctcaaccaacagaactgaaatactcctggaagacgtggggcaaggccaaaatgctttcaaccgagagtcacaaccagactttcttgattgacgggccggaaacagcagagtgccccaataccaacagggcgtggaactctctggaggttgaagattatggatttggcgtgttcacaactaacatctggctcaagctgaaagagaagcaggacgctttttgtgacagcaaattaatgtccgccgcaattaaggataatcgtgccgtgcatgctgacatgggttactggatcgaatcagccctgaacgatacctggaagatagagaaagccagcttcattgaggtaaagaattgccactggcctaaatctcacacgctttggtccaacggggtcttggaaagtgagatgatcatcccaaagaacctcgctggacccgtgagccagcataattatcggcctggctaccacacacaaattgccggtccatggcatctgggcaaactagaaatggacttcgatttttgtgacgggaccactgttgtggtcaccgaggattgcggaaaccgaggcccctctctgagaacaactaccgcgtccgggaagctcatcacagaatggtgctgtaggtcatgcacgctgccgcctcttcgctaccggggagaggacggctgttggtatggtatggagattagaccattgaaggaaaaagaggaaaatctggtgaacagtttagttaccgccgggcacggacaggtggataatttcagcctcggcgtactgggtatggctctttttctggaggaaatgttgaggactcgcgtcggcacaaagcatgcaatactcctggtggccgtgtcgttcgtcaccctaatcactgggaacatgtcctttaaagacctgggacgagttgtggtaatggtgggcgctacaatgaccgatgacattgggatgggagtcacgtacctcgccctgcttgcagcgttcaaggtgcggcccacttttgccgctggcttgctgttacgtaaactcacctctaaggagctgatgatgacaaccatcggtattgttcttctgagccagtcaactatccctgagacaatactagaactcaccgatgccctggcattggggatgatggtgctgaagatcgtcagaaatatggagaaatatcaattagctgtgacaattatggccatcctctgcgttcccaacgcagtgattctgcagaatgcctggaaggtcagttgtactatccttgctgtagtgtccgtttctccactgatattgaccagctcccagcagaaaacggactggattcctctcgcgctgacaatcaagggactaaaccccaccgccatcttcctgactaccctttcaaggacaaataaaaagcgcagctggccactcaacgaagcaattatggctgtgggcatggtcagtatactggcctcttccttgctgaaaaatgacatcccgatgactggccctttagtggccgggggactcctgaccgtatgctacgtgcttacgggtcggagcgctgatctggagttggaaagagcaacagacgtcaagtgggaggatcaagccgagatttcgggctcatctcccatcctcagtattaccatctccgaagacgggagcatgtctataaagaacgaggaagaggagcagactctgacaatcctaattaggaccggactgcttgttatcagcggcctctttccagtgtccattcccatcactgcggctgcctggtatctgtgggaagtgaaaaagcagcgagccggtgtcttgtgggatgtgccttcaccaccccctatggggaaagccgagttagaagacggagcttaccgcataaagcagaaaggcattctgggctatagtcaaatcggggcaggagtttacaaggagggtacattccacaccatgtggcacgtaacgcggggcgccgtgctcatgcataaggggaaaagaatcgaaccgagctgggcggatgtcaagaaagacctgatttcttacggaggcggttggaaacttgagggggagtggaaagaaggagaggaagtgcaggttctggctttggagccaggcaagaatcccagggccgtgcagactaagcctggcctatttaaaaccaacacagggaccatcggagcagtctccctggatttctcaccaggtacaagtggcagccccataattgacaagaaagggaaggtggtaggactctatggcaacggtgtcgtgactcgttccggggcctacgtttctgctatcgcccagaccgaaaaatcgattgaggataatcctgagatcgaagacgatatatttcgcaagcggagactgacgattatggaccttcacccgggagcaggcaagacaaaaaggtatttacccgctatcgtgcgagaggccatcaagcggggcctgcgcactctcattttggcgccaaccagagtcgtggccgcagaaatggaggaagctctgagggggctccctatccggtaccaaacacccgccattcgagctgagcataccggaagagagatagttgacctgatgtgtcacgcaactttcaccatgcgccttctgagcccagtgagggtccctaactataatttgatcattatggatgaagcccatttcacagaccccgcctcaatcgctgcgcgtggttacatctccacgcgggtggagatgggcgaagcagccgggatttttatgactgctaccccaccgggaagtagagatcctttcccccagtctaacgccccaataatcgacgaggagagggaaattcccgagcgcagctggaactccggccacgaatgggtaacagattttaaaggtaagaccgtgtggttcgttccttcaatcaaagcagggaacgacattgccgcttgcctacgaaagaatggaaagaaagtcatccagctgtctagaaagacttttgatagcgagtatgtgaaaacacggaccaacgactgggatttcgtggtcacgactgacataagtgaaatgggcgcgaattttaaggccgagagggtaatcgatccacgccgttgtatgaaacccgtgattctcacagacggcgaggaaagagttatcttagcagggcctatgccggtgacccacttctccgctgcccaacggaggggacgcattggtcgaaacccaaagaatgagaacgaccagtacatctacatgggcgaacccctggagaatgatgaagactgcgcacattggaaagaggccaagatgcttctggataacataaatacccctgaggggattatccccagcatgtttgaaccagagagagaaaaggtcgacgctattgatggagagtatcggctcaggggcgaagcccgcaaaactttcgtggacttgatgagaaggggtgatctgcctgtttggctcgcgtacaaggtggcagccgaggggatcaactatgctgaccggcgttggtgttttgatggcatcaagaataatcagatcctggaggaaaacgtcgaggtggaaatttggacaaaggagggagagcgcaagaaacttaaaccccgatggctagacgccagaatctactctgatccactggctttgaaagagttcaaggagttcgcagccggcaggaaatcattagctctgaatctcattaccgaaatggggcggctgcctacatttatgactcagaagacgcgcgacgcccttgataacctggcagtactccacaccgcggaggccggaggtagagcttataatcatgccttgtccgaactgccggagacactagagactctgctccttctgaccttattggcaacagtgaccggcgggatcttcctgtttctcatgagtggaaggggcataggtaaaatgactctggggatgtgctgcattatcacggctagcatccttctgtggtacgcccaaattcagccccactggatcgcagcctcgataattctcgttttctttttgatcgtcctgttaattccagaacctgagaagcagcggacaccccaggacaaccaactaacatatgtggtgatcgctatactgactgtcgttgcggccaccatggcaaatgaaatgggcttcctcgagaagaccaagaaggaccttggatttggctctatcgctacccagcagccagaatccaacattctggatatcgacttgcgacctgccagcgcctggactctgtacgcagtggctacaacgttcgtaacccccatgctcagacactcaattgagaatagttctgtgaacgtctccctgactgccatcgcgaatcaggctacagtgcttatggggctcggaaaaggttggccgctgagcaagatggatattggcgttccattgctggccatcgggtgttactcacaagtgaaccctataaccttaaccgcagccctactgctccttgtcgctcattatgcaattatcggacccggcctgcaggccaaagcgacacgcgaggctcagaagagggccgcagccggtatcatgaagaatccaactgtagacgggattacggtgatagatttggaccccatcccttacgatccgaaatttgaaaagcagctgggccaagttatgctcctggtgctttgcgtcacccaggtgttaatgatgcggacaacttgggctctgtgtgaggccctcaccttggcaacaggacccattagtaccctgtgggaaggcaacccagggcgtttctggaatactacgatcgctgtcagcatggccaacatttttagaggatcctatctagcgggcgccggtctactcttctctatcatgaaaaatacaaccaacactaggcgcgggaccggaaacataggcgagacacttggtgaaaagtggaaaagccggctgaatgcattgggcaagtccgagtcacagatctacaaaaagtctgggattcaagaggtggaccgaactctggctaaggaaggaatcaaaagaggcgagaccgatcaccatgccgttagtagggggtcggcaaagctccgctggtttgtggaacggaacatggtaacacctgagggaaaagtggtcgacctgggctgcggtagagggggatggagctattactgtggcggtattaagaatgttcgtgaggtgaaaggcttaacgaaagggggacccggccacgaagaacctatcccaatgtccacctatgggtggaaccttgtcaggctgcagtctggagtggatgtattcttcataccccctgaaaagtgcgacactctcctatgtgatattggcgagtcaagcccaaatcccacagtggaagctggtcggaccctgcgcgttttgaacctggtggagaattggctcaacaataacactcagttttgcatcaaagtccttaatccgtacatgccttccgtgatcgagaagatggaagccctgcagcgaaaatacgggggagccttggtcagaaacccactgagtagaaattctacacatgagatgtattgggtgagcaacgcgtcaggcaatattgtttccagtgtaaacatgataagccggatgctcatcaaccgcttcaccatgagacacaagaaagctacgtacgaacccgacgtggacttaggctctgggaccaggaatattggaatcgagtccgaaattcctaacctggatatcataggtaagcgaatcgagaagattaaacaagagcacgaaacatcatggcattatgaccaggatcacccatacaagacttgggcatatcatggcagctacgagaccaaacagacagggtcggcctctagtatggtcaatggagtggttcggcttctgactaagccctgggacgtgctaccgaccgtcacacagatggctatgaccgatactacgccttttggccaacagcgtgtgttcaaagaaaaggtagacacaagaacccaggagcccaaggaaggtactaaaaagctcatgaaaatcaccgccgagtggctgtggaaggagttggggaaaaagaaaacaccacgcatgtgtacgagggaagagtttacccggaaggtgagatccaacgcagccctgggagctattttcactgatgaaaataagtggaaaagcgcgcgcgaggccgttgaggactcaaggttttgggaactcgtcgataaggagcgaaaccttcacctggaaggcaaatgcgagacatgtgtgtataatatgatgggcaagcgggagaagaagttaggggagttcggaaaggcaaaaggttccagagctatctggtacatgtggctgggcgccaggtttttggagttcgaagcactcgggtttctgaacgaggaccactggttctctcgcgaaaatagcctaagtggacttgagggcgaaggtctgcataagctcgggtacattctgcgtgatgtgtccaaaaaggagggaggcgccatgtatgctgacgacaccgccggctgggatactcggataacattggaggacctgaaaaacgaagagatggtcaccaatcacatggaaggggagcataagaagctcgcggaagcaatctttaaacttacataccagaacaaggttgtgagagtacaaaggcctactccccgcggaaccgtgatggatattatcagccgacgggaccagagaggttctggccaggtcgggacgtatggactgaataccttcacaaacatggaggcccaattaatcaggcagatggagggcgaaggtgtgttcaaaaatattcagcacctgactgctaccgaggaaatagccgttcagaactggttggcacgcgtggggagagagcggctctcaaggatggctatcagtggagatgactgcgtcgtgaagccactggatgaccgttttgcctccgctctaacagcccttaacgatatgggcaaaattcgaaaggacatccaacagtgggagcccagccgcggctggaatgattggactcaggtacctttctgctctcatcactttcacgaactgattatgaaggacgggagagttctcgtggtcccatgtcggaaccaggatgagctgatcggaagggcacgcatatcgcaaggtgcgggctggtcattgagagaaaccgcctgcttagggaaaagctacgctcagatgtggtccctgatgtatttccatcggagggacctccgacttgccgcaaatgctatctgtagtgccgtgccgtctcactgggtgcccacgagccgtacaacctggtccattcatgcaaagcacgagtggatgactacagaagacatgctgaccgtctggaacagagtttggatccaggagaatccttggatggaggataaaactccagtggaatcatgggaggaaattccctacctaggaaagcgcgaggaccagtggtgcggcagtctgatcggtctcacctctcgggccacatgggcgaaaaacatacaagctgccattaatcaggtaaggagcttgatcgggaacgaagagtatacggattacatgccttccatgaagagatttcgccgggaggaagaggaagcaggagtgctgtggtga

SEQ ID NO: 15075 - RNA, 9876 nt, synthetic construct
  misc_feature 1..9876: note = derived and/or modified CDS sequence (opt3) from DENV-2__AF169684__SS-prME
  source 1..9876: mol_type = other RNA
agcgcaggaatgatcattatgctgatccccaccgtgatggctttccacctcacaactagaaatggggaacctcatatgatcgtctccattcaagaaaagggaaaatctcttctgtttaagacggaagacggtgttaatatgtgcaccttgatggcaatggatttaggagaactgtgtgaagacacaatcacttacaaatgcccattactcaggcaaaatgaaccggaggatattgactgttggtgcaattcaaccagtacatgggtgacctatgggacttgtacaaccacgggagagcaccggcgcgaaaagcgaagcgtagccctggtgccccatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaggaacaagacaagcgctttgtttgcaagcattccatggtggatcgaggatggggcaatggttgtgggctattcggaaaaggcggcatcgtcacttgcgccatgtttacctgcaagaaaaacatggaagggaagattgtgcagcctgagaatctcgaatacacaatagtggtcaccccacactcaggagaggagcatgctgttggtaacgacactggcaaacacgggaaggaaatcaaagtgacgccgcagagtagcattacagaggccgaactgaccggatatggcactgtaaccatggagtgttctcccagaacaggtcttgatttcaatgaaatggtgctgttgcaaatggagaacaaggcatggctcgtccacaggcagtggtttctggacttacctctgccatggctccccggggctgatacccagggctccaattggatccagaaggagactcttgtgacattcaaaaaccctcatgccaagaaacaagacgttgtggtcctgggatcacaggaaggcgcgatgcacacggccttgaccggggcaactgagatacagatgagcagtggaaatctactgtttacaggtcatctcaagtgccggctgcgtatggacaaacttcaactgaagggcatgtcttactccatgtgtaccgggaagttcaaagtggtaaaggaaattgctgagacacagcacggaactatcgttatccgcgtgcagtatgagggcgatggtagcccatgcaggattccattcgaaatcatggacttggagaaaagatacgtcctcgggcggctgattaccgtgaacccgatagtcacggaaaaggattcgcctgtgaacatcgaggccgaacccccatttggcgactcttacattatcatcggagttgagcctggccagttaaaactgaattggttcaagaaggggtcctcaattggacaaatgtttgagaccacaatgcgaggtgctaaacgcatggccatactaggcgatactgcatgggacttcgggagtctcggaggcgtgtttaccagcatcggtaaggccctgcatcaggtattcggggctatttatggcgcggcattttccggagtctcttggacaatgaaaatccttattggcgtgatcataacttggatcgggatgaacagcagatcaaccagtttgtccgttagcctggtgctcgtcggaattgtgacgctgtaccttggcgtaatggtgcaggccgattctggttgtgttgtctcatggaagaataaagaactgaagtgcgggagtggaatcttcattacagacaacgtgcacacctggactgagcagtataagtttcaacccgaaagcccatccaaattggcttctgccatccagaaggcacaggaggaaggcatatgtggtattaggtcggtgacacggctcgagaatctgatgtggaaacagatcacccccgagttaaaccacattctggccgaaaatgaggtcaagctaactatcatgaccggcgatataaaagggatcatgcaagctggaaagcgcagcctcagacctcagccaacagaactgaaatactcctggaagacgtggggcaaggccaaaatgctttcaaccgagagtcataaccagactttcttgattgacgggccggaaacagcagagtgccccaataccaacagggcgtggaactctctggaggttgaagattatggatttggcgtgttcacaactaacatctggctcaagctgaaagagaagcaggacgctttttgtgacagcaaattaatgtccgccgcaattaaggataatcgtgccgtgcacgctgacatgggttactggatcgaatcagccctgaacgatacctggaagatagagaaagccagcttcattgaggtaaagaattgccattggcctaaatctcacacgctttggtccaacggggtcttggaaagtgagatgatcatcccaaagaacctcgctggacccgtgagccaacacaattatcggcctggctaccatacacagattgccggtccatggcacctgggcaaactagaaatggacttcgatttttgtgacgggaccactgttgtggtcaccgaggattgcggaaaccgaggcccctctctgagaacaactaccgcgtccgggaagctcatcacagaatggtgctgtaggtcatgcacgctgccgcctcttcgctaccggggagaggacggctgttggtatggtatggagattagaccattgaaggaaaaagaggaaaatctggtgaacagtttagttaccgccgggcatggacaggtggataatttcagcctcggcgtactgggtatggctctttttctggaggaaatgttgaggactcgcgtcggcacaaagcacgcaatactcctggtggccgtgtcgttcgtcaccctaatcactgggaacatgtcctttaaagacctgggacgagttgtggtaatggtgggcgctacaatgaccgatgacattgggatgggagtcacgtacctcgccctgcttgcagcgttcaaggtgcggcccacttttgccgctggcttgctgttacgtaaactcacctctaaggagctgatgatgacaaccatcggtattgttcttctgagccaatcaactatccctgagacaatactagaactcaccgatgccctggcattggggatgatggtgctgaagatcgtcagaaatatggagaaatatcagttagctgtgacaattatggccatcctctgcgttcccaacgcagtgattctgcagaatgcctggaaggtcagttgtactatccttgctgtagtgtccgtttctccactgatattgaccagctcccagcagaagacggactggattcctctcgcgctgacaatcaagggactaaaccccaccgccatcttcctgactaccctttcaaggacaaataaaaagcgcagctggccactcaacgaagcaattatggctgtgggcatggtcagtatactggcctcttccttgctgaaaaatgacatcccgatgactggccctttagtggccgggggactcctgaccgtatgctacgtgcttacgggtcggagcgctgatctggagttggaaagagcaacagacgtcaagtgggaggatcaggccgagatttcgaggtcatctcccatcctcagtattaccatctccgaagacggcagcatgtctataaagaacgaggaagaggagcagactctgacaatcctaattcgaaccgggctgcttgttatcagcggactctttccagtgtccattcccatcactgcggctgcctggtatctgtgggaagtgaaaaagcagcgcgcaggcgtcttgtgggatgtgccttcaccaccccctatgggtaaagccgagttagaagacggggcttaccggataaagcaaaaaggcattctgggctatagtcagatcggcgcaggggtttacaaggagggaacattccataccatgtggcacgtaacgagaggtgccgtgctcatgcacaagggcaaaaggatcgaaccgagctgggcggatgtcaagaaagacctgatttcttacgggggaggctggaaacttgagggtgagtggaaagaaggggaggaagtgcaggttctggctttggagccaggaaagaatccccgtgccgtgcagactaagcctggcctatttaaaaccaacacaggcaccatcggggcagtctccctggatttctcaccaggaacaagtggtagccccataattgacaagaaaggcaaggtggtagggctctatggaaacggcgtcgtgactcgctccggtgcctacgtttctgctatcgcccaaaccgaaaaatcgattgaggataatcctgagatcgaagacgatatatttcggaagagaaggctgacgattatggaccttcatccgggggcaggaaagaccaagaagtatttacccgctatcgtgcgagaggccatcaaacggggcctgcgcactctcattttggcgccaaccagagtcgtggccgcagaaatggaggaagctctgaggggcctccctatccggtaccagacacccgccattcgagctgagcacaccgggagagagatagttgacctgatgtgtcatgcaactttcaccatgcgccttctgagcccagtgagggtccctaactataatttgatcattatggatgaagcccacttcacagaccccgcctcaatcgctgcgcgtggatacatctccacgcgggtggagatgggtgaagcagccggcatttttatgactgctaccccaccggggagtagagatcctttcccccagtctaacgccccaataatcgacgaggagagggaaattcccgagcgcagctggaactccggacatgaatgggtaacagattttaagggcaaaaccgtgtggttcgttccttcaatcaaggcaggtaacgacattgccgcttgcctacgaaagaatgggaaaaaggtcatccaactgtctagaaaaacttttgatagcgagtatgtgaagacacggaccaacgactgggatttcgtggtcacgactgacataagtgaaatgggagcgaattttaaagccgagagggtaatcgatccacgccgttgtatgaagcccgtgattctcacagacggcgaggaaagagttatcttagcaggccctatgccggtgacccacttctccgctgcccagcggagggggcgcattggacgaaaccccaagaatgagaacgaccagtacatctacatgggtgaacccctggagaatgatgaagactgcgcacactggaaggaggccaagatgcttctggataacataaatacccctgagggcattatccccagcatgtttgaaccagagagagaaaaagtcgacgctattgatggggagtatcggctcaggggagaagcccgcaagactttcgtggacttgatgagaaggggcgatctgcctgtttggctcgcgtacaaagtggcagccgagggtatcaactatgctgaccggcgttggtgttttgatgggataaagaacaatcagatcctggaggaaaacgtcgaggtggaaatttggacaaaagagggcgagcgcaagaaacttaaaccccgatggctagacgccagaatctactctgatccactggctttgaaggagttcaaagagttcgcagccggaaggaagtcattagctctgaatctcattaccgaaatgggccggctgcctacatttatgactcagaagacgcgcgacgcccttgataacctggcagtactccataccgcggaggccgggggcagagcttataatcacgccttgtccgaactgccggagacactagagactctgctccttctgaccttattggcaacagtgaccggtggcatcttcctgtttctcatgagtgggaggggaataggcaagatgactctgggtatgtgctgcattatcacggctagcatccttctgtggtacgcccagattcagccccattggatcgcagcctcgataattctcgagttctttttgatcttcctgttaattccagagcctgaaaagcagcggacaccccaagacaaccagctaacatatgttgtcatcgctatactgactgtggtggcggccaccatggcaaatgagatggggtttctcgagaaaacaaagaaagaccttggcttcggatctatcgctacccagcagccagagtccaacattctggatatcgacttgcgacctgccagcgcctggactctgtacgcagtcgctacaacgtttgttacccccatgctcagacactcaattgagaatagttctgtgaacgtatccctgactgccatcgcgaatcaagctacagtgcttatgggcctcgggaagggatggccgctgagcaaaatggatattggtgtcccattgctggccatcggctgttactcacaggtgaaccctataaccttaaccgcagccctactgctccttgttgctcactatgcaattatcgggcccggactgcaggccaaggcgacacgcgaagctcagaagagggccgcagccggcatcatgaaaaatccaactgtggacggtattacggtcatagatttggaccccatcccttacgatccgaagttcgagaaacaactggggcaggtaatgctcctggtgctttgcgttacccaggtgttaatgatgcggacaacttgggctctgtgtgaagccctcaccttggcaacaggccccattagtaccctgtgggagggaaacccaggccgtttttggaatactacgatcgctgtcagcatggccaacattttcagagggtcctatctagcgggagccggcctgctcttttctatcatgaagaatacaaccaacactaggcgcggtaccgggaacataggagaaacacttggcgagaaatggaaaagccggctgaatgcattgggtaaatccgagttccaaatctacaagaagtcaggcattcaggaagtggaccgaactctggctaaagaggggatcaagagaggagaaaccgatcatcacgccgtctctaggggcagtgcaaaactccgctggttcgtggagcggaacatggttacacctgaggggaaggtggtagacctgggatgcggcagaggtgggtggtcgtattactgtggaggccttaaaaatgtgcgtgaagtcaagggtctaacgaagggcgggcccggacatgaggaacctattccaatgagcacctatggctggaacctggttaggctccagtccggggtggatgtctttttcataccccctgagaaatgcgacactctactgtgtgatataggagaatcttcaccaaatcccacagtggaggctggccggaccttgcgcgtactgaacctcgtggagaattggcttaacaataacactcagttttgcattaaggttctgaatccgtacatgcctagcgtgatcgagaaaatggaggccttgcaacgaagatacggtggggccctggtcaggaacccactctcccggaatagtacacacgaaatgtattgggtgtctaacgcgagcggaaatatcgtctcatccgtgaacatgattagtcgcatgttaataaacagattcaccatgaagcataaaaaggctacgtacgagcccgacgttgacctgggcagcggcaccaggaatatcgggattgaatctgaggtacctaaccttgatatcattggaaagcgaatcgagaaaataaagcaggaacacgagacatcctggcactatgaccaggatcatccatacaaaacttgggcatatcacggttcatacgaaaccaagcagacaggcagcgcctcgtctatggtgaatggggtcgtgcggctgctaactaaaccctgggacgttctcccgaccgtgacacaaatggctatgaccgatactacgccttttggacagcagcgtgtcttcaaggagaaggtggacacaagaacccaggaacccaaagagggcactaagaaactgatgaagatcaccgccgagtggttgtggaaagaactgggtaagaaaaagacaccacgcatgtgtacgagggaggaatttacccggaaggtaagaagtaacgcagccctcggggctattttcactgatgagaataaatggaagtccgcgcgcgaggccgtggaagacagcaggttttgggagcttgttgataaagaacgaaacctgcatttagagggaaagtgcgaaacatgtgtctataatatgatgggcaaacgggagaagaagctgggcgagttcgggaaagcaaagggatcaagagctatctggtacatgtggttgggtgccaggtttctcgagttcgaggcactgggctttctaaacgaagaccactggttctcccgcgaaaattctcttagcggggtggaaggagagggcctgcacaaactcggttacattctgcgtgatgtgagtaagaaagaagggggagccatgtatgctgacgacaccgccggctgggatactcggatcacattggaagacctgaagaacgaggaaatggtcaccaatcatatggagggcgaacacaagaaactcgcggaggcaattttcaaacttacataccaaaacaaagttgtgagagtacagaggcctactccccgcgggaccgtgatggatataatctcccgacgggaccagagaggaagcggtcaagtcggcacgtatgggctgaatacctttacaaacatggaggcccagttaattaggcagatggaaggagagggcgtgttcaagaatatccagcatctgactgctaccgaagagatcgccgttcaaaactggttggcacgcgtgggtagagagcggctctctaggatggctatttcaggggatgactgcgtcgtgaaaccactggatgaccgttttgccagtgctctaacagcccttaacgatatgggaaagatacgaaaggacatccagcagtgggaaccctcccgcggctggaatgattggactcaggtacctttctgcagccaccattttcacgagctgattatgaaagacggcagagttctcgtggtcccatgtcggaaccaagatgaactgatcgggagggcacgcatttctcagggagcgggttggtcgttgagagagaccgcctgcttaggcaagtcatacgctcagatgtggagcctgatgtatttccaccggagggacctccgacttgccgcaaatgctatctgttccgccgtgccgagtcattgggtgcccacgtctcgtacaacctggagcatacacgcaaaacatgaatggatgactacagaggacatgctgaccgtctggaacagagtttggatccaggagaatccttggatggaagataagactccagtggagtcctgggaagagattccctacctagggaaacgcgaagaccaatggtgcggatcactgatcggcctcaccagtcgggccacatgggcgaagaacattcaggctgccatcaatcaggtaaggtctttgataggtaacgaggagtatacggattacatgcctagcatgaagagatttcgccgggaagaggaagaggcaggggtgctgtggtga

SEQ ID NO: 15076 - RNA, 9876 nt, synthetic construct
  misc_feature 1..9876: note = derived and/or modified CDS sequence (opt3) from DENV-2__AF169685__SS-prME
  source 1..9876: mol_type = other RNA
agcgcaggcatgatcattatgctgatacccaccgtgatggctttccacctcacaactagaaatggggagcctcatatgatcgtctccattcaggaaaagggaaagtctcttctgtttaagacggaggacggtgttaatatgtgcaccttgatggcaatggatttaggcgaactgtgtgaggacacaatcacttacaaatgcccactgctcagacaaaacgaaccggaggatattgactgttggtgcaattcaaccagtacatgggtgacctatgggacttgtacaaccacgggagagcaccggcgcgaaaagcgaagcgtagcactggtgccccatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaagaacaagacaagcgctttgtttgcaagcattccatggtggatcgaggatggggcaatggttgtgggctattcggaaaaggcggcatcgtcacttgcgccatgtttacctgcaagaaaaacatggaagggaagattgtgcagcctgagaatctcgaatacacaatagtggtcaccccacactcaggagaggagcatgctgttggtaacgacactggcaaacacgggaaggaaatcaaagtgacgccgcagagtagcattacagaggccgaactgaccggatatggcactgtaaccatggagtgttctcccagaacaggtcttgatttcaatgaaatggtgctgttgcaaatggagaacaaggcatggctcgtccacaggcagtggtttctggacttacctctgccatggctccccggggctgatacccagggctccaattggatccagaaggagactcttgtgacattcaaaaaccctcatgccaagaaacaagacgttgtggtcctgggatcacaggaaggcgcgatgcacacggccttgaccggggcaactgagatacagatgagcagtggaaatctactgtttacaggtcatctcaagtgccggctgcgtatggacaaacttcaactgaagggcatgtcttactccatgtgtaccgggaagttcaaagtggtaaaggaaattgctgagacacagcacggaactatcgttatccgcgtgcagtatgagggcgatggtagcccatgcaggattcccttcgaaatcatggacttggagaaaaggtacgtcctcgggcggctgattaccgtgaacccgatagtcacggaaaaggattcgcctgtgaacatcgaggccgaacccccatttggcgactcttacattatcatcggagttgagcctggccagttaaaactgaattggttcaagaaggggtcctcaattggacaaatgtttgagaccacaatgcgaggtgctaaacgcatggccatactaggcgatactgcatgggacttcgggagtctcggaggcgtgtttaccagcatcggtaaggccctgcatcaggtattcggggctatttatggcgcggcattttccggagtctcttggacaatgaaaatccttattggcgtgatcataacttggatcgggatgaacagcagatcaaccagtttgtccgttagcctggtgctcgtcggaattgtgacgctgtaccttggcgtaatggtgcaggccgattctggttgtgttgtctcatggaagaataaagaactgaagtgcgggagtggaatcttcattacagacaacgtgcacacctggactgagcagtataagtttcaacccgaaagcccatccaaattggcttctgccatccagaaggcacaggaggaaggcatatgtggtattaggtcggtgacacggctcgagaatctgatgtggaaacagatcacccccgagttaaaccacattctggccgaaaatgaggtcaagctaactatcatgaccggcgatataaaagggatcatgcaagctggaaagcgcagcctcagacctcagccaacagaactgaaatactcctggaagacgtggggcaaggccaaaatgctttcaaccgagagtcataaccagactttcttgattgacgggccggaaacagcagagtgccccaataccaacagggcgtggaactctctggaggttgaagattatggatttggcgtgttcacaactaacatctggctcaagctgaaagagaagcaggacgctttttgtgacagcaaattaatgtccgccgcaattaaggataatcgtgccgtgcacgctgacatgggttactggatcgaatcagccctgaacgatacctggaagatagagaaagccagcttcattgaggtaaagaattgccattggcctaaatctcacacgctttggtccaacggggtcttggaaagtgagatgatcatcccaaagaacctcgctggacccgtgagccaacacaattatcggcctggctaccatacacagattgccggtccatggcacctgggcaaactagaaatggacttcgatttttgtgacgggaccactgttgtggtcaccgaggattgcggaaaccgaggcccctctctgagaacaactaccgcgtccgggaagctcatcacagaatggtgctgtaggtcatgcacgctgccgcctcttcgctaccggggagaggacggctgttggtatggtatggagattagaccattgaaggaaaaagaggaaaatctggtgaacagtttagttaccgccgggcatggacaggtggataatttcagcctcggcgtactgggtatggctctttttctggaggaaatgttgaggactcgcgtcggcacaaagcacgcaatactcctggtggccgtgtcgttcgtcaccctaatcactgggaacatgtcctttaaagacctgggacgagttgtggtaatggtgggcgctacaatgaccgatgacattgggatgggagtcacgtacctcgccctgcttgcagcgttcaaggtgcggcccacttttgccgctggcttgctgttacgtaaactcacctctaaggagctgatgatgacaaccatcggtattgttcttctgagccaatcaactatccctgagacaatactagaactcaccgatgccctggcattggggatgatggtgctgaagatcgtcagaaatatggagaaatatcagttagctgtgacaattatggccatcctctgcgttcccaacgcagtgattctgcagaatgcctggaaggtcagttgtactatccttgctgtagtgtccgtttctccactgatattgaccagctcccagcagaagacggactggattcctctcgcgctgacaatcaagggactaaaccccaccgccatcttcctgactaccctttcaaggacaaataaaaagcgcagctggccactcaacgaagcaattatggctgtgggcatggtcagtatactggcctcttccttgctgaaaaatgacatcccgatgactggccctttagtggccgggggactcctgaccgtatgctacgtgcttacgggtcggagcgctgatctggagttggaaagagcaacagacgtcaagtgggaggatcaggccgagatttcgggctcatctcccatcctcagtattaccatctccgaagacgggagcatgtctataaagaacgaggaagaggagcagactctgacaatcctaattaggaccggactgcttgttatcagcggcctctttccagtgtccattcccatcactgcggctgcctggtatctgtgggaagtgaaaaagcagcgagccggtgtcttgtgggatgtgccttcaccaccccctatggggaaagccgagttagaagacggagcttaccgcataaagcaaaaaggcattctgggctatagtcagatcggggcaggagtttacaaggagggtacattccataccatgtggcacgtaacgcggggcgccgtgctcatgcacaaggggaaaagaatcgaaccgagctgggcggatgtcaagaaagacctgatttcttacggaggcggttggaaacttgagggggagtggaaagaaggagaggaagtgcaggttctggctttggagccaggcaagaatcccagggccgtgcagactaagcctggcctatttaaaaccaacacagggaccatcggagcagtctccctggatttctcaccaggtacaagtggcagccccataattgacaagaaagggaaggtggtaggactctatggcaacggtgtcgtgactcgttccggggcctacgtttctgctatcgcccaaaccgaaaaatcgattgaggataatcctgagatcgaagacgatatatttcgcaagcggagactgacgattatggaccttcatccgggagcaggcaagacaaaaaggtatttacccgctatcgtgcgagaggccatcaagcggggcctgcgcactctcattttggcgccaaccagagtcgtggccgcagaaatggaggaagctctgagggggctccctatccggtaccagacacccgccattcgagctgagcacaccggaagagagatagttgacctgatgtgtcatgcaactttcaccatgcgccttctgagcccagtgagggtccctaactataatttgatcattatggatgaagcccacttcacagaccccgcctcaatcgctgcgcgtggttacatctccacgcgggtggagatgggcgaagcagccgggatttttatgactgctaccccaccgggaagtagagatcctttcccccagtctaacgccccaataatcgacgaggagagggaaattcccgagcgcagctggaactccggccatgaatgggtaacagattttaaaggtaagaccgtgtggttcgttccttcaatcaaagcagggaacgacattgccgcttgcctacgaaagaatggaaagaaagtcatccaactgtctagaaagacttttgatagcgagtatgtgaaaacacggaccaacgactgggatttcgtggtcacgactgacataagtgaaatgggcgcgaattttaaggccgagagggtaatcgatccacgccgttgtatgaaacccgtgattctcacagacggcgaggaaagagttatcttagcagggcctatgccggtgacccacttctccgctgcccagcggaggggacgcattggtcgaaacccaaagaatgagaacgaccagtacatctacatgggcgaacccctggagaatgatgaagactgcgcacactggaaagaggccaagatgcttctggataacataaatacccctgaggggattatccccagcatgtttgaaccagagagagaaaaggtcgacgctattgatggagagtatcggctcaggggcgaagcccgcaaaactttcgtggacttgatgagaaggggtgatctgcctgtttggctcgcgtacaaggtggcagccgaggggatcaactatgctgaccggcgttggtgttttgatggcatcaagaataatcagatcctggaggaaaacgtcgaggtggaaatttggacaaaggagggagagcgcaagaaacttaaaccccgatggctagacgccagaatctactctgatccactggctttgaaagagttcaaggagttcgcagccggcaggaaatcattagctctgaatctcattaccgaaatggggcggctgcctacatttatgactcaaaagacgcgcgacgcccttgataacctggcagtactccataccgcggaggccggaggtagagcttataatcacgccttgtccgaactgccggagacactagagactctgctccttctgaccttattggcaacagtgaccggcgggatcttcctgtttctcatgagtggaaggggcataggtaaaatgactctggggatgtgctgcattatcacggctagcatccttctgtggtacgcccagattcagccccattggatcgcagcctcgataattctcgttttctttttgatcgtcctgttaattccagaacctgagaagcagcggacaccccaagacaaccagctaacatatgtggtgatcgctatactgactgtcgttgcggccaccatggcaaatgaaatgggcttcctcgagaagaccaagaaggaccttggatttggctctatcgctacccagcagccagaatccaacattctggatatcgacttgcgacctgccagcgcctggactctgtacgcagtggctacaacgttcgtaacccccatgctcagacactcaattgagaatagttctgtgaacgtctccctgactgccatcgcgaatcaagctacagtgcttatggggctcggaaaaggttggccgctgagcaagatggatattggcgttccattgctggccatcgggtgttactcacaggtgaaccctataaccttaaccgcagccctactgctccttgtcgctcactatgcaattatcggacccggcctgcaggccaaagcgacacgcgaggctcagaagagggccgcagccggtatcatgaagaatccaactgtagacgggattacggtgatagatttggaccccatcccttacgatccgaaatttgaaaagcaactgggccaggttatgctcctggtgctttgcgtcacccaggtgttaatgatgcggacaacttgggctctgtgtgaggccctcaccttggcaacaggacccattagtaccctgtgggaaggcaacccagggcgtttctggaatactacgatcgctgtcagcatggccaacatttttagaggatcctatctagcgggcgccggtctactcttctctatcatgaaaaatacaaccaacactaggcgcgggaccggaaacataggcgagacacttggtgaaaagtggaaaagccggctgaatgcattgggcaagtccgagtttcaaatctacaaaaagtcagggattcaggaggtggaccgaactctggctaaggaaggaatcaaaagaggcgagaccgatcatcacgccgtttctagggggagtgcaaagctccgctggttcgtggaacggaacatggtaacacctgagggaaaagtggtcgacctgggctgcggtagagggggatggtcgtattactgtggcggtttaaagaatgttcgtgaggtgaaaggccttacgaaagggggacccggccatgaggaacctattccaatgagcacctatgggtggaacctggtcaggctccagtccggagtggatgtattctttataccccctgaaaagtgcgacactctactgtgtgatataggcgagtcttcaccaaatcccacagtggaagctggtcggaccttgcgcgttctgaacctcgtggagaattggcttaacaataacactcagttctgcattaaagtcctgaatccgtacatgcctagcgtgatcgagaagatggaagccttgcaacgaagatacgggggagccctggtcaggaacccactctcccggaatagtacacacgagatgtattgggtgtctaacgcgagcggcaatatcgtttcatccgtaaacatgattagtcgcatgttaataaacagatttaccatgaggcataaaaaggctacgtacgaacccgacgtggacctgggcagcgggacccgaaatatcggaattgagtctgaagtccctaaccttgatatcattggtaaacggatcgagaagataaagcaggagcacgaaacatcctggcactatgaccaggatcatccatacaaaacttgggcatatcacggctcatacgagaccaagcagacagggagcgcctcgtctatggtgaatggagttgtgcgtctgctaactaaaccctgggacgtcctcccgaccgtgacacaaatggctatgaccgatactacgcctttcggccagcagagagtatttaaggaaaaagtggacacacgcacccaggagcccaaggaaggtactaagaaactgatgaagatcaccgccgagtggttgtggaaagagctggggaagaaaaagacaccaaggatgtgtacgcgggaagagttcaccagaaaagttcgcagtaacgcagccctcggagctatttttactgatgaaaataagtggaagtccgcgagggaggccgtcgaggacagccgattctgggaacttgtggataaagagcggaacctgcatttagaaggcaagtgcgagacatgtgtgtataatatgatgggcaaaagagaaaagaaactgggggagtttggaaaggcaaagggttcaagggctatctggtacatgtggttgggcgcccgcttcctcgagtttgaagcactggggttcctaaacgaggaccactggttttcccgtgaaaattctcttagcggagtcgagggcgaaggtctgcacaaactcgggtacattctgcgggatgttagtaagaaagagggaggcgccatgtatgctgacgacaccgccggctgggatactagaatcacattggaggacctgaagaacgaagagatggtgaccaatcatatggaaggggagcacaaaaagctcgcggaagcaattttcaaacttacataccaaaacaaagtagtgagggtccagcgccctactccccgaggaaccgtgatggatataatctcccggagagaccagaggggtagcggccaagttgggacgtatggactgaataccttcacaaacatggaggcccagttaattcgccagatggagggcgaaggtgtgtttaagaatatccagcatctgactgctaccgaggaaatcgccgtccaaaactggttggcaagagtggggcgggagaggctctctcgtatggctatttcaggagatgactgcgtagttaaaccactggatgaccgattcgccagtgctctaacagcccttaacgatatgggcaagatacgcaaagacatccagcagtgggagccctccagaggctggaatgattggactcaggtgcctttttgcagccaccatttccacgaactgattatgaaggacgggcgggtcctcgtggtgccatgtaggaaccaagatgagctgatcggacgcgcaagaatttctcagggtgcgggctggtcgttgcgggaaaccgcctgcttagggaagtcatacgctcagatgtggagcctgatgtattttcacaggcgagacctccgtcttgccgcaaatgctatctgttccgccgtcccgagtcattgggttcccacgtctagaacaacctggagcatacacgcaaaacatgagtggatgactacagaagacatgctgaccgtgtggaaccgcgtatggatccaggagaatccttggatggaggataagactccagtggaatcctgggaggaaattccctacctaggaaaacgggaggaccaatggtgcggctcactgatcggtctcaccagtagggccacatgggcgaagaacattcaggctgccatcaatcaggtcagatctttgatagggaacgaagagtatacggattacatgcctagcatgaaacgcttccggagggaggaagaggaagcaggagtgctgtggtga

SEQ ID NO: 15077 - RNA, 9876 nt, synthetic construct
  misc_feature 1..9876: note = derived and/or modified CDS sequence (opt3) from DENV-2__AF169686__SS-prME
  source 1..9876: mol_type = other RNA
agcgcaggaatgatcattatgctgatacccaccgtgatggctttccacctcacaactagaaatggggagcctcatatgatcgtctccattcaagaaaagggaaaatctcttctgtttaagacggaggacggtgttaatatgtgcaccttgatggcaatggatttaggcgaactgtgtgaggacacaatcacttacaaatgcccactactcaggcaaaatgaaccggaggatattgactgttggtgcaattcaaccagtacatgggtgacctatgggacttgtacaaccacgggagagcaccggcgcgaaaagcgaagcgtagcactggtgccccatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaagaacaagacaagcgctttgtttgcaagcattccatggtggatcgaggatggggcaatggttgtgggctattcggaaaaggcggcatcgtcacttgcgccatgtttacctgcaagaaaaacatggaagggaagattgtgcagcctgagaatctcgaatacacaatagtggtcaccccacactcaggagaggagcatgctgttggtaacgacactggcaaacacgggaaggaaatcaaagtgacgccgcagagtagcattacagaggccgaactgaccggatatggcactgtaaccatggagtgttctcccagaacaggtcttgatttcaatgaaatggtgctgttgcaaatggagaacaaggcatggctcgtccacaggcagtggtttctggacttacctctgccatggctccccggggctgatacccagggctccaattggatccagaaggagactcttgtgacattcaaaaaccctcatgccaagaaacaagacgttgtggtcctgggatcacaggaaggcgcgatgcacacggccttgaccggggcaactgagatacagatgagcagtggaaatctactgtttacaggtcatctcaagtgccggctgcgtatggacaaacttcaactgaagggcatgtcttactccatgtgtaccgggaagttcaaagtggtaaaggaaattgctgagacacagcacggaactatcgttatccgcgtgcagtatgagggcgatggtagcccatgccggattccattcgaaatcatggacttggagaaaaggtacgtcctcgggcggctgattaccgtgaacccgatagtcacggaaaaggattcgcctgtgaacatcgaggccgaacccccatttggcgactcttacattatcatcggagttgagcctggccagttaaaactgaattggttcaagaaggggtcctcaattggacaaatgtttgagaccacaatgcgaggtgctaaacgcatggccatactaggcgatactgcatgggacttcgggagtctcggaggcgtgtttaccagcatcggtaaggccctgcatcaggtattcggggctatttatggcgcggcattttccggagtctcttggacaatgaaaatcttcattggcgtgatcataacttggatcgggatgaacagcagatcaaccagtctttccgttagcttggtgctggtcggaattgtgacgctctacctgggcgtaatggtgcaggccgattctggttgtgttgtctcatggaagaataaagaacttaagtgcgggagtggaatctttattacagacaacgtgcacacctggactgagcagtataagttccaacccgaaagcccatccaaactggcttctgccatccagaaggcacaggaggaaggcatatgtggtattaggtcggtgacacggttggagaatctcatgtggaaacagatcacccccgagctgaaccacattttagccgaaaatgaggtcaagctgactatcatgaccggcgatataaaagggatcatgcaagctggaaagcgcagcctaagacctcagccaacagaactcaaatactcctggaagacgtggggcaaggccaaaatgctgtcaaccgagagtcataaccagacttttcttattgacgggccggaaacagcagagtgccccaataccaacagggcgtggaactctttggaggttgaagattatggattcggcgtgtttacaactaacatctggctgaagctcaaagagaagcaggacgctttctgtgacagcaaactgatgtccgccgcaattaaggataatcgtgccgtgcacgctgacatgggttactggatcgaatcagccttaaacgatacctggaagatagagaaagccagcttcattgaggtaaagaattgccattggcctaaatctcacacgctgtggtccaacggggtccttgaaagtgagatgatcatcccaaagaacttggctggacccgtgagccaacacaattatcggcctggctaccatacacagattgccggtccatggcacctcggcaaactggaaatggactttgatttctgtgacgggaccactgttgtggtcaccgaggattgcggaaaccgaggcccctctctaagaacaactaccgcgtccgggaagctgatcacagaatggtgctgtaggtcatgcacgctcccgcctctgcgctaccggggagaggacggctgttggtatggtatggagattagaccacttaaggaaaaagaggaaaatttggtgaacagtctggttaccgccgggcatggacaggtggataattttagcttaggcgtactcggtatggctctgttccttgaggaaatgctgaggactcgcgtcggcacaaagcacgcaatattgctcgtggccgtgtcgtttgtcaccctgatcactgggaacatgtccttcaaagacctaggacgagttgtggtaatggtgggcgctacaatgaccgatgacattgggatgggagtcacgtacctggccctcctggcagcgtttaaggtgcggcccactttcgccgctggccttttgctgcgtaaattaacctctaaggagctcatgatgacaaccatcggtattgttctgcttagccaatcaactatccctgagacaatactggaactaaccgatgccctcgcactggggatgatggtgttgaagatcgtcagaaatatggagaaatatcagctggctgtgacaattatggccatcttatgcgttcccaacgcagtgattctccagaatgcctggaaggtcagttgtactatcctggctgtagtgtccgtttctccacttatactgaccagctcccagcagaagacggactggattcctttggcgctcacaatcaagggactgaaccccaccgccatctttctaactaccctgtcaaggacaaataaaaagcgcagctggccagtgaacgaagcaattatggctgtcggcatggtgagtatacttgcctcttccctcctgaaaaatgacatcccgatgactggccctttggtagccgggggactgttaaccgtgtgctacgtcctcacgggtcggagcgctgatctggagcttgaaagagcaacagacgttaagtgggaggatcaggccgagatttcgggctcatctcccatcctgagtattaccatctccgaagacgggagcatgtctataaagaacgaggaagaggagcagactttgacaatcctcattaggaccggactgctagtgatcagcggcctgttcccagtgtccattcccatcactgcggctgcctggtatctttgggaagtcaaaaagcagcgagccggtgtgctctgggatgttccttcaccaccccctatggggaaagccgagctggaagacggagcttaccgcataaagcaaaaaggcattttgggctatagtcagatcggggcaggagtatacaaggagggtacatttcataccatgtggcacgtgacgcggggcgccgtcttaatgcacaaggggaaaagaatcgaaccgagctgggcggatgtgaagaaagacctgatttcttacggaggcggttggaagctcgagggggagtggaaagaaggagaggaagttcaggtgctggctcttgagccaggcaagaatcccagggccgtccagactaagcctggcctgttcaaaaccaacacagggaccatcggagcagtgtccttggatttttcaccaggtacaagtggcagccccataattgacaagaaagggaaggtagtcggactatatggcaacggtgtggttactcgttccggggcctacgtgtctgctatcgcccaaaccgaaaaatcgattgaggataatcctgagatcgaagacgatatattccgcaagcggagactgacgattatggacctccatccgggagcaggcaagaccaagaagtatctgcccgctatcgtcagggaggccatcaaacgaggccttcggactttaattctggcgccaacccgcgtggttgccgcagaaatggaggaagctctcagagggttgcctatcaggtaccagacacccgccattcgggctgagcacaccggacgagagatagtggacctgatgtgtcatgcaactttcaccatgagactcctgagcccagtccgcgtgcctaactataatcttatcattatggatgaagcccactttacagaccccgcctcaatcgctgcgaggggttacatctccacgcgtgtagagatgggcgaagcagccgggattttcatgactgctaccccaccgggaagtcgggatccttttccccagtctaacgccccaataatcgacgaggagagagaaattcccgagaggagctggaactccggccatgaatgggtgacagatttcaagggtaaaaccgtttggtttgtcccttcaatcaaggcagggaacgacattgccgcttgcctgcgcaagaatggcaaaaaggtgatccaattgtctcgaaaaactttcgatagcgagtatgtgaagacaagaaccaacgactgggattttgtcgtaacgactgacataagtgaaatgggcgcgaatttcaaagccgagcgggtgatcgatccaaggcgctgtatgaagcccgttattctaacagacggcgaggaacgtgtgatcctggcagggcctatgccggtcacccacttttccgctgcccagagacggggaaggattggtcgcaaccccaaaaatgagaacgaccagtacatctacatgggcgaacccctcgagaatgatgaagactgcgcacactggaaggaggccaagatgttactggataacataaatacccctgaggggattatccccagcatgttcgaaccagagcgagaaaaagtggacgctattgatggagagtatagacttcggggcgaagccaggaagacttttgttgacctgatgcgcagaggtgatctccctgtgtggttggcgtacaaagtcgcagccgaggggatcaactatgctgacaggcggtggtgtttcgatggcataaagaacaatcagatcctggaggaaaacgtggaggtagaaatttggacaaaagagggagagcgtaagaagctcaaaccccgctggctggacgcccgaatctactctgatccacttgctctaaaggagttcaaagagtttgcagccggcagaaagtcactggctttgaatttaattaccgaaatggggaggctgcctacattcatgactcagaaaacgcgggacgccctcgataacctggcagtgcttcataccgcggaggccggaggtcgcgcttataatcacgccctgtccgaactcccggagacattggagactctgctactgctcacccttctggcaacagttaccggcgggatctttttattcttgatgagtggaagaggcataggtaagatgactctggggatgtgctgcattatcacggctagcatcctcctgtggtacgcccagattcagccccattggatcgcagcctcgataattcttgtctttttcctgatcgtgctcttgattccagaacctgagaagcagaggacaccccaagacaaccagctgacatatgtggtcatcgctatattaactgttgtggcggccaccatggcaaatgaaatgggctttctagagaaaacaaagaaagacctgggattcggctctatcgctacccagcagccagaatccaacattctcgatatcgaccttcggcctgccagcgcctggactctgtacgcagtagctacaacgtttgtgacccccatgttgcgacactcaattgagaatagttctgtcaacgtgtccctgactgccatcgcgaatcaagctacagttctcatggggctgggaaagggttggccgcttagcaaaatggatattggcgtgccactcctggccatcgggtgttactcacaggtcaaccctataaccttgaccgcagccctgttactactggtagctcactatgcaattatcggacccggcctccaggccaaggcgacaagagaggctcagaagcgcgccgcagccggtatcatgaaaaatccaactgtggacgggattacggttatagatcttgaccccatcccttacgatccgaagttcgaaaaacaactgggccaggtgatgttgctggtcctctgcgtgacccaggtcctgatgatgaggacaacttgggctctttgtgaggccttaaccctggcaacaggacccattagtaccctctgggaaggcaacccagggcggttttggaatactacgatcgctgtgagcatggccaacattttccgtggatcctatttggcgggcgccggtctgctattttctatcatgaagaatacaaccaacactagaagggggaccggaaacataggcgagacactgggtgaaaaatggaaaagccgcctcaatgcacttggcaaatccgagttccaaatctacaagaagtcagggattcaggaggttgaccggactctggctaaagaaggaatcaagcgaggcgagaccgatcatcacgccgtgtctagagggagtgcaaaattgaggtggttcgtagaacgcaacatggtgacacctgagggaaaggtcgttgacctgggctgcggtagagggggatggtcgtattactgtggcggtctcaaaaatgtgagagaggtcaagggcctgacgaaagggggacccggccatgaggaacctattccaatgagcacctatgggtggaacttagtgcgtcttcagtccggagtagatgtgtttttcactccccctgaaaaatgcgacacactgctctgtgatatcggcgagtcttcaccaaatcccaccgttgaagctggtaggactctacgggtgctgaacttggtcgagaattggctgaacaataacacacagttttgcataaaggtgctcaatccgtacatgcctagcgtcattgagaaaatggaagcccttcaacgccgatacgggggagccctggtgagaaacccattgtccaggaatagtacccacgagatgtattgggtttctaacgcgagcggcaatatcgtatcatccgtgaacatgatcagtcggatgctgattaaccgcttcacgatgaagcataaaaaggctacctacgaacccgacgtcgacctcggcagcgggacaagaaatataggaatcgagtctgaagtgcctaacttagatattatcggtaagaggattgagaaaatcaagcaggagcacgaaacttcctggcactatgaccaggatcatccatacaaaacctgggcatatcacggctcatacgagacaaagcagactgggagcgcctcgtctatggttaatggagtggtccgactgcttaccaaaccctgggacgtgctgccgacagtaacccaaatggctatgactgatacgacaccttttggccagcagcgggtgttcaaggaaaaggttgacacccgtactcaggagcccaaagaaggtaccaagaaactaatgaagataacagccgagtggctctggaaagagctggggaagaaaaagacgccaagaatgtgtacccgcgaagagtttactaggaaggtccggagtaacgcagccttgggagctatcttcacagatgaaaataaatggaagtccgcgagagaggccgtggaggacagccgcttttgggaactggtggataaagagaggaacctccatcttgaaggcaagtgcgagacctgtgtctataatatgatgggcaaacgagaaaagaagctgggggagttcggaaaagcaaagggttcacgggctatttggtacatgtggttaggcgccagatttctggagttcgaaactttggggtttctcaacgaggaccactggttctccagggaaaattctctgagcggagttgagggcgaaggtctacacaaacttgggtacatcctgcgcgatgtgagtaagaaagagggaggcgcaatgtatgccgacgacacagctggctgggatacccgtattacactcgaggacctgaagaacgaagagatggtaactaatcatatggaaggggagcacaagaaattggccgaagcgatcttcaagctgacctaccaaaacaaagtggtccgggtgcagagacctacgcccaggggaaccgttatggatattatatcccgccgagaccagcggggtagcggccaagtggggacatatggactcaatacttttaccaacatggaggcacagcttatcagacagatggagggcgaaggtgtcttcaagaatattcagcatctgacagccactgaggaaatcgctgtgcaaaactggttagccagggtagggcgcgagagactgtctcggatggcaatctcaggagatgactgcgttgtgaaaccattggatgacaggtttgctagtgccctcaccgctctgaacgatatgggcaagattcgtaaggacatacagcagtgggagccctcccgaggctggaatgattggacgcaggtccctttctgcagccaccattttcacgaactaatcatgaaagacgggcgcgtgcttgtggtcccatgtagaaaccaagatgagctgattggacgggccaggatctctcagggtgcaggctggtcgctccgcgaaacagcgtgcctggggaagtcatacgcccagatgtggagcttgatgtatttccacagacgggacttaaggctggctgccaatgcaatttgttccgctgttccgagtcattgggtgcccacctctcgaactacatggagcatccacgccaaacatgagtggatgaccactgaagacatgctcgcagtatggaaccgtgtgtggatacaggagaatccttggatggaggataagaccccagtcgaatcctgggaggaaatcccctaccttggaaaaagagaggaccaatggtgcggctcactgattggtctaacaagtcgcgccacgtgggcgaagaacatccaggctgccattaatcaggtgcggtctctgatcgggaacgaagagtataccgattacatgcctagcatgaagaggtttagacgcgaggaagaggaagcaggagttctctggtga

SEQ ID NO: 15078 - RNA, 9876 nt, synthetic construct
  misc_feature 1..9876: note = derived and/or modified CDS sequence (opt3) from DENV-2__AF169687__SS-prME
  source 1..9876: mol_type = other RNA
agcgccggcatgatcattatgctgatacccaccgtgatggctttccacctcacaactagaaacggggagcctcatatgatcgtatccattcaggaaaagggaaaatctcttctgtttaagacggaggacggtgttaatatgtgcaccttgatggcaatggatttaggcgaactgtgtgaggacacaatcacttacaaatgcccattactcaggcaaaacgaaccggaggatattgactgttggtgcaattcaaccagtacatgggtgacctatgggacttgtacaaccacgggagagcaccggcgcgaaaagcgaagcgtagccctggtgccccatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaagaacaggacaagcgctttgtttgcaagcattccatggtggatcgaggatggggcaatggttgtgggctgttcggaaaaggcggcatcgtcacttgcgccatgtttacctgcaagaaaaacatggaagggaagattgtgcagcctgagaatctcgaatacacaatagtggtcaccccacactcaggagaggagcatgctgttggtaacgacactggcaaacacgggaaggaaatcaaagtgacgccgcagagtagcattacagaggccgaactgaccggatatggcactgtaaccatggagtgttctcccagaacaggtcttgatttcaatgaaatggtgctgttgcaaatggagaacaaggcatggctcgtccacaggcagtggtttctggacttacctctgccatggctccccggggctgatacccagggctccaattggatccagaaggagactcttgtgacattcaaaaaccctcatgccaagaaacaagacgttgtggtcctgggatcacaggaaggcgcgatgcacacggccttgaccggggcaactgagatacagatgagcagtggaaatctactgtttacaggtcatctcaagtgccggctgcgtatggacaaacttcaactgaagggcatgtcttactccatgtgtaccgggaagttcaaagtggtaaaggaaattgctgagacacagcacggaactatcgttatccgcgtgcagtatgagggcgatggtagcccatgccgaatcccattcgaaattatggacttggagaaaaggtacgtcctcgggcggctgattaccgtgaacccgatagtcacggaaaaggattcgcctgtgaacatcgaggccgaacccccatttggcgactcttacattatcatcggagttgagcctggccagttaaaactgaattggttcaagaaggggtcctcaattggacaaatgtttgagaccacaatgcgaggtgctaaacgcatggccatactaggcgatactgcatgggacttcgggagtctcggaggcgtgtttaccagcatcggtaaggccctgcatcaggtattcggggctatttatggcgcggcattttccggagtctcttggacaatgaaaatccttattggcgtgatcataacttggatcgggatgaacagcagatcaaccagtttgtccgttagcctggtgctcgtcggaattgtgacgctgtaccttggcgtaatggtgcaggccgattctggttgtgttgtctcatggaagaataaagaactgaagtgcgggagtggaatcttcattacagacaacgtgcacacctggactgagcagtataagtttcaacccgaaagcccatccaaattggcttctgccatccagaaggcacaggaggaaggcatatgtggtattaggtcggtgacacggctcgagaatctgatgtggaaacagatcacccccgagttaaaccacattctgagcgaaaatgaggtcaagctaactatcatgaccggcgatataaaagggatcatgcatgccggaaagcgctccctcagacctcaaccaacagaactgaaatactcatggaagacgtggggcattgctaagatgcttagtaccgagtctcacaaccagactttcttgatcgacgggccggaaacagccgagtgccccaataccaacagggcatggaatagcctggaggttgaagattatggatttggcgtgttcacaactaacatttggctcaaactgaaggagaaacaggacgcgttttgtgactccaagttaatgtcagctgccatcaaagataatcgtgcagtgcatgccgacatgggttactggatagaaagcgctctgaacgatacctggaagattgagaaggcctctttcatcgaggtcaaaaattgccactggcctaagtcccacacgctttggagtaacggggtcttggaaagcgagatgatcattcccaaaaatctcgcaggacccgtgtctcagcataattatcggcctggctaccacacacaaatcgctggtccatggcatctgggcaagctagaaatggacttcgatttttgtgacgggaccactgttgtggtcaccgaggattgcggaaaccgaggcccctccctgagaacaactaccgcctcagggaaactcattacagaatggtgctgtaggagttgcacgctgccgcctcttcgctaccggggagaggacggctgttggtatggtatggagataagaccattgaaggaaaaggaggaaaatctggtgaacagcttagttaccgcggggcacggacaggtggataatttctcgctcggcgtactgggtatggccctttttctggaggaaatgttgaggactcgcgtcggcacaaaacatgctatcctcctggtggcagtgtccttcgtcaccctaattactgggaacatgtcttttaaggacctgggacgagttgtggtaacagtgggcgccaccatgacggatgacatcgggatgggagtcacttacctcgctctgcttgccgcattcaaagtgcggcccacctttgcggccggcttgctgttacgtaagctcacaagcaaagagctgatgatgaccactattggtatcgttcttctgtcacagagtacaatacctgagaccatcctagaactcacagatgctctggccttggggatgatggtgctgaagattgtcagaaatatggagaagtatcaattagcagtgactatcatggctattctctgcgttcccaacgccgtgatcctgcagaatgcatggaaagtctcctgtaccatacttgccgtagtgtctgttagcccactgattttgacgtcctcacagcagaagacagactggatccctctcgctctgaccatcaaaggactaaaccccactgcgattttcctgaccacacttagcaggactaataagaaacgcagttggccactcaacgaagccataatggcagtgggcatggtctctatcctggcttccagcttgctgaagaatgacattccgatgaccggccctttagtggccgggggactcctgacggtatgctacgtgcttacaggtcggtcggccgatctggagttggaaagagctaccgacgtcaaatgggaggatcaagcagagatctcaggctctagtcccattctctccatcactataagcgaagacgggtctatgagcatcaagaacgaggaagaggagcagacactgaccattctaatcaggactggactgcttgttatttccggcctctttccagtgtcaatccccataacagccgcggcttggtatctgtgggaagtgaagaaacagcgagccggtgtcttgtgggatgtgcctagtccaccccctatggggaaggcagagttagaagacggagcctaccgcattaaacagaagggcatcctgggctatagccaaatcggggctggagtttacaaagagggtaccttccacacgatgtggcacgtaactcggggcgcagtgctcatgcataaggggaagagaattgaaccgtcttgggccgatgtcaaaaaggacctgatctcctacggaggcggttggaaacttgagggggagtggaaggaaggagaggaagtgcaggttctggcgttggagccaggcaaaaatcccagggctgtgcagaccaagcctggcctatttaagacaaacaccgggacaataggagccgtctcactggatttcagtccaggtactagcggctcccccattatcgacaaaaaggggaaagtggtaggactctatggcaacggtgtcgtgacccgttctggggcatacgtttcggccattgctcagacggaaaagagcatcgaggataatcctgagatagaagacgatatttttcgcaaacggagactgacaatcatggaccttcacccgggagccggcaagactaagaggtatttacccgcaatcgtgcgagaggctattaaacggggcctgcgcaccctcatcttggccccaacaagagtcgtggcggccgaaatggaggaagcactgagggggctccctattcggtaccaaacccccgctatacgagccgagcatactggaagagagatcgttgacctgatgtgtcacgctaccttcacaatgcgccttctgtcaccagtgagggtccctaactataatttgattatcatggatgaagcacatttcacggaccccgcctccatcgccgctcgtggttacattagtactcgggtggagatgggcgaagcggcagggatatttatgaccgccacaccaccgggatctagagatcctttcccccagagcaacgctccaatcattgacgaggagagggaaatccccgagcgctcctggaactcaggccacgaatgggtaaccgattttaagggtaaaactgtgtggttcgttccttctattaaggccgggaacgacatcgcagcctgcctacggaaaaatggaaagaaggtcatacagctgagcagaaaaacatttgatagtgagtatgtgaagaccagaacgaacgactgggatttcgtggtcactacagacatctccgaaatgggcgctaattttaaagcggagagggtaattgatccacgccgttgtatgaagcccgtgatcctcaccgacggcgaggaaagagttattttagccgggcctatgccggtgacccacttcagcgcagctcaacggaggggacgcatcggtcgaaaccccaaaaatgagaacgaccagtacatatacatgggcgaacccctggagaatgatgaagactgcgcccattggaaggaggcaaaaatgcttctggataacattaatactcctgaggggatcattccctctatgtttgaaccagagagagaaaaggtcgacgccatcgatggagagtatcggctcaggggcgaagctcgcaagacattcgtggacttgatgagaaggggtgatctgcctgtttggctcgcctacaaagtggcggcagaggggataaactatgccgaccggcgttggtgttttgatggcatcaagaacaatcagattctggaggaaaacgtcgaggtggaaatctggaccaaagagggagagcgcaagaaacttaagccccgatggctagacgctagaatttactcagatccactggccttgaaggagttcaaagagttcgctgcaggcaggaagtccttagccctgaatctcatcacagaaatggggcggctgcctacttttatgacgcagaaaacccgcgacgctcttgataacctggccgtactccacacagcagaggcgggaggtagagcctataatcatgctttgagtgaactgccggagactctagagaccctgctccttctgacattattggccaccgtgactggcgggatattcctgtttctcatgagcggaaggggcattggtaagatgacgctggggatgtgctgcatcatcaccgcatcgattcttctgtggtacgctcaaatccagccccactggatagccgcatctattatcctcgttttctttttgattgtcctgttaatcccagaacctgagaaacagcggacaccccaggacaaccaactaacttatgtggtgatagccatcctgaccgtcgttgctgcgacaatggccaatgaaatgggcttcctcgagaagaccaagaaagaccttggatttggctccattgcaactcagcagccagaaagcaacatcctggatattgacttgcgacctgcttcagcctggacactgtacgccgtggcaacgaccttcgtaactcccatgctcagacacagtatcgaaaattcttccgtgaacgtcagcctgacagctattgccaatcaggcgaccgtgcttatggggctcggaaagggttggccgctgtcaaaaatggatatcggcgttccattgctggctatagggtgttacagtcaagtgaaccctattaccttaacagccgcactactgctccttgtcgcccattatgctatcatcggacccggcctgcaggcaaaggccactcgcgaggcgcagaaaagggctgccgcaggtattatgaagaatccaacggtagacgggataaccgtgatcgatttggaccccattccttacgatccgaagtttgaaaaacagctgggccaagttatgctcctggtgctttgcgtcacacaggtgttaatgatgcggactacctgggccctgtgtgaggctctcacattggccaccggacccatcagcactctgtgggaaggcaacccagggcgtttctggaatacgacaattgcagtctccatggctaacatctttagaggatcttatctagccggcgcgggtctactcttcagcataatgaagaataccactaacaccaggcgcgggacaggaaacatcggcgagactcttggtgaaaaatggaagtcccggctgaatgccttgggcaaatcagagtttcagatttacaagaaatctgggatccaagaggtggaccgaaccctggcaaaggaaggaattaagagaggcgagacagatcaccatgctgttagtagggggtcggccaaactccgctggttcgtggaacggaacatggtaacgcctgagggaaaggtggtcgacctgggcagcggtagagggggatggtcctattactgcggcggtcttaaaaatgttcgtgaggtgaagggcctaaccaaagggggacccggccacgaggaacctatcccaatgtctacttatgggtggaacctggtcaggctccagtcaggagtggatgtattctttataccccctgaaaagtgtgacacactactgtgcgatattggcgagagctccccaaatcccaccgtggaagcaggtcggactttgcgcgttctgaacctcgtggagaattggcttaacaataacacacagttctgtatcaaggtcctgaatccgtacatgcctagtgtgatcgagaaaatggaggctttgcagcgaaagtacgggggagccctggtcagaaacccactctctaggaatagcacccatgagatgtattgggtgtcaaacgcctccggcaatattgttagtagcgtaaacatgatatctcggatgttaatcaaccgctttacgatgagacacaaaaaggcgacctacgaacccgacgtggacctgggctccgggacaaggaatattggaatcgagtcagaaattcctaaccttgatatcataggtaaacgaatcgagaagattaagcaagagcacgaaactagctggcattatgaccaggatcacccatacaaaacctgggcttatcatggctcgtacgagacaaagcagactgggtctgcaagttccatggtcaatggagtggttcggctgctaaccaaaccctgggacgtgctcccgacagtcacccagatggccatgactgatacgacacctttcggccaacagcgtgtgtttaaggaaaaagtagacaccagaactcaggagcccaaggaaggtaccaagaaactgatgaagatcacagctgagtggttgtggaaagagctggggaagaaaaagacgccacgcatgtgcaccagggaagagttcactcggaaagtgagaagcaacgccgcactcggagccatttttacagatgaaaataagtggaagtcagctcgcgaggcggttgaggactccaggttctgggaacttgtcgataaagagcgaaacctgcacttagaaggcaagtgtgagacctgcgtgtataatatgatgggcaaacgggaaaagaaactgggggagtttggaaaggccaagggttctagagcaatctggtacatgtggttgggcgctaggttcctcgagtttgaagccctggggttcctaaacgaggaccactggtttagccgcgaaaatagtctttccggagtggagggcgaaggtagccataaactggggtacattctccgtgatgtctctaagaaagagggaggcgcaatgtatgccgacgacactgctggctgggatacacggataaccctggaggacttgaagaacgaagagatggttacaaatcacatggaaggggagcataaaaagctggccgaagcgatcttcaagctcacttaccagaacaaagtggtaagagtgcaaaggcctaccccacgcggaacggtcatggatattatctcacgacgggaccagagaggtagtggccaggtggggacctatggacttaatacattcactaacatggaggcacaactgatcaggcagatggagggcgaaggtgtttttaagaatattcagcacttaaccgccacagaggaaatagctgtgcagaactggctggcccgcgtcgggagagagcggttgtccaggatggcaatcagcggagatgactgtgtggtaaaaccactcgatgaccgtttcgcttctgccctgactgctctaaacgatatgggcaagattcgaaaagacatccaacagtgggagccctcgcgcggctggaatgattggacccaggttcctttttgctcacatcacttccacgaacttattatgaaggacgggagagtgctggtcgtgccatgccggaaccaggatgagctcatcggaagggcccgcataagccaaggtgcaggctggtccctgagagaaacggcgtgtttggggaagagttacgcccagatgtggtctttaatgtattttcatcggagggacctgcgactcgctgccaatgcaatctgcagcgctgtgccgtcccactgggtccccacatcacgtaccacttggagtattcatgccaaacacgagtggatgacaaccgaagacatgcttactgtttggaacagagtgtggatccaggagaatccttggatggaggataagaccccagtagaatcttgggaggaaattccctacctgggaaaacgcgaggaccagtggtgtggcagcctaatcggtctgacatcccgggcaacgtgggccaagaacatacaagcggctattaatcaggtgaggtcactcatcgggaacgaagagtataccgattacatgcctagcatgaaaagattccgccgggaggaagaggaagccggagtcttgtggtga

SEQ ID NO: 15079 - RNA, 9876 nt, synthetic construct
  misc_feature 1..9876: note = derived and/or modified CDS sequence (opt3) from DENV-2__AF169688__SS-prME
  source 1..9876: mol_type = other RNA
agcgcaggcatgataattatgctgatacccaccgtgatggctttccacctcactactagaaatggggagcctcatatgatcgtctccattcaggaaaagggaaagtctcttctgtttaagacggaggacggtgttaatatgtgcaccttgatggcaatggatttaggcgaactgtgtgaggacaccatcacttacaagtgcccattactcaggcaaaacgaaccggaggatattgactgttggtgcaattcaaccagtacatgggtgacctatgggacttgtacaaccacgggagagcaccggcgcgaaaagcgaagcgtagcactggtgccccatgtcggcatgggtcttgagactcgtaccgaaacatggatgtcctctgagggggcgtggaagcacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaagaacaggacaagcgctttgtttgcaagcattccatggtggatcgaggatggggcaatggttgtgggctgttcggaaaaggcggcatcgtcacttgcgccatgtttacctgcaagaaaaacatggaagggaagattgtgcagcctgagaatctcgaatacacaatagtggtcaccccacactcaggagaggagcatgctgttggtaacgacactggcaaacacgggaaggaaatcaaagtgacgccgcagagtagcattacagaggccgaactgaccggatatggcactgtaaccatggagtgttctcccagaacaggtcttgatttcaatgaaatggtgctgttgcaaatggagaacaaggcatggctcgtccacaggcagtggtttctggacttacctctgccatggctccccggggctgatacccagggctccaattggatccagaaggagactcttgtgacattcaaaaaccctcatgccaagaaacaagacgttgtggtcctgggatcacaggaaggcgcgatgcacacggccttgaccggggcaactgagatacagacaagcagtggaaatctactgtttaccggtcatctcaagtgccggctgcgtatggacaaacttcaactgaagggcatgtcttactccatgtgtacagggaagttcaaagtggtaaaggaaattgctgagactcagcacggaaccatcgttatccgcgtgcagtatgagggcgatggtagcccatgcaggattcccttcgaaatcatggacttggagaaaaggtacgtcctcgggcggctgattacggtgaacccgatagtcaccgaaaaggattcgcctgtgaacatcgaggccgaacccccatttggcgactcttacattatcatcggagttgagcctggccagttaaaactgaattggttcaagaaggggtcctcaattggacaaatgtttgagacaactatgcgaggtgctaaacgcatggccatactaggcgataccgcatgggacttcgggagtctcggaggcgtgtttacaagcatcggtaaggccctgcatcaggtattcggggctatttatggcgcggcattttccggagtctcttggactatgaaaatccttattggcgtgatcataacctggatcgggatgaacagcagatcaacgagtttgtccgttagcctggtgctcgtcggaattgtgacactgtaccttggcgtaatggtgcaggccgattctggttgtgttgtctcatggaagaataaagaactgaagtgcgggagtggaatcttcattaccgacaacgtgcacacttggacagagcagtataagtttcaacccgaaagcccatccaaattggcttctgccatccagaaggcacaggaggaaggcatatgtggtattaggtcggtgacccggctcgagaatctgatgtggaaacagatcactcccgagttaaaccacattctggccgaaaatgaggtcaagctaaccatcatgacaggcgatataaaagggatcatgcatgctggaaagcgcagcctcagacctcaaccaacggaactgaaatactcctggaagacctggggcaaggccaaaatgctttcaactgagagtcacaaccagacattcttgattgacgggccggaaaccgcagagtgccccaatacaaacagggcgtggaactctctggaggttgaagattatggatttggcgtgttcactaccaacatctggctcaagctgaaagagaagcaggacgctttttgtgacagcaaattaatgtccgccgcaattaaggataatcgtgccgtgcatgctgacatgggttactggatcgaatcagccctgaacgatacgtggaagatagagaaagccagcttcattgaggtaaagaattgccactggcctaaatctcacacactttggtccaacggggtcttggaaagtgagatgatcatcccaaagaacctcgctggacccgtgagccagcataattatcggcctggctaccacacccaaattgccggtccatggcatctgggcaaactagaaatggacttcgatttttgtgacgggactaccgttgtggtcacagaggattgcggaaaccgaggcccctctctgagaactaccacagcgtccgggaagctcatcacggaatggtgctgtaggtcatgcaccctgccgcctcttcgctaccggggagaggacggctgttggtatggtatggagattagaccattgaaggaaaaagaggaaaatctggtgaacagtttagttactgccgggcacggacaggtggataatttcagcctcggcgtactgggtatggctctttttctggaggaaatgttgaggacacgcgtcggcaccaagcatgcaatactcctggtggccgtgtcgttcgtcactctaatcacagggaacatgtcctttaaagacctgggacgagttgtggtaatggtgggcgctaccatgacggatgacattgggatgggagtcacttacctcgccctgcttgcagcgttcaaggtgcggcccacctttgccgctggcttgctgttacgtaaactcacatctaaggagctgatgatgaccactatcggtattgttcttctgagccagtcaacaatccctgagaccatactagaactcacagatgccctggcattggggatgatggtgctgaagatcgtcagaaatatggagaaatatcaattagctgtgactattatggccatcctctgcgttcccaacgcagtgattctgcagaatgcctggaaggtcagttgtaccatccttgctgtagtgtccgtttctccactgatattgacgagctcccagcagaaaacagactggattcctctcgcgctgaccatcaagggactaaaccccactgccatcttcctgaccacactttcaaggactaataaaaagcgcagctggccactcaacgaagcaattatggctgtgggcatggtcagtatactggcctcttccttgctgaaaaatgacatcccgatgaccggccctttagtggccgggggactcctgacggtatgctacgtgcttacaggtcggagcgctgatctggagttggaaagagcaaccgacgtcaagtgggaggatcaagccgagatttcgggctcatctcccatcctcagtattactatctccgaagacgggagcatgtctataaagaacgaggaagaggagcagacactgaccatcctaattaggactggactgcttgttatcagcggcctctttccagtgtccattcccatcacagcggctgcctggtatctgtgggaagtgaaaaagcagcgagccggtgtcttgtgggatgtgccttcaccaccccctatggggaaagccgagttagaagacggagcttaccgcataaagcagaaaggcattctgggctatagtcaaatcggggcaggagtttacaaggagggtaccttccacacgatgtggcacgtaactcggggcgccgtgctcatgcataaggggaaaagaatcgaaccgagctgggcggatgtcaagaaagacctgatttcttacggaggcggttggaaacttgagggggagtggaaagaaggagaggaagtgcaggttctggctttggagccaggcaagaatcccagggccgtgcagaccaagcctggcctatttaaaacaaacaccgggacaatcggagcagtctccctggatttctcaccaggtacaagtggcagccccataattgacaagaaagggaaggtggtaggactctatggcaacggtgtcgtgacccgttccggggcctacgtttctgctatcgcccagacggaaaaatcgattgaggataatcctgagatcgaagacgatatatttcgcaagcggagactgacaattatggaccttcacccgggagcaggcaagactaaaaggtatttacccgctatcgtgcgagaggccatcaagcggggcctgcgcaccctcattttggcgccaacaagagtcgtggccgcagaaatggaggaagctctgagggggctccctatccggtaccaaacccccgccattcgagctgagcatactggaagagagatagttgacctgatgtgtcacgcaaccttcacaatgcgccttctgagcccagtgagggtccctaactataatttgatcattatggatgaagcccatttcacggaccccgcctcaatcgctgcgcgtggttacatctccactcgggtggagatgggcgaagcagccgggatttttatgaccgctacaccaccgggaagtagagatcctttcccccagtctaacgccccaataatcgacgaggagagggaaattcccgagcgcagctggaactccggccacgaatgggtaaccgattttaaaggtaagactgtgtggttcgttccttcaatcaaagcagggaacgacattgccgcttgcctacgaaagaatggaaagaaagtcatccagctgtctagaaagacatttgatagcgagtatgtgaaaacccggacgaacgactgggatttcgtggtcactacagacataagtgaaatgggcgcgaattttaaggccgagagggtaatcgatccacgccgttgtatgaaacccgtgattctcaccgacggcgaggaaagagttatcttagcagggcctatgccggtgacccacttctccgctgcccaacggaggggacgcattggtcgaaacccaaagaatgagaacgaccagtacatctacatgggcgaacccctggagaatgatgaagactgcgcacattggaaagaggccaagatgcttctggataacataaatactcctgaggggattatccccagcatgtttgaaccagagagagaaaaggtcgacgctattgatggagagtatcggctcaggggcgaagcccgcaaaacattcgtggacttgatgagaaggggtgatctgcctgtttggctcgcgtacaaggtggcagccgaggggatcaactatgctgaccggcgttggtgttttgatggcatcaagaataatcagatcctggaggaaaacgtcgaggtggaaatttggaccaaggagggagagcgcaagaaacttaaaccccgatggctagacgccagaatctactctgatccactggctttgaaagagttcaaggagttcgcagccggcaggaaatcattagctctgaatctcattacagaaatggggcggctgcctacttttatgacgcagaagacccgcgacgcccttgataacctggcagtactccacacagcggaggccggaggtagagcttataatcatgccttgtccgaactgccggagactctagagaccctgctccttctgacattattggcaaccgtgactggcgggatcttcctgtttctcatgagtggaaggggcataggtaaaatgacgctggggatgtgctgcattatcaccgctagcatccttctgtggtacgcccaaattcagccccactggatcgcagcctcgataattctcgttttctttttgatcgtcctgttaattccagaacctgagaagcagcggacaccccaggacaaccaactaacttatgtggtgatcgctatactgaccgtcgttgcggccacaatggcaaatgaaatgggcttcctcgagaagaccaaaaaggaccttggatttggctctatcgctactcagcagccagaatccaacattctggatatcgacttgcgacctgccagcgcctggacactgtacgcagtggctacgaccttcgtaactcccatgctcagacactcaattgagaatagttctgtgaacgtctccctgacagccatcgcgaatcaggctaccgtgcttatggggctcggaaaaggttggccgctgagcaagatggatattggcgttccattgctggccatcgggtgttactcacaagtgaaccctataaccttaacagcagccctactgctccttgtcgctcattatgcaattatcggacccggcctgcaggccaaagcgactcgcgaggctcagaagagggccgcagccggtatcatgaagaatccaacggtagacgggattaccgtgatagatttggaccccatcccttacgatccgaaatttgaaaagcagctgggccaagttatgctcctggtgctttgcgtcacacaggtgttaatgatgcggactacctgggctctgtgtgaggccctcacattggcaaccggacccattagtactctgtgggaaggcaacccagggcgtttctggaatacgacaatcgctgtcagcatggccaacatttttagaggatcctatctagcgggcgccggtctactcttctctatcatgaaaaataccactaacaccaggcgcgggacaggaaacataggcaagactcttggtgagaaatggaaaagccggctgaatgcattgggcaaaatcgaatttcagatttacaagaagtccgggatccaagaggtggaccgaaccctggctaaagagggaattaagagaggcgaaacagatcaccatgccgtttcaagggggtctgcaaaactccgctggttcgtggagcggaacatggtaacgcctgaaggaaaggtggtcgacctgggctgcggtagagggggatggagttattactgtggcggtctaaagaatgttcgtgaggtgaagggccttaccaaagggggacccggccacgaggaacctatcccaatgtcgacttatgggtggaacctggtcaggctccagagcggagtggatgtattctttataccccctgagaaatgcgacacactactgtgtgatattggcgaatcctctccaaatcccaccgtggaggctggtcggactttgcgcgttctgaacctcgtggaaaattggcttaacaataacacacagttctgcatcaaggtcctgaatccgtacatgccttcagtgatcgagaaaatggaggccttgcagcgaaagtacgggggagccctggtcagaaacccactcagcagaaattccacccatgaaatgtattgggtgagtaacgcgtctggcaatattgttagctcagtaaacatgatatcccggatgttaatcaaccgctttacgatgagacacaaaaaggctacctacgagcccgacgtggacctgggcagtgggacaaggaatattggaatcgaaagcgagattcctaaccttgatatcataggtaagcgaatcgagaaaattaagcaagaacacgagacttcttggcattatgaccaggatcacccatacaaaacctgggcatatcatggctcctacgaaacaaagcagactgggtcagccagctcgatggtcaatggagtggttcggctgctaaccaaaccctgggacgtgctcccgacagtcacccagatggctatgactgatacgacacctttcggccaacagcgtgtgtttaaggagaaggtagacaccagaactcaggaacccaaagagggtaccaagaaactgatgaagatcacagccgaatggttgtggaaagagctggggaagaaaaagacgccacgcatgtgtaccagggaggagttcactcggaaggtgagatctaacgcagccctcggagctatttttacagatgagaataaatggaagagtgcgcgcgaagccgttgaggactccaggttctgggagcttgtcgataaagaacgaaacctgcacttagagggcaagtgcgaaacctgtgtgtataatatgatgggcaaacgggagaagaagctgggggaatttggaaaagcaaagggtagcagagctatctggtacatgtggttgggcgccaggttcctcgagtttgaggcactggggttcctaaacgaagaccactggttttcacgcgaaaattccctttctggagtggaaggcgagggtctgcataaactcgggtacattctgcgtgatgtcagcaagaaagaaggaggcgccatgtatgctgacgacactgccggctgggatacacggataaccttggaggacctgaagaacgaggaaatggttacaaatcacatggagggggaacataagaaactcgcggaggcaatcttcaaacttacttaccagaacaaagtggtaagagtgcaaaggcctacaccccgcggaacggtcatggatattatcagtcgacgggaccagagaggttccggccaggtggggacctatggactgaatacattcactaacatggaagcccaattaatcaggcagatggagggcgagggtgtttttaagaatattcagcacctgaccgctacagaagagatagccgtgcagaactggttggcacgcgtcgggagagaacggctcagcaggatggctatctctggagatgactgcgtggtaaaaccactggatgaccgtttcgcctcagctctaactgcccttaacgatatgggcaagattcgaaaggacatccaacagtgggagcccagtcgcggctggaatgattggacccaggttcctttttgctcccatcacttccacgagctgattatgaaagacgggagagtgctcgtcgtgccatgtcggaaccaggatgaactgatcggaagggcacgcataagccaaggtgcgggctggtctttgagagagacggcctgcttagggaagtcgtacgctcagatgtggtcactgatgtattttcatcggagggacctccgacttgccgcaaatgctatctgtagcgccgtgccgtcccactgggtccccacaagtcgtaccacttggtctattcatgcaaaacacgaatggatgacaaccgaggacatgctgactgtttggaacagagtgtggatccaggaaaatccttggatggaggataagaccccagtagagagctgggaagagattccctacctaggaaaacgcgaagaccagtggtgcggctccctgatcggtctcacatcacgggccacgtgggcgaagaacatacaagctgccattaatcaggtgaggagtttgatcgggaacgaggaatataccgattacatgccttctatgaagagattccgccgggaggaggaagaggcaggagtcctgtggtga

SEQ ID NO: 15080 - RNA, 9873 nt, synthetic construct
  misc_feature 1..9873: note = derived and/or modified CDS sequence (opt3) from DENV-3__AB189125__SS-prME
  source 1..9873: mol_type = other RNA
accagcctgtgcctcatgatgatgcttcccgcaactctggctttccacttgacttccagagacggagaacctaggatgatcgtggggaagaacgaacggggaaagtctttactgtttaagacggcatcaggtattaatatgtgtaccctgatagccatggatctcggcgagatgtgcgacgatacagtcacttacaagtgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagagcacagacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagctgatcgagggaaaagtggtccagcacgaaaatctcaagtatacagtgataattactgttcataccggtgaccagcaccaggtgggcaacgagacacaaggggtcaccgcagaaatcactccccaggcttccacggtggaggccattcttcctgaatacggaacactgggcttggagtgctctccacgaaccggtctagactttaatgagatgatcctgctcactatgaaaaacaaggcgtggatggtacatagacagtggttctttgatctgccgcttccctggaccagcggggccacaaccgaaactcctacatggaataaaaaggagctgttggttacgttcaaaaacgcacacgctaagaagcaagaagtggtcgtgctcggctcccaggagggagccatgcacaccgctctgactggcgccacagaaatccagacctcagggggaacaagtatttttgcaggtcatttaaaatgtaggctgaagatggacaaactagagctcaagggcatgagctatgccatgtgctctaatgctttcgtcctgaaaaaggaggtgtccgaaactcagcacgggaccatacttatcaaggttgagtacaaaggagaagatgcgccatgtaagattcccttctcaacggaggacggccaaggtaaagcacataacgggcggttgatcaccgccaaccctgtggtaacaaagaaagaggaaccagtcaatatagaggctgaacccccgtttggcgagagcaacattatcatcggaattggcgataaggccctgaagatcaattggtacaaaaaggggagttctattggaaaaatgttcgaagcaactgcccgtggtgctcgcagaatggccatactcggcgacaccgcatgggattttgggtccgtgggaggcgttctgaacagccttggtaagatggtgcaccagatcttcgggtcggcgtatacagctctgttttctggcgtctcctggattatgaaaatcggaatcggcgtgttgctcacttggattgggctaaattcaaagaacaccagtatgagcttctcctgcatagtaatcggaattatcacgttatacctgggcgccgtggttcaggcagacatgggttgtgtcattaattggaaggggaaagagctaaagtgcggatctggcatctttgtgacaaacgaggtgcatacctggactgaacagtataaattccaagccgatagccctaagaggctcgctacagccatagccggtgcttgggagaatggcgtctgtgggatccggtcaaccactcgaatggaaaacctgctttggaaacagattgccaatgagttgaactacatcctgtgggaaaataacattaagctcaccgttgtggtgggagacatcataggcattctggagcaggggaaacgcacattaacgccccagccaatggagctgaagtatagttggaagacctggggaaaagcgaagatcgtaactgccgaaattcaaaattccagctttatcatagatggccctaacacacccgagtgcccaaacgcttctagagcatggaatgtctgggaagtggaggactacggtttcggggtttttaccacaaacatctggcttaaattgagggaaatgtatactcagctctgtgaccaccggctgatgtcagccgctgtgaaggatgagcgcgccgtccacgcagacatgggatactggattgagagtcagaaaaatggcagctggaagctagaaaaggcgtccctgatcgaggtgaaaacctgcacgtggcccaagtctcatacactctggtcgaacggtgttctggaaagcgatatgattatccctaaatcccttgccggcccaatatcacagcacaattacagaccggggtatcatacccaaactgctggaccctggcacttgggcaagctggagttagacttcaactactgcgaggggaccacagtggtaattactgaaaattgtggaaccaggggccctagtctccgtacaacgaccgtctctggtaaactgatccacgagtggtgctgtcggagctgcactcttccacccctgcgatatatgggggaagatggatgttggtacggcatggagatcagacctattaacgaaaaggaggagaatatggtgaagtccttggtgtcagccggtagcggcaaagtcgacaactttacaatgggggttctctgcctggcaatcctattcgaagaggtgatgaggggaaagttcggcaaaaagcatatgattgctggggtactgtttaccttcgtgctcctgctttctggacagataacttggcgcgatatggcccggacattgatcatgattggctccaatgcaagtgacagaatgggtatgggggtcacctatctggccttaatcgctacgtttaaaattcagccattcctcgcgctgggatttttccttaggaagctgactagccgcgaaaacctactcctgggcgtgggcttggccatggcaaccacactgcaattacccgaggatatcgaacagatggctaatgggatagccctcggactgatggcccttaagctgatcacccagtttgagacttaccagttgtggacagctctcgtttctctgatgtgttccaacaccattttcacactaactgtggcatggcgaaccgccacgctgatccttgcgggtatttcactcctgccggtctgccaaagtagctcgatgcggaaaacagactggttgcctatgaccgtggctgccatgggcgttccacccctgcctttatttatcttctccctcaaggatactctgaaacgtagatcttggccccttaatgagggggtgatggcagtcggactggtaagcatattggcctcaagtctcctgaggaacgacgtgccaatggctggccctctagttgccggtgggctgcttattgcctgttatgtgatcaccggaacatccgcggatctcactgtcgaaaaggctgccgacgtgacctgggaggaagaggcagaacagacgggcgtatctcacaacctgatgatcacagtggacgatgacggcaccatgcgcattaaagatgacgagactgagaatatattgacagtcttactgaagaccgccctcctgatcgttagcgggatttttccctactccatcccagctactcttctggtgtggcatacatggcagaaacagacccaacggtcaggagtgttgtgggatgtcccgagccctcccgaaacgcagaaggccgagctagaagagggtgtgtacagaattaagcagcagggcatcttcgggaaaactcaagttggagtaggcgtgcagaaggagggtgtctttcacaccatgtggcatgtgacaagaggggcagttctgacctataacggaaaacgactcgaaccaagttgggcttctgtgaagaaagacctgatatcctacggcggcgggtggcgccttagcgcccagtggcaaaagggagaggaagtccaggtgatcgcggtagagcccggtaagaatcctaaaaacttccagacaatgccaggcattttccagactaccacgggggaaatcggagccattgcattagattttaagcccggcacatcgggttcacctatcataaatcgggaggggaaagtcgtgggactgtatggcaacggcgttgtgactaagaatgggggatacgtctctggtattgctcaaaccaacgccgagccggacggcccaacacccgaactcgaggaagagatgttcaaaaagagaaatttgaccatcatggatctgcaccctgggagtggaaagactaggaaatatctcccagctatcgtgcgtgaagcaattaagcgccggctgagaacccttatcctggcccccacaagggttgtggccgctgagatggaggaagcgttgaaaggcctacctatacgataccagacgactgcaaccaagtccgagcacacaggtaaagaaattgtcgacctgatgtgccatgccacctttactatgcggctcttaagcccggtgcgcgtacccaactataatctgatcattatggatgaggctcacttcacagacccagcctctatcgcagccagagggtacataagcaccagggtgggaatgggcgaagctgcggccatttttatgacggcaactcctcccggcacagctgatgccttcccacagtccaacgcacctatccaggacgaggagcgggacatccccgaacgatcatggaatagtgggaacgattggattaccgactttgccggaaagaccgtttggttcgtcccaagcatcaaggctggtaatgatattgccaactgtcttaggaagaacggcaagaaagtgatacaactgtctcgcaagacttttgacacagagtaccagaaaaccaagctcaatgattgggacttcgtggtcacaactgatatctccgaaatgggggcgaactttaaggcagacagggtaattgatccgcgtcggtgcttgaaacctgtgatcctgacggacggacccgagagagttatcctcgccggcccaatgcccgtgaccgtcgcttcagccgctcagaggcgcggtcgagtggggagaaatcctcagaaggagaacgatcaatatattttcacaggccagccactgaataacgacgaagaccatgcacactggactgaggccaaaatgcttctagataatataaacacccccgaaggaatcattcctgctctgttcgagccggaacgggagaagagtgccgcaatcgacggcgagtacaggttgaaaggggaaagccgcaagacatttgttgagttaatgcgtagaggagatctgccagtgtggctcgcgcataaagtcgcctccgaaggtattaagtataccgaccggaagtggtgcttcgatggcgagaggaataaccagatcctggaagagaatgtggacgtagagatatggactaaagaaggggagaagaagaaacttcgcccccgatggctggatgctagaacgtactctgaccctctcgccttgaaagaatttaaagatttcgcagctggacggaagtcgatcgccctggacctagtgaccgagattggcagggttcccagccacctggcacaccgcacaagaaacgccctcgataatcttgtcatgctgcatacttcagaacacggtgggagggcttatcggcatgcggtggaggagttaccagaaaccatggagacattgctgctcctgggccttatgatcctgctcaccggaggcgtgatgttgtttctgatttccgggaaaggagtcggtaagacaagtatcggcttaatatgtgttgtggcctctagcgggatgctatggatggcagacattcctctgcagtggatcgcttccgccattgtactcgagttctttatgatggtgcttctgatccccgagccagagaaacaacgtacacctcaggataaccagttggcctacgtcgtgataggaatcctgacgctcgcagctattgttgccgcgaatgaaatgggcctgcttgagaccactaagcgcgacctcggtatgtcaaaagaaccgggggtggtctctcccacaagctatctggacgtagatttgcacccagctagtgcctggaccctgtacgcagtggccaccacagttatcactcctatgttacgacacacgattgagaactccaccgctaatgtgagcctagcagccatcgcgaaccaagctgtcgtgctgatgggcctcgacaagggatggcccatatctaagatggatcttggcgtcccactgttggccctggggtgctactcacaggtgaaccctctcacactgactgcagccgttcttttactggtgacccattatgctattatcggacccggcctccaggccaaagcaacaagagaagctcagaagaggaccgccgcgggtatcatgaaaaatccgactgtagacgggattatgacgatcgatttggacccagtgatatacgattccaagttcgagaaacaactgggacaggtcatgctactggttctctgtgccgtgcagcttctgttgatgcggacaagttgggcattttgcgaggctctgaccctcgccactggccctattaccacactgtgggaaggtagccccggcaagttctggaacactaccatcgcagtctcgatggctaatatttttcgcgggtcttatttagccggagccggccttgcgttctccatcatgaaaagcgtggggacaggaaaaagaggcacgggttcacagggggagaccctgggagaaaagtggaaaaagaaactcaaccaactaagtaggaaggagtttgacctgtacaaaaagtctggcataactgaagtagatcggacagaggctaaggagggtttgaaacgaggcgaaatcacccaccatgcagtgtccagagggagcgccaagctgcagtggttcgttgagcgcaatatggtgattccagaaggaagggtcatcgacctcggctgtgggcggggaggctggtcatattactgcgctggtcttaaaaaggtgactgaggtccgtgggtatacaaaaggaggccccggccacgaagaacctgtgccgatgagtacctacgggtggaacattgttaagctgatgagcggaaaggatgtattctacttgcccccagagaaatgtgacacgctgctctgcgatatcggtgaatcctctcctagccccaccgtggaggaatccagaacaattagggtcttaaagatggtggagccttggctgaaaaataaccagttttgtatcaaggttcttaatccatatatgcccgccgtgatagagcatctggaacgcctacagcggaaacacggcgggatgctcgtccgaaaccctctgtcaagaaattctactcacgagatgtactggattagtaacggaaccggcaatatcgtgtcgagcgtaaacatggtgtccaggttgctgctcaatcgcttcacaatgacttatcggagaccaaccatcgaaaaggacgttgaccttggtgcagggacacgtcatgtcaacgccgagcccgaaaccccgaacatggatgtgattggagagaggatacggcgcatcaaggaggaacactcttcaacttggcattacgacgatgagaatccttataaaacgtgggcttaccacggcagctatgaagtgaaggcgacaggctccgccagttctatgattaacggggtcgttaaactgttaaccaagccatgggacgtggtacccactgtgacccaaatggcaatgacagatacgaccccttttggacagcagcgagtcttcaaagagaaggtggacactagaacaccaaagcccatgccgggtaccaggaaagttatggaaatcactgctgagtggctgtggcggacattgggccgcaataagagacctaggctctgcacccgagaggaatttactaagaaggtgcggactaacgccgcaatgggggccgtcttcaccgaggaaaatcaatgggatagcgctcgtgccgcggtggaggacgaagagttttggaaactggtagatagagagcgcgaactacacaaacttggaaaatgtggctcatgcgtttacaacatgatgggtaagagggagaagaaactgggggagttcggaaaggcaaaaggctcccgggccatttggtacatgtggctcggcgctagatatctggagtttgaggccttggggttcctgaatgaagaccattggtttagtcgcgagaacagctactctggagtggaaggtgagggcctccacaaacttgggtatatcctgagggatatatccaaaatccccggaggcgcaatgtacgctgacgacacggccggttgggatacccgaattacagaagacgatttacataatgaggagaagatcactcagcagatggacccagaacaccggcagctggctaacgccattttcaagttgacctatcaaaataaagtcgtgaaggtgcagagacctacacccaaagggactgtcatggatatcatatcaaggaaggaccagcgcggaagcggccaggttggcacctacgggctcaacacgtttacaaatatggaggcacaactgattcgtcagatggaaggagagggtgtgctatcgaaaaccgatcttgaaaacccacatctgctcgagaagaagatcactcagtggctggagacaaaaggcgtagaacggttgaagagaatggcgatctctggggacgattgcgtggtcaaacccattgacgataggttcgccaatgctttactggccctcaacgacatgggaaaggtgcgcaaagatatacctcagtggcaaccaagtaagggctggcacgactggcagcaggttccgttctgttcccaccattttcacgagcttatcatgaaggacggtcgaaaactggtggtcccctgccggagccaggatgaactaattgggagagcaaggatctcacaaggagctggctggtccctgaaggagaccgcctgtctcggcaaagcatatgcccagatgtgggcgttgatgtacttccatcgcagagacctgcggcttgcttctaacgccatttgcagcgcagtgcctgtacactgggttccaacaagtaggaccacatggtccatccacgcccatcaccagtggatgacgaccgaagatatgctgactgtgtggaatcgtgtctggatagaggacaacccctggatggaggataagacacctgtgaccacttgggaagacgttccatacctcgggaaacgagaggatcaatggtgtggcagcttaatcggtctgacatctcgcgctacctgggcccagaatattttgacggcaatccaacaggtgagatcactgattggcaacgaagagtttctcgactatatgcccagtatgaagcggttcaggaaggaggaagagtccgaaggggctatctggtga

SEQ ID NO: 15081 - RNA, 9873 nt, synthetic construct
  misc_feature 1..9873: note = derived and/or modified CDS sequence (opt3) from DENV-3__AB189126__SS-prME
  source 1..9873: mol_type = other RNA
accagcctgtgcctcatgatgatgcttcccgcaacactggctttccacttgacttccagagacggagagcctaggatgatcgtggggaagaacgaacggggaaagtctttactgtttaagacggcatcaggtattaatatgtgtaccctgatagccatggatctcggcgagatgtgcgacgatacagtcacttacaagtgtccactgatcaccgaagttgagccggaagacattgattgctggtgtaaccttacaagtacctgggtgacttatgggacatgcaatcaggcgggagagcaccgccgagacaagcgtagcgtagctctggcaccccacgtgggcatgggtttggataccagagcacagacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagctgatcgagggaaaagtggtccagcacgaaaatctcaagtatacagtgataattactgttcataccggtgaccagcaccaggtgggcaacgagacacaaggggtcaccgcagaaatcactccccaggcttccacggtggaggccattcttcctgaatacggaacactgggcttggagtgctctccacgaaccggtctagactttaatgagatgatcctgctcactatgaaaaacaaggcgtggatggtacatagacagtggttctttgatctgccgcttccctggaccagcggggccacaaccgaaactcctacatggaataaaaaggagctgttggttacgttcaaaaacgcacacgctaagaagcaagaagtggtcgtgctcggctcccaggagggagccatgcacaccgctctgactggcgccacagaaatccagacctcagggggaacaagtatttttgcaggtcatttaaaatgtaggctgaagatggacaaactagagctcaagggcatgagctatgccatgtgctctaatgctttcgtcctgaaaaaggaggtgtccgaaactcagcacgggaccatacttatcaaggttgagtacaaaggagaagatgcgccatgtaagattcccttctcaacggaggacggccaaggtaaagcacataacgggcggttgatcaccgccaaccctgtggtaacaaagaaagaggaaccagtcaatatagaggctgaacccccgtttggcgagagcaacattatcatcggaattggcgataaggccctgaagatcaattggtacaaaaaggggagttctattggaaaaatgttcgaagcaactgcccgtggtgctcgcagaatggccatactcggcgacaccgcatgggattttgggtccgtgggaggcgttctgaacagccttggtaagatggtgcaccagatcttcgggtcggcgtatacagctctgttttctggcgtctcctggattatgaaaatcggaatcggcgtgttgctcacttggattgggctaaattcaaagaacaccagtatgagcttctcctgcatagtaatcggaattatcacgttatacctgggcgccgtggttcaggcagacatgggttgtgtcattaattggaaggggaaagagctaaagtgcggatctggcatctttgtgacaaacgaggtgcatacctggactgaacagtataaattccaagccgatagccctaagaggctcgctacagccatagccggtgcttgggagaatggcgtctgtgggatccggtcaaccactcgaatggaaaacctgctttggaaacagattgccaatgagttgaactacatcctgtgggaaaataacattaagctcaccgttgtggtgggagacatcataggcgtactggagcaggggaaacgcacattaacgccccagccaatggagctgaagtatagttggaagacctggggaaaagcgaaggtcgtgactgccgaaattcaaaattccagctttatcattgatggccctaacacacccgagtgcccaaacgcttctagagcatggaatgtttgggaagtggaggactacggtttcggggtctttaccacaaacatctggcttaaattgagggaaatgtatactcagctctgtgaccaccggctgatgtcagccgctgtgaaggatgagcgcgccgttcacgcagacatgggatactggatagagagtcagaaaaatggcagctggaagctagaaaaggcgtccctgatcgaggtgaaaacctgcacgtggcccaagtctcatacactctggtcgaacggtgtactggaaagcgatatgattatccctaaatcccttgccggcccaatttcacagcacaattacagaccggggtatcatacccaaactgctggaccctggcacttgggcaagctggagttagacttcaactactgcgaggggaccacagtcgtgatcactgaaaattgtggaaccaggggccctagtctccgtacaacgaccgtgtctggtaaactgatacacgagtggtgctgtcggagctgcactcttccacccctgcgatatatgggggaagatggatgttggtacggcatggagattagacctatcaacgaaaaggaggagaatatggtcaagtccttggtttcagccggtagcggcaaagtggacaactttacaatgggggtactctgcctggcaatcctattcgaagaggtgatgaggggaaagttcggcaaaaagcatatgattgctgggatcctgtttattttcgtcctcctgctttctggacagataacctggcgcgatatggcccggactttgatcatgattggctccaatgcaagtgacagaatgggtatgggggtgacatatctggccttaatcgctacctttaaaattcagccattcctcgcgctgggatttttccttaggaagctgacgagccgcgaaaacctactcctgggcgttggcttggccatggcaactaccctgcaattacccgaggatatcgaacagatggctaatgggatagccctcggactgatggcccttaagctgatcacacagtttgagacctaccagttgtggactgctctcgtgtctctgacatgttccaacaccattttcacactaactgtcgcatggcgaaccgccacgctgatccttgcgggtatttcactcctgccggtgtgccaaagtagctcgatgcggaaaacagactggttgcctatgaccgttgctgccatgggcgtgccacccctgcctttatttatcttctccctcaaggatactctgaaacgtagatcttggccccttaatgagggggtcatggcagtaggactggtgagcatattggcctcaagtctcctgaggaacgacgttccaatggctggccctctagtggccggtgggctgcttattgcctgttatgtcatcaccggaacatccgcggatctcactgtggaaaaggctgccgacgtaacctgggaggaagaggcagaacagacgggcgtgtctcacaacctgatgatcacagtcgacgatgacggcaccatgcgcattaaagatgacgagactgagaatatattgacagttttactgaagaccgccctcctgatcgtgagcgggatttttccctactccatcccagctactcttctggtgtggcatacatggcagaaacagacccaacggtcaggagtcttgtgggatgtgccgagccctcccgaaacgcagaaggccgagctagaagagggtgtttacagaattaagcagcagggcatcttcgggaaaactcaagtaggagtgggcgtccagaaggagggtgtgtttcacaccatgtggcatgttacaagaggggcagtgctgacctataacggaaaacgactcgaaccaaattgggctagtgtcaagaaagacctgatatcttacggcggcgggtggcgcctttccgcccagtggcaaaagggagaggaagtgcaggtaatcgcggtcgagcccggtaagaaccctaaaaatttccagacaatgccaggcattttccagactaccacgggggaaatcggagccattgcattagattttaagcccggcacaagcggttcgcctatcataaaccgggaggggaaagtggttggactgtatggcaatggcgtggtcactaagaacgggggatacgtgtcaggtattgctcaaaccaatgccgagccggacggcccaacacccgaactcgaggaagagatgttcaaaaagagaaacttgaccatcatggatctgcaccctgggtctggaaagactaggaaatatctcccagctatcgttcgtgaagcaattaagcgccggctgagaacccttatcctggcccccacaagggtggtcgccgctgagatggaggaagcgttgaaaggcctacctatacgataccagacgactgcaaccaagagtgagcacacaggtaaagaaattgtggacctgatgtgccatgccacctttactatgcggctcttatccccggtacgcgtgcccaattataacctgatcattatggatgaggctcacttcacagacccagccagcatcgcagccagagggtacatatctaccagggttggaatgggcgaagctgcggccatttttatgacggcaactcctcccggcacagctgatgccttcccacagagcaatgcacctatccaggacgaggagcgggacatccccgaacgatcctggaactcagggaatgattggattaccgactttgccggaaagaccgtctggttcgtgccaagtatcaaggctggtaacgatattgccaactgtcttaggaagaatggcaagaaagtgatacaactgagccgcaagacttttgacacagagtaccagaaaaccaagctcaacgattgggacttcgtcgtaacaactgatatctctgaaatgggggcgaattttaaggcagacagggtgattgatccgcgtcggtgcttgaaacctgttatcctgacggacggacccgagagagtgatcctcgccggcccaatgcccgtcaccgtggcttccgccgctcagaggcgcggtcgagttgggagaaaccctcagaaggagaatgatcaatatattttcacaggccagccactgaacaatgacgaagaccatgcacactggactgaggccaaaatgcttctagataacataaatacccccgaaggaatcattcctgctctgttcgagccggaacgggagaagtcagccgcaatcgacggcgagtacaggttgaaaggggaaagtcgcaagacatttgtggagttaatgcgtagaggagatctgccagtctggctcgcgcataaagtggccagcgaaggtattaagtataccgaccggaagtggtgcttcgatggcgagaggaacaatcagatcctggaagagaacatggacgtagagatatggactaaagaaggggagaagaagaaacttcgcccccgatggctggatgctagaacgtactccgaccctctcgccttgaaagaatttaaagatttcgcagctggacggaagtctatcgccctggacctagtgaccgagattggcagggttccctcgcacctggcacaccgcacaagaaatgccctcgataaccttgtcatgctgcatactagcgaacacggtgggagggcttatcggcatgcggtggaggagttaccagaaaccatggagacattgctgctcctgggccttatgatcctgctcaccggaggcgccatgttgtttctgatttcagggaaaggagtgggtaagacttccatcggcttaatatgtgtcgttgcaagttctgggatgctatggatggctgacattcctctgcagtggatcgccagcgccattgtgctcgagttctttatgatggtacttctgatccccgagccagagaaacaacgtacacctcaggataatcagttggcatacgtggtcataggaatcctgacgctcgctgccattgtggcggctaacgaaatgggcctgcttgagaccactaagcgcgacctcggtatgtccaaagaaccgggggttgtgcccccaacatcatatctggacgtcgatttgcaccctgcctctgcatggaccctgtacgccgtagctaccacagtgatcactcccatgttacgacacacgattgagaatagcaccgcaaacgttagtctagccgcgatcgctaaccaagccgtggtcctgatgggcctcgacaagggatggccaatatccaagatggatcttggcgtgcctctgttggcactggggtgctacagccaggtcaatcccctcacactgactgccgctgtgcttttactggttacccattatgccattatcggaccgggcctccaggcaaaagctacaagagaagcccagaagaggaccgcggccggtatcatgaaaaacccaactgtggacgggattatgacgatcgatttggaccctgtaatatacgattctaagttcgagaaacaactgggacaggtgatgctactggtcctctgtgcagttcagcttctgttgatgcggacatcatgggctttttgcgaggccctgaccctcgcaactggccccattaccacactgtgggaaggttccccaggcaagttctggaatactaccatcgctgtgagtatggccaacatttttcgcgggagctatttagccggagcgggccttgctttctcgatcatgaagtctgtcgggacaggaaaaagaggcacgggttcccagggggagaccctgggagaaaagtggaaaaagaaactcaatcaactaagcaggaaggagtttgacctgtacaaaaagtcaggcataactgaagtggatcggacagaggcaaaggagggtttgaaacgaggcgaaatcacccaccatgccgtaagtagagggtctgctaagctgcagtggttcgtggagcgcaacatggttattcccgaaggaagggtgatcgacctcggctgtgggcggggaggctggtcctattactgcgccggtcttaaaaaggtcactgaggtgcgtgggtatacaaaaggaggccctggccacgaagaaccggtccccatgagcacctacgggtggaatattgtgaagctgatgtcaggaaaggatgttttctacttgccacctgagaaatgtgacacgctgctctgcgatatcggtgaaagtagcccctcccctaccgtagaggaatctagaacaattagggtgttaaagatggtcgagccatggctgaaaaacaatcagttttgtatcaaggtgcttaacccctatatgcctactgttatagagcatctggaacgcctacagcggaaacacggcgggatgctcgtgcgaaatccactgagcagaaactccacccacgagatgtactggatttcaaatggaacaggcaacatcgtctctagtgtgaatatggtatcgaggttgctgctcaaccgcttcactatgacccatcggagacccacaatcgaaaaggacgtggaccttggtgcagggacccgtcacgttaacgccgagccggaaactcctaatatggatgtcattggagagaggatacggcgcatcaaggaggaacatagctccacgtggcactatgacgatgagaacccatacaaaacatgggcttatcacggctcttacgaagtgaaggcgaccggctcagccagctccatgattaatggggtggtcaaactgttaactaagccctgggacgttgtgcctaccgtaacacaaatggcaatgacggataccactccatttggacagcagcgagtgttcaaagagaaggtcgacacaagaacccccaagccgatgcctggtactaggaaagtgatggaaatcacagctgagtggctgtggcggaccttgggccgcaacaagagacccaggctctgcacacgagaggaatttactaaaaaggttcggaccaatgccgcaatgggggccgtgttcacggaggaaaaccaatgggatagtgctcgtgccgcggtcgaggacgaagagttttggaaactggtggatagagagcgcgaactacataaacttggaaaatgtggctcttgcgtatataatatgatgggtaagagggagaagaaactgggggagttcggaaaggcaaaaggcagccgggccatttggtacatgtggctcggcgctagatacctggagtttgaggccttggggttcctgaacgaagaccactggttttcacgcgaaaattcctatagtggagttgaaggtgagggcctccataaacttgggtacatcctgagggatataagcaaaatcccaggaggcgcaatgtatgctgacgacaccgccggttgggatacacgaattactgaagacgatttacacaacgaggagaagatcacccagcagatggaccctgaacatcggcagctggctaatgccattttcaagttgacataccaaaacaaagtggtcaaggtgcagagacccactccaaaagggaccgtgatggatatcatatctaggaaggaccagcgcggatccggccaggtcggcacgtatgggctcaatacatttaccaacatggaggcacaactgattcgtcagatggaaggagagggtgttctatcaaaaactgatcttgaaaatccccatctgctcgagaagaagatcacacagtggctggagaccaaaggcgtggaacggttgaagagaatggcgatcagcggggacgattgcgtagtgaaacctattgacgataggttcgccaacgctttactggccctcaacgacatgggaaaggtccgcaaagatataccacagtggcaaccgtcgaagggctggcacgactggcaacaggtgcccttctgttctcatcactttcatgagcttatcatgaaggacggtcgaaaactggttgtgccttgccggccacaggatgaactaattgggagagcaaggatcagtcaaggagctggctggtccctgaaggagactgcctgtctcggcaaagcatacgcccagatgtgggcgttgatgtatttccaccgcagagacctgcggcttgctagcaatgccatttgctcagcagtccccgtgcactgggtacctacctccaggacaacgtggtctatccatgcccaccatcagtggatgaccactgaagatatgctgacagtttggaaccgtgtgtggatagaggacaatccatggatggaggataagacccccgtcactacatgggaagacgtgccttacctcgggaaacgagaggatcaatggtgtggcagcttaatcggtctgaccagtcgcgctacgtgggcccagaacattttgacagcaatccagcaggttagatccctgattggcaatgaagagtttctcgactacatgccgagcatgaagcggttcaggaaggaggaggaacttgaaggggctatctggtga

SEQ ID NO: 15082 - RNA, 9873 nt, synthetic construct
  misc_feature 1..9873: note = derived and/or modified CDS sequence (opt3) from DENV-3__AB189127__SS-prME
  source 1..9873: mol_type = other RNA
accagcctgtgcctcatgatgatgcttcccgcaactctggctttccacttgacttccagagacggcgagcctaggatgatcgtggggaagaacgaacggggaaagtctttactgtttaagacggcatcaggtattaatatgtgtaccctgatagccatggatctcggcgagatgtgcgacgatacagtcacttacaagtgtccactgatcaccgaagttgagccggaagacattgattgctggtgtaaccttacaagtacctgggtgacttatgggacatgcaatcaggcgggagagcaccgccgagacaagcgtagcgtagctctggcaccccacgtgggcatgggtttggataccagagcacagacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagctgatcgagggaaaagtggtccagcacgaaaatctcaagtatacagtgataattactgttcataccggtgaccagcaccaggtgggcaacgagacacaaggggtcaccgcagaaatcactccccaggcttccacggtggaggccattcttcctgaatacggaacactgggcttggagtgctctccacgaaccggtctagactttaatgagatgatcctgctcactatgaaaaacaaggcgtggatggtacatagacagtggttctttgatctgccgcttccctggaccagcggggccacaaccgaaactcctacatggaataaaaaggagctgttggttacgttcaaaaacgcacacgctaagaagcaagaagtggtcgtgctcggctcccaggagggagccatgcacaccgctctgactggcgccacagaaatccagacctcagggggaacaagtatttttgcaggtcatttaaaatgtaggctgaagatggacaaactagagctcaagggcatgagctatgccatgtgctctaatgctttcgtcctgaaaaaggaggtgtccgaaactcagcacgggaccatacttatcaaggttgagtacaaaggagaagatgcgccatgtaagattcccttctcaacggaggacggccaaggtaaagcacataacgggcggttgatcaccgccaaccctgtggtaacaaagaaagaggaaccagtcaatatagaggctgaacccccgtttggcgagagcaacattatcatcggaattggcgataaggccctgaagatcaattggtacaaaaaggggagttctattggaaaaatgttcgaagcaactgcccgtggtgctcgcagaatggccatactcggcgacaccgcatgggattttgggtccgtgggaggcgttctgaacagccttggtaagatggtgcaccagatcttcgggtcggcgtatacagctctgttttctggcgtctcctggattatgaaaatcggaatcggcgtgttgctcacttggattgggctaaattcaaagaacaccagtatgagcttctcctgcatagtaatcggaattatcacgttatacctgggcgccgtggttcaggcagacatgggttgtgtcattaattggaaggggaaagagctaaagtgcggatctggcatctttgtgacaaacgaggtgcatacctggactgaacagtataaattccaagccgatagccctaagaggctcgctacagccatagccggtgcttgggagaatggcgtctgtgggatccggtcaaccactcgaatggaaaacctgctttggaaacagattgccaatgagttgaactacatcctgtgggaaaataacattaagctcaccgttgtggtgggagacatcataggcgtactggagcaggggaaacgcacattaacgccccagccaatggagctgaagtatagttggaagacctggggaaaagcgaaggtcgtgactgccgaaattcaaaattccagctttatcattgatggccctaacacacccgagtgcccaaacgcttctagagcatggaatgtttgggaagtggaggactacggtttcggggtctttaccacaaacatctggcttaaattgagggaaatgtatactcagctctgtgaccaccggctgatgtcagccgctgtgaaggatgagcgcgccatacacgcagacatgggatactggatcgagagtcagaaaaatggcagctggaagctagaaaaggcgtccctgattgaggttaaaacctgcacgtggcccaagtctcatacactctggtcgaacggtgtgctggaaagcgatatgatcattcctaaatcccttgccggcccaatctcacagcacaattacagaccggggtatcatacccaaactgctggaccctggcacttgggcaagctggagttagacttcaactactgcgaggggaccacagtagtcataactgaaaattgtggaaccaggggccctagtctccgtacaacgaccgtgtctggtaaactgattcacgagtggtgctgtcggagctgcactcttccacccctgcgatatatgggggaagatggatgttggtacggcatggagatcagacctatcaacgaaaaggaggagaatatggtgaagtccttggtctcagccggtagcggcaaagttgacaactttacaatgggggtgctctgcctggcaattctattcgaagaggtaatgaggggaaagttcggcaaaaagcatatgatcgctgggattctgtttatgttcgtgctcctgctttctggacagataacctggcgcgatatggcccggactttgatcatgattggctccaatgcaagtgacagaatgggtatgggggtcacatatctggccttaatcgctacctttaaaattcagccattcctcgcgctgggatttttccttaggaagctgacgagccgcgaaaacctactcctgggcgtgggcttggccatggcaactaccctgcaattacccgaggatatcgaacagatggctaatgggatagccctcggactgatggcccttaagctgatcacacagtttgagacctaccagttgtggactgctctcgtttctctgacatgttccaacaccattttcacactaactgtggcatggcgaaccgccacgctgatccttgcgggtatttcactcctgccggtctgccaaagtagctcgatgcggaaaacagactggttgcctatgaccgtggctgccatgggcgttccacccctgcctttatttatcttctccctcaaggatactctgaaacgtagatcttggccccttaatgagggggtgatggcagtcggactggtaagcatattggcctcaagtctcctgaggaacgacgtgccaatggctggccctctagttgccggtgggctgcttattgcctgttatgtgatcaccggaacatccgcggatctcactgtcgaaaaggctgccgacgtgacctgggaggaagaggcagaacagacgggcgtatctcacaacctgatgatcacagtggacgatgacggcaccatgcgcattaaagatgacgagactgagaatatattgacagtcttactgaagaccgccctcctgatcgttagcgggatttttccctactccatcccagctactcttctggtgtggcatacatggcagaaacagacccaacggtcaggagtgttgtgggatgtcccgagccctcccgaaacgcagaaggccgagctagaagagggtgtgtacagaattaagcagcagggcatcttcgggaaaactcaagttggagtaggcgtgcagaaggagggtgtctttcacaccatgtggcatgtgacaagaggggcagttctgacctataacggaaaacgactcgaaccaagttgggcttctgtgaagaaagacctgatatcctacggcggcgggtggcgccttagcgcccagtggcaaaagggagaggaagtccaggtgatcgcggtagagcccggtaagaatcctaaaaacttccagacaatgccaggcattttccagactaccacgggggaaatcggagccattgcattagattttaagcccggcacatcgggttcacctatcataaatcgggaggggaaagtcgtgggactgtatggcaacggcgttgtgactaagaatgggggatacgtctctggtattgctcaaaccaacgccgagccggacggcccaacacccgaactcgaggaagagatgttcaaaaagagaaatttgaccatcatggatctgcaccctgggagtggaaagactaggaaatatctcccagctatcgtgcgtgaagcaattaagcgccggctgagaacccttatcctggcccccacaagggttgtggccgctgagatggaggaagcgttgaaaggcctacctatacgataccagacgactgcaaccaagtccgagcacacaggtaaagaaattgtcgacctgatgtgccatgccacctttactatgcggctcttaagcccggtgcgcgtacccaactataatctgatcattatggatgaggctcacttcacagacccagcctctatcgcagccagagggtacataagcaccagggtgggaatgggcgaagctgcggccatttttatgacggcaactcctcccggcacagctgatgccttcccacagtccaacgcacctatccaggacgaggagcgggacatccccgaacgatcatggaatagtgggaacgattggattaccgactttgccggaaagaccgtttggttcgtcccaagcatcaaggctggtaatgatattgccaactgtcttaggaagaacggcaagaaagtgatacaactgtctcgcaagacttttgacacagagtaccagaaaaccaagctcaatgattgggacttcgtggtcacaactgatatctccgaaatgggggcgaactttaaggcagacagggtaattgatccgcgtcggtgcttgaaacctgtgatcctgacggacggacccgagagagttatcctcgccggcccaatgcccgtgaccgtcgcttcagccgctcagaggcgcggtcgagtggggagaaatcctcagaaggagaacgatcaatatattttcacaggccagccactgaataacgacgaagaccatgcacactggactgaggccaaaatgcttctagataatataaacacccccgaaggaatcattcctgctctgttcgagccggaacgggagaagagtgccgcaatcgacggcgagtacaggttgaaaggggaaagccgcaagacatttgttgagttaatgcgtagaggagatctgccagtgtggctcgcgcataaagtcgcctccgaaggtattaagtataccgaccggaagtggtgcttcgatggcgagaggaataaccagatcctggaagagaatatggacgtggagatatggactaaagaaggggagaagaagaaacttcgcccccgatggctggatgctagaacgtactctgaccctctcgccttgaaagaatttaaagatttcgcagctggacggaagtcgatcgccctggacctagtaaccgagattggcagggtgcccagccacctggcacaccgcacaagaaacgccctcgataatcttgttatgctgcatacttcagaacacggtgggagggcttatcggcatgcggtcgaggagttaccagaaaccatggagacattgctgctcctgggccttatgatcctgctcaccggaggcgccatgttgtttctgatttccgggaaaggagtgggtaagacaagtatcggcttaatatgtgtggtcgcatctagcgggatgctatggatggctgacattcctctgcagtggatcgcctccgccattgttctcgagttctttatgatggtgcttctgatccccgagccagagaaacaacgtacacctcaggataaccagttggcatacgtagtgataggaatcctgacgctcgctgccattgtcgcggctaatgaaatgggcctgcttgagaccactaagcgcgacctcggtatgtcaaaagaaccgggggtggttcccccaacatcttatctggacgtggatttgcaccctgccagcgcatggaccctgtacgccgtcgctaccacagtaatcactcccatgttacgacacacgattgagaacagtaccgcaaatgtgtccctagccgcgatcgctaaccaagccgttgtgctgatgggcctcgacaagggatggccaataagcaagatggatcttggcgtccctctgttggcactggggtgctactctcaggtgaaccccctcacactgactgccgctgtccttttactggtgacccattatgccattatcggaccgggcctccaggcaaaagctacaagagaagcccagaagaggaccgcggccggtatcatgaaaaatccaactgttgacgggattatgacgatcgatttggaccctgtgatatacgattcaaagttcgagaaacaactgggacaggtaatgctactggtgctctgtgcagtccagcttctgttgatgcggacatcctgggctttttgcgaggccctgaccctcgcaactggccccattaccacactgtgggaaggtagtccaggcaagttctggaacactaccatcgctgttagcatggccaatatttttcgcgggtcgtatttagccggagcgggccttgctttctctatcatgaagtccgtggggacaggaaaaagaggcacgggtagccagggggagaccctgggagaaaagtggaaaaagaaactcaaccaactatcaaggaaggagtttgacctgtacaaaaagagtggcataactgaagtcgatcggacagaggcaaaggagggtttgaaacgaggcgaaatcacccaccatgccgtgtctagagggtccgctaagctgcagtggttcgtagagcgcaatatggtgattcccgaaggaagggttatcgacctcggctgtgggcggggaggctggagctattactgcgccggtcttaaaaaggtgactgaggtccgtgggtatacaaaaggaggccctggccacgaagaaccggtgcccatgtcaacctacgggtggaacattgtcaagctgatgagtggaaaggatgtgttctacttgccacctgagaaatgtgacacgctgctctgcgatatcggtgaaagctccccctctcctaccgttgaggaaagcagaacaattagggtattaaagatggtggagccatggctgaaaaataaccagttttgtatcaaggtccttaatccctatatgcctactgtgatagagcatctggaacgcctacagcggaaacacggcgggatgctcgttcgaaacccactgtccagaaattcaacccacgagatgtactggatttctaacggaacaggcaatatcgtgagttcggtcaacatggtgagcaggttgctgctcaatcgcttcactatgacccatcggagacccacaatcgaaaaggacgtagaccttggtgcagggacccgtcacgtgaacgccgagccggaaactcctaacatggatgttattggagagaggatacggcgcatcaaggaggaacattcctctacgtggcactatgacgatgagaatccatacaaaacatgggcttatcacggctcatacgaagtcaaggcgaccggcagcgcctccagtatgattaacggggtggtgaaactgttaactaagccctgggacgtcgttcctaccgtgacacaaatggcaatgacggataccactccatttggacagcagcgagtattcaaagagaaggtggacacaagaacccccaagccgatgcctggtactaggaaagtcatggaaatcacagctgagtggctgtggcggaccttgggccgcaataagagacccaggctctgcacacgagaggaatttactaaaaaggtgcggaccaacgccgcaatgggggccgttttcacggaggaaaatcaatgggattctgctcgtgccgcggtggaggacgaagagttttggaaactggtcgatagagagcgcgaactacataaacttggaaaatgtggcagctgcgtgtataacatgatgggtaagagggagaagaaactgggggagttcggaaaggcaaaaggctcacgggccatttggtacatgtggctcggcgctagatacctggagtttgaggccttggggttcctgaatgaagaccactggttttcccgcgagaacagttatagcggagtagaaggtgagggcctccataaacttgggtacatcctgagggatatatctaaaatcccaggaggcgcaatgtatgctgacgacaccgccggttgggatacacgaattactgaagacgatttacacaatgaggagaagatcacccagcagatggaccctgaacatcggcagctggctaacgccattttcaagttgacataccaaaataaagttgtgaaggtccagagacccactccaaaagggaccgtgatggatatcatatccaggaaggaccagcgcggatcaggccaggtgggcacgtatgggctcaacacatttaccaatatggaggcacaactgattcgtcagatggaaggagagggtgtcctaagcaaaactgatcttgaaaacccccatctgctcgagaagaagatcacacagtggctggagaccaaaggcgttgaacggttgaagagaatggcgatctcgggggacgattgcgtggtaaaacctattgacgataggttcgccaatgctttactggccctcaacgacatgggaaaggtgcgcaaagatataccacagtggcaaccgtctaagggctggcacgactggcagcaggtccccttctgtagtcatcactttcatgagcttatcatgaaggacggtcgaaaactggtggttccttgccggccacaggatgaactaattgggagagcaaggatctcccaaggagctggctggagcctgaaggagactgcctgtctcggcaaagcatacgcccagatgtgggcgttgatgtatttccaccgcagagacctgcggcttgcttcaaacgccatttgctccgcagtgcccgtccactgggtgcctacctctaggacaacgtggagcatccatgcccaccatcagtggatgaccactgaagatatgctgacagtatggaatcgtgtttggatagaggacaacccatggatggaggataagacccccgtgactacatgggaagacgtcccttacctcgggaaacgagaggatcaatggtgtggaagtttaatcggtctgacctcccgcgctacgtgggcccagaatattttgacagcaatccaacaggtgagaagcctgattggcaacgaagagtttctcgactacatgccgtctatgaagcggttcaggaaggaggaagaacttgaaggggctatctggtga

SEQ ID NO: 15083 - RNA, 9873 nt, synthetic construct
  misc_feature 1..9873: note = derived and/or modified CDS sequence (opt3) from DENV-3__AB189128__SS-prME
  source 1..9873: mol_type = other RNA
accagcctgtgcctcatgatgatccttcccgccactctggctttccacttgacttccagagacggagaacctaggatgattgtggggaagaacgaacggggaaaatctttactgtttaagacggcctcaggtattaatatgtgtaccctgatcgccatggatctcggcgaaatgtgcgacgatacagtcacttacaaatgtccactgattaccgaagttgaaccggaagacatcgattgctggtgtaaccttacaagtacctgggtgacttatgggacatgcaatcaggcgggagaacaccgccgagacaagcgtagcgtagctctggcaccccacgtgggcatgggtttggataccagaacgcagacttggatgtccgcagagggggcctggaggcaggtcgaaaaagtggagacctgggctttccggcatcctggatttacagttctcgcactgttcctggcccactttattggcacttctctcacccagaaggtggtcatcttcatattactgatgcttgtgacaccatcgatgaccatgcgctgtgtaggcgttgggaacagagactttgtggaaggattgtcaggtgctacgtgggtcgatgtggtgctggagcatggcgggtgcgtcactacaatggccaagaataaacccaccctagacatcgagctccagaagactgaagcgacacaactggcaacccttaggaaactgtgtattgagggaaagatcacgaacgttaccacagatagccggtgccctactcagggcgaagccattttgccagaggaacaggaccagaattacgtgtgtaaacacacctatgtagatcgcggttgggggaacggatgcggcctcttcggcaaggggagtctggtgacatgcgctaagtttcaatgtttagagtccatcgagggaaaagtcgtgcagcacgaaaatctgaagtacactgttataattaccgtgcatacaggtgaccagcaccaggtcggcaacgagacccaaggggtgactgccgaaatcacgccccaggcatctacagtagaggctattctccctgaatatggaacccttggcctggagtgcagcccacgaactggtttggacttcaatgagatgatcctactgaccatgaaaaacaaggcctggatggttcatagacagtggtttttcgatctcccgctgccctggacatccggggcgaccactgaaacacctacgtggaataaaaaggagcttctggtgacctttaaaaacgcccacgcaaagaagcaagaagtcgtggtcttgggctcacaggagggagctatgcacactgccctcacaggcgctaccgaaatccagacaagtgggggaactagcattttcgccggtcatctgaaatgtaggttaaagatggacaaactggagctaaagggcatgtcttacgcaatgtgcctcaatgccttcgtgctgaaaaaggaggtttccgaaacccagcacgggacgatacttatcaaggtggagtataaaggagaagatgctccatgtaagattcccttttcaaccgaggacggccaaggtaaagcgcataacgggcggttgatcacagcaaaccctgtagtcactaagaaagaggaaccagtgaatatagaggccgaacccccgttcggcgagagcaacattgttatcggaatcggcgataaggctctgaagattaattggtacaaaaaggggagttctatcggaaaaatgtttgaagccaccgcacgtggtgcccgcagaatggctattctcggcgacacagcctgggatttcgggtccgtgggaggcgtcctgaacagccttggtaagatggtgcaccagatatttgggtcggcatacactgcgctgttctctggcgtatcctggatcatgaaaattggaatcggcgtgttgctcacctggatcgggctaaattcaaagaacacgagtatgagcttttcctgcattgttataggaatcattacattatatctgggcgctgtcgtgcaggccgacaccggttgtgtgatcaattggaaggggaaagagctaaagtgcggatctggcattttcgtcactaacgaggttcatacatggaccgaacagtacaaatttcaagcagatagccctaagaggctcgccactgctatcgccggtgcatgggagaatggcgtgtgtgggatacggtcaaccacacgaatggaaaacctgctttggaaacagatcgctaatgagttgaactatattctgtgggaaaataacatcaagctcacggtggtagtcggagacattatcggcgtgctggagcaggggaaacgcaccttaactccccagccaacagagctgaagtacagttggaagacctggggaaaagccaagatagttacagcggaaactcaaaattccagcttcattatcgatggccctaacacccccgagtgcccatctgcctcaagagcttggaacgtgtgggaagtcgaggaatatggttttggggtgttcacgacaaatatttggcttaaattgagggagatgtacacccagctctgtgaccaccggctgatgagtgcagccgttaaggacgagcgcgctgtgcacgccgatatgggatattggatcgaaagccagaaaaacggctcctggaagctagagaaggcatctctgatagaagtaaaaacttgcacctggcccaagtcgcatacactctggagcaatggtgtcctggagtccgacatgatcattcctaaatcacttgcgggcccaatcagtcagcacaactacagaccggggtaccatactcaaaccgccggaccctggcacttgggcaagctggagttagattttaattattgcgaagggacaacggtggtgattaccgagaactgtggaactaggggcccttctctccgtacaaccactgtcagcggtaaactgatccacgaatggtgctgtcggtcctgcacacttccacccctgcgatacatgggggaggacggatgttggtatggcatggaaataagacctattaatgagaaggaggaaaacatggttaagtcattggtgagcgctggttctggcaaagtagataatttcaccatgggggtgctctgcctggccatcctattcgaggaagtcatgaggggaaagtttggcaaaaagcatatgatcgcaggggtgctgttcacgtttgttctcctgctttccggacagattacttggcgcgacatggctcggaccttgatcatgattggcagtaacgccagcgatagaatgggtatgggggtgacatacctggcattaatagccaccttcaaaatccagccatttctcgctctgggattctttcttaggaagctgacttctcgcgagaatctactcctgggcgtcggcttggcgatggccacaaccctgcaattacccgaagacattgagcagatggcaaacgggatcgctctcggactgatggcccttaagctgattacacagttcgagacttatcagttgtggaccgccctcgtgtccctgatgtgttcaaatacgatctttacactaaccgttgcttggcgaactgcaaccctgatacttgccggtatcagtctcctgccggtgtgccaaagctcgtccatgcggaaaacagattggttgcctatgactgtcgcggctatgggcgtaccacccctgcctttattcatattttctctcaaggacaccctgaaacgtagaagctggccccttaacgaaggggtgatggccgttggactggtgtcaatcttggcaagttccctcctgaggaatgatgtcccaatggccggccctctagtggctggtgggctgcttattgcatgttacgtaatcacgggaacatctgccgacctcaccgtggagaaggcggctaacgtcacttgggaagaggaagccgagcagacaggcgttagccacaacctgatgataaccgtggatgacgacggcactatgcgcattaaagatgacgagacagaaaatatcttgaccgtgttactgaagacggcactcctgatcgtctccgggattttcccctattcaataccagccactcttctggtgtggcatacctggcagaaacagacacaacggagcggagttttgtgggatgtaccgagtcctcccgagacccagaaggctgaactagaggacggtgtgtacagaatcaagcagcagggcatttttgggaaaacacaagtcggagtgggcgttcagaaggagggtgtgttccacactatgtggcatgtcaccagaggggccgtgctgacgcacaacggaaaacgactcgaaccaaattgggcatctgtaaagaaagatctgatctcctacggcggcgggtggcgccttagcgctcagtggcaaaagggagaggaagtccaggtgattgccgttgagcccggtaagaaccctaaaaatttccagacaatgccaggcatctttcagactaccacaggggaaataggagcgatcgccttagacttcaagcccggcacctcgggttcacctattatcaaccgggaggggaaagtggtcggactgtatggcaatggcgtggttactaagaacgggggatacgtgtctggtattgcacaaaccaatgctgagccggatggcccaacacccgaactcgaggaagagatgtttaaaaagagaaacttgacgatcatggacctgcaccctgggagtggaaagactaggaaatatctcccagccatagtccgtgaagctattaagcgccggctgagaacccttatcctggcacccacaagggtggtagccgccgagatggaggaggctttgaaaggcctacctatccgataccagaccactgcgacaaagtccgagcataccggtaaagaaattgtggatctgatgtgccacgcaacgttcactatgcggctcttaagcccggttcgcgtccccaattataacctgatcataatggacgaggcccattttacagatccagcttctattgccgcaagagggtacatcagcaccagggtgggaatgggcgaagccgctgcgattttcatgaccgccactcctcccggcacagcagacgcttttccacagtccaatgcccctatccaggatgaggagcgggacatacccgaacgatcatggaacagtgggaatgagtggattaccgacttcgcaggaaagacagtgtggtttgtcccaagcatcaaggccggtaacgatatcgctaactgtcttaggaagaatggcaagaaagtaattcaactgtctcgcaagactttcgacacggaatatcagaaaaccaagctcaacgattgggactttgtggttacaactgatatctccgagatgggggccaatttcaaggcggacagggtgattgatccgcgtcggtgcttgaaacctgtcatactgaccgacggacccgagagagtgatcctcgcaggcccaatgcccgttacagtggcctcagctgcccagaggcgcggtcgagtcgggagaaaccctcagaaggaaaatgatcaatacattttcaccggccagccactgaacaatgacgaggatcacgctcattggactgaagcaaaaatgcttctagacaacatcaatacgcccgagggaatcattcctgccctgtttgaaccggagcgggagaagagtgctgccatagacggcgaatacaggttgaaaggggagagccgcaagaccttcgtggaattaatgcgtagaggagatctgccagtatggctcgcacacaaagtggcgtccgagggtatcaagtatacagaccggaagtggtgctttgatggcgaaaggaacaatcagattctggaggagaacatggacgttgaaatctggactaaagagggggaaaagaagaaacttcgcccccgatggctggatgccagaacctactctgaccctctcgctttgaaagagttcaaagattttgccgcaggacggaagtcgattgctctggacctagtcacagaaatcggcagggtgcccagccacctggcccatcgcaccagaaatgcactcgataaccttgtgatgctgcacacttcagagcatggtgggagggcctatcggcacgctgtcgaggaattaccagagacaatggaaacgttgctgctcctgggccttatgatactgctcaccggaggcgcgatgttgttcctgatctccgggaaaggaattggtaagacaagtatcggcttaatttgtgttgtggcctctagcgggatgctatggatggcagacgtacctctgcagtggatcgcttccgccatagtgctcgagtttttcatgatggtccttctgattcccgagccagaaaaacaacgtacacctcaggataatcagttggcctacgtggttatcggcattctgaccctcgcagctatcgtggccgcgaacgagatgggcctgcttgaaaccacaaagcgcgacctcggtatgtcaaaagagccgggggtcgtatctcccataagctatctggatgtggacttgcacccagctagtgcctggactctgtacgcagttgccacgaccgtgatcacacctatgttacgacatactattgaaaattccaccgctaacgtcagcctagcagccatcgcgaaccaagctgtggtcctgatgggcctcgacaagggatggcccatttctaagatggatcttggcgtgccactgttggccctggggtgctattcacaggttaatcctctcacactgaccgcagccgtgcttttactggtaactcactacgctatcataggacccggcctccaggccaaagcaacgagagaggctcagaagaggacagccgcgggtattatgaaaaacccgaccgtggacgggatcatgactatcgatttggacccagtcatttacgattccaagtttgagaaacaactgggacaggttatgctactgatcctctgtgccgtgcagcttctgttgatgcggaccagttgggcattctgcgaagctctgacactcgccactggccctataaccacactgtgggagggtagccccggcaagttttggaatacgaccattgcagtctcgatggctaacatcttccgcgggtcttatttagccggagccggccttgcgttttccattatgaaaagcgtggggactggaaaaagaggcacaggttcacagggggaaaccctgggagagaagtggaaaaagaaactcaatcaactaagtaggaaggagttcgacctgtacaaaaagtctggcatcactgaggtagatcggacagaggctaaggaaggtttgaaacgaggcgagataacccatcacgcagtgtccagagggagcgccaagctgcagtggttcgttgaacgcaacatggtgatcccagagggaagggtcattgacctcggctgtgggcggggaggctggtcatattactgcgctggtcttaaaaaggtgacggaagtccgtgggtataccaaaggaggccccggccatgaggagcctgtgccgatgagtacatacgggtggaatatcgttaagctgatgagcggaaaggatgtattttatttgcccccagaaaaatgtgacactctgctctgcgatattggtgagtcctctcctagccccaccgtggaagagtccagaacaatcagggtcttaaagatggtggagccttggctgaaaaacaatcagttctgtattaaggttcttaacccatacatgcccactgtgatcgaacacctggagcgcctacagcggaaacacggcgggatgctcgtccgaaatcctctgtcaagaaactctacccatgaaatgtactggataagtaatggaacaggcaacattgtgtcgagcgtaaatatggtgtccaggttgctgctcaaccgctttaccatgactcaccggagaccaacgatcgagaaggacgttgatcttggtgccgggacacgtcatgtcaacgcagaacccgagaccccgaatatggacgtgatcggagagaggattcggcgcataaaggaagaacactcttcaacttggcactatgacgatgaaaacccttacaaaacctgggcctatcatggcagctacgaggtgaaggctacaggctccgcgagttctatgatcaatggggtcgttaaactgttaacgaagccatgggacgtggtacccaccgtgactcaaatggccatgacagataccactcctttcggacagcagcgagtctttaaagaaaaggtggacacaagaaccccaaggcccatgccgggtacacggaaggttatggagattactgcagagtggctgtggcgcaccttgggcagaaacaaaaggcctcgactctgcacgcgggaagagttcaccaagaaagtgcgtacaaatgctgccatgggggcagtctttactgaagagaaccaatgggatagcgccagagctgccgtggaagacgaggagttctggaagctggtagatcgcgaaagggagctacacaaacttggaaagtgtggctcatgcgtttataatatgatgggtaaacgggaaaagaagctgggggagtttggaaaagcgaagggctccagagcaatctggtacatgtggctcggcgcccgctatctggagttcgaggctttggggtttctgaacgaggaccattggttcagtagggaaaatagctactctggagtggagggtgaaggcctccacaaacttgggtacattctgcgagatatctccaagatacccggaggcgccatgtatgcagacgataccgctggttgggacacacggatcactgaggacgatttacataacgaggagaagattacccagcagatggacccagagcacagacagctggccaatgctatctttaagttgacgtaccaaaacaaggtcgtgaaagtgcagaggcctacacccaaggggaccgtcatggatattatctcacgcaaagaccagcgtggaagcggccaggttggcacttatgggctcaatacattcaccaacatggaagcccaactgatacggcagatggagggagaaggtgtgctatcgaaggcagatcttgagaatccacatctgctcgagaaaaagattactcagtggctggaagcggagggcgtagaaagattgaagaggatggccatctctggggacgattgcgtggtcaaacccatcgacgatcgcttcgctaacgccttactggcactcaacgacatgggaaaggtgcgaaaagatattcctcagtggcaaccaagtaagggctggcatgactggcagcaggttccgttttgttcccaccatttccacgagcttataatgaaagatggtcggaagctggtggtcccctgcagacctcaggacgaactaatcgggagggctcgcattagccaaggagccggctggtcactgaaggagaccgcatgtctcggcaaagcctacgcgcagatgtgggctttgatgtattttcacagacgggacctgaggcttgcctccaatgcaatctgctctgccgtgccagtacattgggttcccacaagccgtacgacctggagtattcacgctcatcaccagtggatgactacagaggatatgctgaccgtgtggaaccgagtctggatcgaagacaatccttggatggaggataagactccagtgacaacctgggaagacgttccctacctcgggaaacgcgaggatcaatggtgtggatccttaataggtcatacgagcagagccacatgggcacagaacatcctgaccgctattcaacaggtgcggtctttgatcggcaatgaggagttcctggactatatgccttcaatgaagaggtttcgcaaagaggaagagagtgaaggggccatttggtga

SEQ ID NO: 15084 - RNA, 9873 nt, synthetic construct
  misc_feature 1..9873: note = derived and/or modified CDS sequence (opt3) from DENV-3__AB214879__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggccccccacgtgggcatgggtttggataccagaacgcaaacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctagacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagtggtccagcacgaaaatctgaagtatactgtgataattaccgttcatacaggtgaccagcaccaggtgggcaacgagacccaaggggtcactgccgaaatcacgccccaggcatctacagtggaggctgtactccctgaatacggaacccttggcctggagtgcagcccacgaactggtttggactttaatgagatgattctactgaccatgaaaaacaaggcctggatggttcatagacagtggttctttgatctcccgctgccctggacatccggggcgaccactgaaacacctacgtggaataaaaaggagcttctggtgaccttcaaaaacgcccacgcaaagaagcaagaagtcgtggtcttgggctcacaggagggagctatgcacactgccctcacaggcgctaccgaaatccagacaagtgggggaactagcgtgtttgccggtcatctgaaatgtaggttaaagatggacaaactggagctaaagggcatgtcttatgcaatgtgctccaatgccttcgttctcaaaaaggaggtgtcagaaacccagcacgggacgatcctgattaaggtagagtacaaaggagaagatgctccatgtaagatacccttcagcaccgaggacggccaaggtaaagcgcataacgggcggcttatcacagcaaaccctgtcgtgactaagaaagaggaaccagttaatattgaggccgaacccccgtttggcgagagtaacatcataattggaatcggcgataaggctttgaagatcaattggtacaaaaaggggtcttccattggaaaaatgttcgaagccaccgcacgtggtgcccgcagaatggctatcctgggcgacacagcctgggattttgggagcgtgggaggcgtcctcaactcgctgggtaagatggtgcaccagattttcgggtctgcatatactgcgcttttttccggcgtatcatggataatgaaaatcggaattggcgtgctgttgacctggatcgggctcaatagtaagaacacgagcatgtccttctcttgcatcgttattggaataatcacactgtacttaggcgctgtcgtgcaggccgacatgggttgtgtgattaattggaaggggaaagagctgaagtgcggaagcggcatctttgtcaccaacgaggttcatacttggacagaacagtataaattccaagcagattcacctaagaggctagccaccgctattgccggtgcatgggagaatggcgtgtgtgggatccggagtactacccgaatggaaaacctcctgtggaaacagatagctaatgagcttaactacatcttgtgggaaaataacattaagctgacagtggtagtcggagacatcattggcgtgctcgagcaggggaaacgcacgctgaccccccagccaatggagttaaagtattcctggaagacttggggaaaagccaagatcgttacagcggaaacccaaaatagctcttttataattgatggccctaacacacccgagtgcccatcagccagtagagcttggaacgtgtgggaagtcgaggactacggtttcggggtgtttactaccaatatctggctgaaacttagggaaatgtatacgcagttgtgtgaccaccggctcatgagcgcagccgttaaggatgagcgcgctgtgcacgccgacatgggatactggattgagtcccagaaaaacggctcttggaagctggaaaaggcatcgctaatcgaggtaaaaacatgcacctggcccaagagccatactctgtggtccaatggtgtcctcgaatcagatatgataatccctaaaagtctggcgggcccaatttctcagcacaactacagaccggggtatcatacccaaacagccggaccctggcaccttggcaagttggagctggacttcaattactgcgaggggactaccgtggtgatcacagaaaactgtggaacgaggggccctagcttacgtaccactacagtctccggtaaactcattcacgagtggtgctgtcggtcatgcaccctgccaccccttcgatatatgggggaagatggatgttggtacggcatggagatcagacctataaatgaaaaggaggagaacatggttaagagcctggtgtctgctggttccggcaaagtagacaattttactatgggggtgttgtgcctcgccattctgttcgaagaggtcatgaggggaaagttcggcaaaaagcatatgatcgcaggggtgctatttacattcgttctgctcctgagtggacagatcacctggcgcgatatggctcggacgcttattatgatcggcagcaacgcctctgacagaatgggtatgggggtgacttatttggcactgattgccacctttaaaatacagccattcttagctctcggatttttcctgaggaagcttacatcccgcgaaaatctgctactcggcgtcggcctggcgatggccaccactttgcaactgcccgaggatatcgaacagatggcaaacgggattgctttaggactcatggccctgaagcttatcacacagtttgagacctaccagctgtggacagccttgacttcactcatgtgtagtaataccattttcacgctgacagtggcttggcgaaccgcaactctaatcctggccggtataagccttctcccggtttgccaatcgtcctctatgcggaaaaccgactggctgcctatgacagtggcggctatgggcgtcccacccttgcctctgtttatcttcagcttaaaggatactctcaaacgtagatcatggcccctgaacgagggggtaatggccgtgggacttgttagtattctggcatcctctttgctcaggaatgacgtgccaatggccggccctctggtcgctggtgggctactgatcgcatgttatgtgattaccggaacgagcgccgatcttacagtagaaaaggcggctgacgtgacctgggaggaagaggccgaacagactggcgtctcccacaacctcatgatcacagttgacgatgacggcaccatgcgcataaaagatgacgagactgagaacattctgacagtgttgttaaagaccgcactgctcatcgtgtcagggatctttccctacagcattccagccacgctgcttgtctggcatacttggcagaaacagacccaacggagtggagtgctgtgggatgttccgtctcctcccgaaacacagaaggctgagttggaagagggtgtatacagaataaagcagcagggcatcttcgggaaaacccaagtgggagtcggcgtgcagaaggagggtgtttttcacacaatgtggcatgtgactaggggggccgtcctaacccacaatggaaaacgactggaaccaaactgggcatccgtgaagaaagacctcattagctatggcggcgggtggcgcctgtcggctcagtggcaaaagggagaggaagtacaggtcatcgccgtggagcccggtaagaatcctaaaaacttccagacgatgccaggcattttccagacaactaccggggaaatcggagcgatagcccttgattttaagcccggcacatcaggttctcctatcattaatcgggaggggaaagttgtgggattatacggcaacggcgtcgtgaccaagagtgggggatatgtttccggtatcgcacaaactaatgctgagccggacggcccaacccccgaactggaggaagagatgttcaaaaagagaaacctcacaattatggatttgcaccctgggagcggaaagacgaggaaatacctgccagccatcgtgcgtgaagctataaagcgccggctcagaactctgattcttgcacccaccagggtcgtggccgccgagatggaggaagctctgaaaggcttgcctatccgatatcagacaaccgcgactaagtctgagcatacaggtaaagaaatcgtagacctaatgtgccacgcaacctttacgatgcggctgctcagcccggtgcgcgttcccaattacaacttaattatcatggatgaggcccatttcactgacccagcttccatagccgcaagagggtatatttcaacaagggtcggaatgggcgaagccgctgcgatctttatgaccgccacccctcccggcactgcagatgctttcccacagagtaatgcccctattcaggacgaggagcgggacatccccgaacgaagctggaactctgggaatgattggataacagactttgcaggaaagaccgtgtggttcgtgccatccattaaggccggtaacgatatcgctaattgtctgagaaaaaacggcaagaaagtcatccaactttcacgcaagacatttgacactgagtaccagaaaacgaagctgaacgattgggacttcgtagtgaccacagatattagtgaaatgggggccaattttaaggcggacagggttatcgatccgcgtcggtgcctcaaacctgtgattttgactgacggacccgagagagtcatactggcaggcccaatgcccgtgaccgttgccagcgctgcccagaggcgcggtcgagtggggagaaaccctcagaaggagaatgatcaatacatcttcacaggccagccactcaacaatgacgaagaccacgctcattggaccgaggcaaaaatgctgcttgataacattaatactcccgaaggaatcatccctgccctattcgagccggaacgggagaagtccgctgccattgacggcgagtataggctgaaaggggaatctcgcaagacgtttgtcgagttgatgcgtagaggagatttaccagtgtggctggcacacaaagtagcgtcggaaggtataaagtacaccgaccggaagtggtgcttcgatggcgagaggaacaatcagatcctcgaagagaacatggacgtggagatttggacaaaagaaggggagaagaaaaagctgcgcccccgatggcttgatgccagaacttatagcgaccctctggctctcaaagaatttaaggatttcgccgcaggacggaagtcaatcgcttttgacttggttaccgagattggcagggtcccctcccacctggcccatcgcacaagaaatgcactagataacctggtgatgctccacaccagtgaacatggtgggagggcctaccggcacgctgtggaggagcttccagaaactatggagacactgttattgctgggcctcatgatcctgcttacgggaggcgcgatgctgttcctcatatctgggaaaggaatcggtaagaccagcattggcttgatctgtgtcgttgcctcctcagggatgctgtggatggcagacattcctttacagtggatcgcttctgccatagtgctagaatttttcatgatggtactgctcattcccgagccagagaaacaacgtactcctcaggataatcagcttgcctatgtggtcatcggaattctgacattggcagctatcgtggccgcgaacgaaatgggcctgctcgagaccaccaagcgcgacctgggtatgagcaaagaaccgggggttgtgagtcccacatcctaccttgacgtcgatctccacccagctagcgcctggactctgtatgcagtagccacgaccgtgataacacctatgttgcgacatactatcgagaattctaccgctaacgtttcactggcagccattgcgaatcaagctgtggtcttaatgggcctagacaagggatggcccatctccaagatggatctgggcgtgccactccttgccctggggtgctacagtcaggtcaaccctttgacactgaccgcagccgtgctcctgcttgttactcactacgctattatcggacccggcttacaggccaaagcaacgagagaagctcagaagaggacagccgcgggtataatgaaaaacccgaccgtggacgggattatgactatcgatctggacccagtaatctatgatagcaagtttgagaaacaactcggacaggtgatgttgctggtcctatgtgccgttcagctgctccttatgcggacctcgtgggcattctgcgaggctctgacattggccactggccctattaccacactgtgggaaggttctcccggcaagttttggaatacgaccatcgcagtgtccatggctaacatattccgcgggagctacctcgccggagccggcctggcgttttcaattatgaagagtgtcgggactggaaaaagaggcacaggttctcagggggagaccttaggagaaaagtggaaaaagaaacttaatcaactgtccaggaaggagttcgacctctataaaaagagcggcatcactgaagtggatcggacagaggctaaggagggtctaaaacgaggcgaaattacccatcacgcagtatcaagagggagtgccaagctgcagtggttcgtggagcgcaacatggttatcccagaaggaagggtgatagacttgggctgtgggcggggaggctggagctactattgcgctggtctgaaaaaggtcacggaggtgcgtgggtacaccaaaggaggccccggccatgaagagcctgtcccgatgtccacatatgggtggaatatcgtgaagctcatgtctggaaaggatgttttttaccttcccccagagaaatgtgacactctgttgtgcgatattggtgaaagctccccttcacccaccgtagaggaatctagaacaatcagggtgctgaagatggtcgagccttggctcaaaaacaatcagttctgtattaaggtgttaaacccatacatgcccactgttatcgagcacctggaacgccttcagcggaaacacggcgggatgctggtgcgaaatcctctaagtagaaactcgacccatgagatgtattggattagcaatggaacaggcaacatcgtctcctctgtgaatatggtatcaaggctcctgttgaaccgctttaccatgacttaccggagaccaacgatagaaaaggacgtggacctgggtgccgggacacgtcacgttaatgcagagcccgaaaccccgaacatggatgtcattggagagaggatccggcgcatcaaggaggaacatagctccacttggcactatgacgatgagaacccttacaaaacctgggcctatcacggcagttacgaagtgaaggctacaggctctgcgagctcaatgattaatggggtggtcaaactccttacgaagccatgggacgttgtgcccaccgtaactcaaatggccatgacagataccactcctttcggacagcagcgagtgtttaaagagaaggtcgacacaagaaccccaaagcccatgccgggtacaaggaaagtgatggaaataactgcagagtggctgtggcggaccttaggccgcaacaagagacctaggctgtgcacgcgagaggaattcaccaaaaaggttcggacaaatgctgccatgggggcagtgtttactgaggaaaaccaatgggattccgcccgtgctgccgtcgaggacgaagagttctggaaattggtggatagagagcgcgaactccataagctgggaaaatgtggcagttgcgtatataatatgatgggtaagagggagaagaaactaggggaatttggaaaggcgaaaggcagccgggcaatctggtacatgtggcttggcgccagatacctggagttcgaggctctcgggtttctgaacgaagaccactggttctctcgcgagaattcctattcaggagttgaaggtgagggcttgcataagctggggtacattctcagggatatcagcaaaattcccggaggcgccatgtatgcagacgacaccgctggttgggatacacgaatcactgaagacgatcttcacaacgaggagaagataacccagcagatggacccagaacatcggcagctggccaatgctatctttaagttaacgtaccaaaacaaagtggtcaaggtgcagagacctacacccaaagggaccgtgatggatattatctcgaggaaggaccagcgcggatctggccaggtcggcacttatgggctgaatacattcaccaacatggaggcccaattgattcgtcagatggaaggagagggtgttctcagtaaaactgatctggaaaatccacacctacttgagaagcggatcacccagtggctggagacaaagggcgtggaaagactcaaaaggatggcaatatccggggacgattgcgtagtgaagcccattgacgatcgcttcgcgaacgccctgttggctttaaatgacatgggaaaagtccgaaaggatatccctcagtggcaaccaagcaaaggctggcacgactggcagcaggtgccgttttgttcacatcacttccatgagctgatcatgaaggacggtcggaagctcgttgtgccctgcagacctcaggatgaacttattgggagggcccgcatatcccaaggagcaggctggtctctgaaagagacggcttgtctaggcaaggcctacgcacagatgtgggccctgatgtattttcacagacgggacctcaggttggcgagcaacgctatctgcagtgccgtcccagtgcactgggtacccacctcccgtactacatggagcattcatgcacaccatcagtggatgaccactgaagatatgctgacagtttggaaccgagtgtggatcgaggacaatccttggatggaggataaaaccccagtcacgacatgggaagacgtgccctaccttgggaagcgcgaggatcaatggtgtggatctctgattggtctcacctcaagagccacttgggctcagaacatcttaaccgccatacagcaggttcggagtctgatcggcaatgaagagttcttggactacatgccttccatgaaaaggtttcgcaaggaggaagagagcgaaggggcaatttggtga

SEQ ID NO: 15085 - RNA, 9873 nt, synthetic construct
  misc_feature 1..9873: note = derived and/or modified CDS sequence (opt3) from DENV-3__AB214880__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggccccccacgtgggcatgggtttggataccagaacgcaaacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctagacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagtggtccagcacgaaaatctgaagtatactgtgataattaccgttcatacaggtgaccagcaccaggtgggcaacgagacccaaggggtcactgccgaaatcacgccccaggcatctacagtggaggctgtactccctgaatacggaacccttggcctggagtgcagcccacgaactggtttggactttaatgagatgattctactgaccatgaaaaacaaggcctggatggttcatagacagtggttctttgatctcccgctgccctggacatccggggcgaccactgaaacacctacgtggaataaaaaggagcttctggtgaccttcaaaaacgcccacgcaaagaagcaagaagtcgtggtcttgggctcacaggagggagctatgcacactgccctcacaggcgctaccgaaatccagacaagtgggggaactagcatctttgccggtcatctgaaatgtaggttaaagatggacaaactggagctaaagggcatgtcttatgcaatgtgctccaatgccttcgtgctcaaaaaggaggtttcagaaacccagcacgggacgattctgataaaggtggagtacaaaggagaagatgctccatgtaagatccccttcagcaccgaggacggccaaggtaaagcgcataacgggcggcttattacagcaaaccctgtagtcactaagaaagaggaaccagtgaatatcgaggccgaacccccgtttggcgagagtaacataattatcggaatcggcgataaggctttgaagattaattggtacaaaaaggggtcttccatcggaaaaatgttcgaagccaccgcacgtggtgcccgcagaatggctattctgggcgacacagcctgggattttgggagcgttggaggcgtgctcaactcgctgggtaagatggtccaccagatattcgggtctgcatatactgcgcttttttccggcgtgtcatggatcatgaaaattggaatcggcgtactgttgacctggatcgggctcaatagtaagaacacgagcatgtccttctcttgcattgtgataggaatcattacactgtacttaggcgctgttgtccaggccgacatgggttgtgtgatcaattggaaggggaaagagctgaagtgcggaagcggcatttttgtgaccaacgaggtccatacttggacagaacagtataaattccaagcagattcacctaagaggctagccaccgctatcgccggtgcatgggagaatggcgtttgtgggatacggagtactacccgaatggaaaacctcctgtggaaacagatcgctaatgagcttaactacattttgtgggaaaataacatcaagctgacagtggtggtaggagacattatcggcgtcctcgagcaggggaaacgcacgctgaccccccagccaatggagttaaagtattcctggaagacttggggaaaagccaagatagtgacagcggaaacccaaaatagctcttttattatcgatggccctaacacacccgagtgcccatcagccagtagagcttggaacgtttgggaagtggaggactacggtttcggggtctttactaccaatatttggctgaaacttagggaaatgtatacgcagttgtgtgaccaccggctcatgagcgcagccgtgaaggatgagcgcgctgttcacgccgacatgggatactggatcgagtcccagaaaaacggctcttggaagctggaaaaggcatcgctaatagaggtgaaaacatgcacctggcccaagagccatactctgtggtccaatggtgtactcgaatcagatatgatcattcctaaaagtctggcgggcccaatctctcagcacaactacagaccggggtatcatacccaaacagccggaccctggcaccttggcaagttggagctggacttcaattactgcgaggggactaccgtcgtgattacagaaaactgtggaacgaggggccctagcttacgtaccactacagtgtccggtaaactcatccacgagtggtgctgtcggtcatgcaccctgccaccccttcgatatatgggggaagatggatgttggtacggcatggagataagacctattaatgaaaaggaggagaacatggtcaagagcctggtttctgctggttccggcaaagtggacaattttactatgggggtattgtgcctcgccatcctgttcgaagaggtgatgaggggaaagttcggcaaaaagcatatgatcgcaggggtcctatttacattcgtgctgctcctgagtggacagattacctggcgcgatatggctcggacgcttatcatgattggcagcaacgcctctgacagaatgggtatgggggttacttatttggcactgatagccacctttaaaatccagccattcttagctctcggatttttcctgaggaagcttacatcccgcgaaaatctgctactcggcgtgggcctggcgatggccaccactttgcaactgcccgaggatattgaacagatggcaaacgggatcgctttaggactcatggccctgaagcttattacacagtttgagacctaccagctgtggacagccttggcttcactcatgtgtagtaatactatcttcaccctgacggtcgcatggcgaacagccaccctaatactggcgggtatcagccttctcccggtgtgccaatcgtcctctatgcggaaaactgactggctgcctatgaccgttgctgccatgggcgtgccacccttgcctctgtttattttcagcttaaaggatacactcaaacgtagatcatggcccctgaacgagggggtcatggcagtaggacttgtgagtatcctggcctcctctttgctcaggaatgacgttccaatggctggccctctggtggcaggtgggctactgattgcctgttatgtcatcactggaaccagcgcggatcttacggtggaaaaggctgccgacgtaacatgggaggaagaggcagaacagaccggcgtgtcccacaacctcatgataactgtcgacgatgacggcacaatgcgcattaaagatgacgagaccgagaacatcctgactgttttgttaaagacagccctgctcatcgtgtcagggatttttccctacagcataccagctaccctgcttgtgtggcatacgtggcagaaacagactcaacggagtggagtcctgtgggatgtgccgtctcctcccgaaacccagaaggccgagttggaagagggtgtttacagaatcaagcagcagggcattttcgggaaaacacaagtaggagtgggcgtccagaaggagggtgtgtttcacaccatgtggcatgttacaaggggggcagtgctaactcacaatggaaaacgactggaaccaaactgggcttccgtcaagaaagacctcatcagctatggcggcgggtggcgcctgtcggcccagtggcaaaagggagaggaagtgcaggtaattgcggtcgagcccggtaagaatcctaaaaacttccagaccatgccaggcatcttccagacgacaactggggaaataggagccatcgcacttgattttaagcccggcacctcaggttctcctattatcaatcgggaggggaaagtggttggattatacggcaacggcgtggtcacaaagagtgggggatatgtgtccggtattgctcaaaccaatgccgagccggacggcccaactcccgaactggaggaagagatgttcaaaaagagaaacctcaccatcatggatttgcaccctgggagcggaaagacaaggaaatacctgccagctatagttcgtgaagcaattaagcgccggctcagaacgctgatccttgcccccactagggtggtcgccgctgagatggaggaagcgctgaaaggcttgcctatccgatatcagaccacagcaaccaagtctgagcatactggtaaagaaattgtggacctaatgtgccacgccacatttaccatgcggctgctcagcccggtacgcgtgcccaattacaacttaatcataatggatgaggctcatttcacggacccagcctccattgcagccagagggtatatctcaactagggttggaatgggcgaagctgcggccatttttatgacagcaacccctcccggcaccgctgatgccttcccacagagtaatgcacctatccaggacgaggagcgggacatacccgaacgaagctggaactctgggaatgattggattactgactttgccggaaagacagtctggttcgtgccatccatcaaggctggtaacgatatcgccaattgtctgagaaaaaacggcaagaaagtgattcaactttcacgcaagacctttgacacagagtaccagaaaactaagctgaacgattgggacttcgtcgtaacgaccgatatcagtgaaatgggggcgaattttaaggcagacagggtgattgatccgcgtcggtgcctcaaacctgttatattgacagacggacccgagagagtgatcctggccggcccaatgcccgtcactgtggctagcgccgctcagaggcgcggtcgagttgggagaaaccctcagaaggagaatgatcaatacattttcaccggccagccactcaacaatgacgaagaccacgcacattggacagaggccaaaatgctgcttgataacatcaatacccccgaaggaatcattcctgctctattcgagccggaacgggagaagtccgccgcaatagacggcgagtataggctgaaaggggaatctcgcaagacttttgtggagttgatgcgtagaggagatttaccagtctggctggcgcacaaagtggcctcggaaggtatcaagtacacggaccggaagtggtgcttcgatggcgagaggaacaatcagattctcgaagagaacatggacgtagagatctggaccaaagaaggggagaagaaaaagctgcgcccccgatggcttgatgctagaacatatagcgaccctctggccctcaaagaatttaaggatttcgcagctggacggaagtcaattgcctttgacttggtgactgagatcggcagggttccctcccacctggcacatcgcaccagaaatgccctagataacctggtcatgctccacacaagtgaacatggtgggagggcttaccggcacgcggtggaggagcttccagaaaccatggagactctgttattgctgggcctcatgatactgcttacaggaggcgccatgctgttcctcatctctgggaaaggaattggtaagacgagcatcggcttgatttgtgtggtcgcatcctcagggatgctgtggatggctgacatccctttacagtggatagcctctgccattgttctagaatttttcatgatggtgctgctcatccccgagccagagaaacaacgtacccctcaggataatcagcttgcatatgtagtgattggaatcctgactttggctgccatagtcgcggctaacgaaatgggcctgctcgagacaaccaagcgcgacctgggtatgagcaaagaaccgggggtggttagtcccacctcctaccttgacgtggatctccacccagccagcgcatggacactgtatgccgtcgctactacggtaatcacccctatgttgcgacatacaattgagaattctactgcaaacgtgtcactggccgcgatcgctaatcaagccgttgtgttaatgggcctagacaagggatggcccatttccaagatggatctgggcgtcccactccttgcactggggtgctacagtcaggtgaaccctttgaccctgacagccgctgtcctcctgcttgtgacccactacgccatcataggacccggcttacaggcaaaagctactagagaagcccagaagaggacggcggccggtattatgaaaaacccgacagttgacgggatcatgaccatcgatctggacccagtgatttatgatagcaagtttgagaaacaactcggacaggtaatgttgctggtgctatgtgcagtccagctgctccttatgcggacttcgtgggctttctgcgaggccctgaccttggcaacaggccctatcactaccctgtgggaaggttctcccggcaagttttggaatacaacgatagctgtttccatggccaacattttccgcgggagctacctcgccggagcgggcctggctttttcaatcatgaagagtgtggggaccggaaaaagaggcactggttctcagggggagacattaggagaaaagtggaaaaagaaacttaatcaactgtccaggaaggagttcgacctctataaaaagagcggcattaccgaagtcgatcggactgaggcaaaggagggtctaaaacgaggcgaaatcacacatcacgccgtgtcaagagggagtgctaagctgcagtggttcgtagagcgcaacatggtgataccagaaggaagggttatcgacttgggctgtgggcggggaggctggagctactattgcgccggtctgaaaaaggtgaccgaggtccgtgggtacacgaaaggaggccccggccatgaagagcctgtgccgatgtccacctatgggtggaatattgtcaagctcatgtctggaaaggatgtgttttaccttcccccagagaaatgtgacacactgttgtgcgatatcggtgaaagctccccttcacccactgttgaggaatctagaaccattagggtactgaagatggtggagccttggctcaaaaacaatcagttctgtatcaaggtcttaaacccatacatgcccacagtgattgagcacctggaacgccttcagcggaaacacggcgggatgctggttcgaaatcctctaagtagaaactcgactcatgagatgtattggatcagcaatggaaccggcaacatagtgtcctctgtcaatatggtgtcaaggctcctgttgaaccgctttacaatgacctaccggagaccaactattgaaaaggacgtagacctgggtgcagggacgcgtcacgtgaatgccgagcccgaaacaccgaacatggatgttatcggagagaggatccggcgcattaaggaggaacatagctccacctggcactatgacgatgagaacccttacaaaacttgggcttatcacggcagttacgaagtcaaggcgaccggctctgccagctcaatgataaatggggtggtgaaactccttacaaagccatgggacgtcgttcccacggtgacccaaatggcaatgactgatacaacccctttcggacagcagcgagtatttaaagagaaggtggacactagaacaccaaagcccatgccgggtaccaggaaagtcatggaaatcacagctgagtggctgtggcggactttaggccgcaacaagagacctaggctgtgcacccgagaggaattcacgaaaaaggtgcggaccaatgccgcaatgggggccgtttttacagaggaaaaccaatgggattccgctcgtgccgcggtggaggacgaagagttctggaaattggtcgatagagagcgcgaactccataagctgggaaaatgtggcagttgcgtgtataatatgatgggtaagagggagaagaaactaggggaatttggaaaggcaaaaggcagccgggccatttggtacatgtggcttggcgctagatacctggagttcgaggccctcgggtttctgaacgaagaccactggttctctcgcgagaattcctattcaggagtagaaggtgagggcttgcataagctggggtacatcctcagggatattagcaaaatccccggaggcgcaatgtatgctgacgacactgccggttgggatacccgaataacagaagacgatcttcacaacgaggagaagatcactcagcagatggacccagaacatcggcagctggctaatgccatttttaagttaacctaccaaaacaaagttgtgaaggtccagagacctacgcccaaagggacagtgatggatatcatttcgaggaaggaccagcgcggatctggccaggtgggcacctatgggctgaatactttcacaaacatggaggcacaattgatccgtcagatggaaggagagggtgtcctcagtaaaaccgatctggaaaatccacacctacttgagaagcggataactcagtggctggagaccaagggcgttgaaagactcaaaaggatggcgatttccggggacgattgcgtggtaaagcccatcgacgatcgcttcgccaacgctctgttggccttaaatgacatgggaaaagtgcgaaaggatatccctcagtggcaaccaagcaaaggctggcacgactggcagcaggtcccgttttgttcacatcacttccatgagctgattatgaaggacggtcggaagctcgtggttccctgcagacctcaggatgaacttatagggagggcacgcatctcccaaggagctggctggtctctgaaagagacagcctgtctaggcaaggcatacgcccagatgtgggcgctgatgtattttcacagacgggacctcaggttggctagcaacgccatttgcagtgcagtgccagtccactgggtgcccacgtcccgtaccacttggagcatccatgcccaccatcagtggatgacaaccgaagatatgctgactgtatggaaccgagtttggattgaggacaatccttggatggaggataaaacaccagtgaccacgtgggaagacgtcccctaccttgggaagcgcgaggatcaatggtgtggatctctgatcggtctcacatcaagagctacctgggcccagaacatattaactgcaatccagcaggtgcggagtctgattggcaatgaagagttcttggactacatgccttccatgaaaaggtttcgcaaggaggaagagagcgaaggggctatctggtga

SEQ ID NO: 15086 - RNA, 9873 nt, synthetic construct
  misc_feature 1..9873: note = derived and/or modified CDS sequence (opt3) from DENV-3__AB214881__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggccccccacgtgggcatgggtttggataccagaacgcaaacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctagacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagtggtccagcacgaaaatctgaagtatactgtgataattaccgttcatacaggtgaccagcaccaggtgggcaacgagacccaaggggtcactgccgaaatcacgccccaggcatctacagtggaggctgtactccctgaatacggaacccttggcctggagtgcagcccacgaactggtttggactttaatgagatgattctactgaccatgaaaaacaaggcctggatggttcatagacagtggttctttgatctcccgctgccctggacatccggggcgaccactgaaacacctacgtggaataaaaaggagcttctggtgaccttcaaaaacgcccacgcaaagaagcaagaagtcgtggtcttgggctcacaggagggagctatgcacactgccctcacaggcgctaccgaaatccagacaagtgggggaactagcatctttgccggtcatctgaaatgtaggttaaagatggacaaactggagctaaagggcatgtcttatgcaatgtgctccaatgccttcgtgctcaaaaaggaggtttcagaaacccagcacgggacgattctgataaaggtggagtacaaaggagaagatgctccatgtaagatccccttcagcaccgaggacggccaaggtaaagcgcataacgggcggcttattacagcaaaccctgtagtcactaagaaagaggaaccagtgaatatcgaggccgaacccccgtttggcgagagtaacataattatcggaatcggcgataaggctttgaagattaattggtacaaaaaggggtcttccatcggaaaaatgttcgaagccaccgcacgtggtgcccgcagaatggctattctgggcgacacagcctgggattttgggagcgttggaggcgtgctcaactcgctgggtaagatggtccaccagatattcgggtctgcatatactgcgcttttttccggcgtgtcatggatcatgaaaattggaatcggcgtactgttgacctggatcgggctcaatagtaagaacacgagcatgtccttctcttgcattgtgataggaatcattacactgtacttaggcgctgttgtccaggccgacatgggttgtgtgatcaattggaaggggaaagagctgaagtgcggaagcggcatttttgtgaccaacgaggtccatacttggacagaacagtataaattccaagcagattcacctaagaggctagccaccgctatcgccggtgcatgggagaatggcgtttgtgggatacggagtactacccgaatggaaaacctcctgtggaaacagatcgctaatgagcttaactacattttgtgggaaaataacatcaagctgacagtggtggtaggagacattatcggcatactcgagcaggggaaacgcacgctgaccccccagccaatggagttaaagtattcctggaagacttggggaaaagccaagattgtcacagcggaaacccaaaatagctcttttatcattgatggccctaacacacccgagtgcccatcagccagtagagcttggaacgtgtgggaagttgaggactacggtttcggggtgtttactaccaatatctggctgaaacttagggaaatgtatacgcagttgtgtgaccaccggctcatgagcgcagccgtcaaggatgagcgcgctgtgcacgccgacatgggatactggatagagtcccagaaaaacggctcttggaagctggaaaaggcatcgctaatcgaggttaaaacatgcacctggcccaagagccatactctgtggtccaatggtgtgctcgaatcagatatgattatccctaaaagtctggcgggcccaatttctcagcacaactacagaccggggtatcatacccaaacagccggaccctggcaccttggcaagttggagctggacttcaattactgcgaggggactaccgtagtcatcacagaaaactgtggaacgaggggccctagcttacgtaccactacagtgtccggtaaactcatacacgagtggtgctgtcggtcatgcaccctgccaccccttcgatatatgggggaagatggatgttggtacggcatggagattagacctatcaatgaaaaggaggagaacatggtgaagagcctggtctctgctggttccggcaaagttgacaattttactatgggggtgttgtgcctcgccatcctgttcgaagaggtaatgaggggaaagttcggcaaaaagcatatgattgcaggggtgctatttacattcgtcctgctcctgagtggacagatcacctggcgcgatatggctcggacgcttattatgataggcagcaacgcctctgacagaatgggtatgggggtgacttatttggcactgatcgccacctttaaaattcagccattcttagctctcggatttttcctgaggaagcttacatcccgcgaaaatctgctactcggcgttggcctggcgatggccaccactttgcaactgcccgaggatatcgaacagatggcaaacgggattgctttaggactcatggccctgaagcttatcacacagtttgagacctaccagctgtggacagccttggcttcactcatgtgtagtaatactatattcaccctgacggtggcatggcgaacagccaccctaatcctggcgggtattagccttctcccggtctgccaatcgtcctctatgcggaaaactgactggctgcctatgaccgtggctgccatgggcgttccacccttgcctctgtttatcttcagcttaaaggatacactcaaacgtagatcatggcccctgaacgagggggtgatggcagtcggacttgtaagtattctggcctcctctttgctcaggaatgacgtgccaatggctggccctctggttgcaggtgggctactgatcgcctgttatgtgataactggaaccagcgcggatcttacggtcgaaaaggctgccgacgtgacatgggaggaagaggcagaacagaccggcgtatcccacaacctcatgattactgtggacgatgacggcacaatgcgcatcaaagatgacgagaccgagaacatcctgactgtcttgttaaagacagccctgctcattgtttcagggatatttccctacagcatcccagctaccctgcttgtgtggcatacgtggcagaaacagactcaacggagtggagtgctgtgggatgtcccgtctcctcccgaaacccagaaggccgagttggaagagggtgtgtacagaattaagcagcagggcatcttcgggaaaacacaagttggagtaggcgtgcagaaggagggtgtctttcacaccatgtggcatgtgacaaggggggcagttctaactcacaatggaaaacgactggaaccaaactgggcttccgtgaagaaagacctcattagctatggcggcgggtggcgcctgtcggcccagtggcaaaagggagaggaagtccaggtgatcgcggtagagcccggtaagaatcctaaaaacttccagaccatgccaggcatattccagacgacaactggggaaatcggagccattgcacttgattttaagcccggcacctcaggttctcctatcattaatcgggaggggaaagtcgtgggattatacggcaacggcgttgtgacaaagagtgggggatatgtctccggtatcgctcaaaccaatgccgagccggacggcccaactcccgaactggaggaagagatgttcaaaaagagaaacctcaccataatggatttgcaccctgggagcggaaagacaaggaaatacctgccagctattgtgcgtgaagcaatcaagcgccggctcagaacgctgatccttgcccccactagggttgtggccgctgagatggaggaagcgctgaaaggcttgcctattcgatatcagaccacagcaaccaagtctgagcatactggtaaagaaatcgtcgacctaatgtgccacgccacatttaccatgcggctgctcagcccggtgcgcgtacccaattacaacttaataattatggatgaggctcatttcacggacccagcctccatcgcagccagagggtatatttcaactagggtgggaatgggcgaagctgcggccatctttatgacagcaacccctcccggcaccgctgatgccttcccacagagtaatgcacctatacaggacgaggagcgggacattcccgaacgaagctggaactctgggaatgattggatcactgactttgccggaaagacagtttggttcgtcccatccatcaaggctggtaacgatattgccaattgtctgagaaaaaacggcaagaaagtgatccaactttcacgcaagacctttgacacagagtaccagaaaactaagctgaacgattgggacttcgtggtcacgaccgatattagtgaaatgggggcgaattttaaggcagacagggtaatagatccgcgtcggtgcctcaaacctgtgatcttgacagacggacccgagagagttattctggccggcccaatgcccgtgactgtcgctagcgccgctcagaggcgcggtcgagtggggagaaaccctcagaaggagaatgatcaatacatcttcaccggccagccactcaacaatgacgaagaccacgcacattggacagaggccaaaatgctgcttgataacatcaatacccccgaaggaattatacctgctctattcgagccggaacgggagaagtccgccgcaatcgacggcgagtataggctgaaaggggaatctcgcaagacttttgttgagttgatgcgtagaggagatttaccagtgtggctggcgcacaaagtcgcctcggaaggtattaagtacacggaccggaagtggtgcttcgatggcgagaggaacaatcagatcctcgaagagaacatggacgtggagatttggaccaaagaaggggagaagaaaaagctgcgcccccgatggcttgatgctagaacatatagcgaccctctggccctcaaagaatttaaggatttcgcagctggacggaagtcaatcgcctttgacttggtaactgagataggcagggtgccctcccacctggcacatcgcaccagaaatgccctagataacctggttatgctccacacaagtgaacatggtgggagggcttaccggcacgcggtcgaggagcttccagaaaccatggagactctgttattgctgggcctcatgatcctgcttacaggaggcgccatgctgttcctcatttctgggaaaggaatcggtaagacgagcattggcttgatctgtgtggtggcatcctcagggatgctgtggatggctgacatacctttacagtggattgcctctgccatcgtcctagaatttttcatgatggttctgctcattcccgagccagagaaacaacgtacccctcaggataatcagcttgcatatgtggtaatcggaatactgactttggctgccatcgtggcggctaacgaaatgggcctgctcgagacaaccaagcgcgacctgggtatgagcaaagaaccgggggtcgtgagtcccacctcctaccttgacgttgatctccacccagccagcgcatggacactgtatgccgtggctactacggtcattacccctatgttgcgacatacaatcgagaattctactgcaaacgtatcactggccgcgattgctaatcaagccgtggttttaatgggcctagacaagggatggcccatctccaagatggatctgggcgtgccactccttgcactggggtgctacagtcaggtcaaccctttgaccctgacagccgctgtgctcctgcttgtcacccactacgccataattggacccggcttacaggcaaaagctactagagaagcccagaagaggacggcggccggtatcatgaaaaacccgacagtggacgggatcatgaccattgatctggacccagttatctatgatagcaagtttgagaaacaactcggacaggtgatgttgctggtactatgtgcagtgcagctgctccttatgcggacttcgtgggctttctgcgaggccctgaccttggcaacaggccctataactaccctgtgggaaggttctcccggcaagttttggaatacaacgattgctgtctccatggccaacatcttccgcgggagctacctcgccggagcgggcctggctttttcaattatgaagagtgttgggaccggaaaaagaggcactggttctcagggggagacattaggagaaaagtggaaaaagaaacttaatcaactgtccaggaaggagttcgacctctataaaaagagcggcatcaccgaagtggatcggactgaggcaaaggagggtctaaaacgaggcgaaataacacatcacgccgtctcaagagggagtgctaagctgcagtggttcgtggagcgcaacatggtaatcccagaaggaagggtgattgacttgggctgtgggcggggaggctggagctactattgcgccggtctgaaaaaggttaccgaggtgcgtgggtacacgaaaggaggccccggccatgaagagcctgtcccgatgtccacctatgggtggaatatcgtgaagctcatgtctggaaaggatgtcttttaccttcccccagagaaatgtgacacactgttgtgcgatattggtgaaagctccccttcacccactgtggaggaatctagaaccatcagggttctgaagatggtagagccttggctcaaaaacaatcagttctgtattaaggtgttaaacccatacatgcccacagtcatcgagcacctggaacgccttcagcggaaacacggcgggatgctggtgcgaaatcctctaagtagaaactcgactcatgagatgtattggataagcaatggaaccggcaacattgtttcctctgtgaatatggtctcaaggctcctgttgaaccgctttacaatgacctaccggagaccaactatcgaaaaggacgtggacctgggtgcagggacgcgtcacgtaaatgccgagcccgaaacaccgaacatggatgtgatcggagagaggattcggcgcataaaggaggaacatagctccacctggcactatgacgatgagaacccttacaaaacttgggcttatcacggcagttacgaagttaaggcgaccggctctgccagctcaatgatcaatggggtcgtgaaactccttacaaagccatgggacgtggtccccacggttacccaaatggcaatgactgatacaacccctttcggacagcagcgagtgtttaaagagaaggtagacactagaacaccaaagcccatgccgggtaccaggaaagtgatggaaattacagctgagtggctgtggcggactttaggccgcaacaagagacctaggctgtgcacccgagaggaattcacgaaaaaggtccggaccaatgccgcaatgggggccgtgtttacagaggaaaaccaatgggattccgctcgtgccgcggttgaggacgaagagttctggaaattggtggatagagagcgcgaactccataagctgggaaaatgtggcagttgcgtctataatatgatgggtaagagggagaagaaactaggggaatttggaaaggcaaaaggcagccgggccatctggtacatgtggcttggcgctagatacctggagttcgaggccctcgggtttctgaacgaagaccactggttctctcgcgagaattcctattcaggagtggaaggtgagggcttgcataagctggggtacattctcagggatatcagcaaaatacccggaggcgcaatgtatgctgacgacactgccggttgggatacccgaatcacagaagacgatcttcacaacgaggagaagattactcagcagatggacccagaacatcggcagctggctaatgccatctttaagttaacctaccaaaacaaagtagttaaggtgcagagacctacgcccaaagggacagtcatggatattatctcgaggaaggaccagcgcggatctggccaggtgggcacctatgggctgaatactttcacaaacatggaggcacaattgatacgtcagatggaaggagagggtgtgctcagtaaaaccgatctggaaaatccacacctacttgagaagcggattactcagtggctggagaccaagggcgtcgaaagactcaaaaggatggcgatctccggggacgattgcgttgtgaagcccatcgacgatcgcttcgccaacgctctgttggccttaaatgacatgggaaaagtacgaaaggatattcctcagtggcaaccaagcaaaggctggcacgactggcagcaggtgccgttttgttcacatcacttccatgagctgataatgaaggacggtcggaagctcgtcgtgccctgcagacctcaggatgaacttatcgggagggcacgcatttcccaaggagctggctggtctctgaaagagacagcctgtctaggcaaggcatacgcccagatgtgggcgctgatgtattttcacagacgggacctcaggttggctagcaacgccatctgcagtgcagttccagtgcactgggtccccacgtcccgtaccacttggagcattcatgcccaccatcagtggatgacaaccgaagatatgctgactgtgtggaaccgagtatggatcgaggacaatccttggatggaggataaaacaccagttaccacgtgggaagacgtgccctaccttgggaagcgcgaggatcaatggtgtggatctctgataggtctcacatcaagagctacctgggcccagaacatcttaactgcaattcagcaggtccggagtctgatcggcaatgaagagttcttggactacatgccttccatgaaaaggtttcgcaaggaggaagagctggaaggggctatttggtga

SEQ ID NO: 15087 - RNA, 9873 nt, synthetic construct
  misc_feature 1..9873: note = derived and/or modified CDS sequence (opt3) from DENV-3__AB214882__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggccccccacgtgggcatgggtttggataccagaacgcaaacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctagacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagtggtccagcacgaaaatctgaagtatactgtgataattaccgttcatacaggtgaccagcaccaggtgggcaacgagacccaaggggtcactgccgaaatcacgccccaggcatctacagtggaggctgtactccctgaatacggaacccttggcctggagtgcagcccacgaactggtttggactttaatgagatgattctactgaccatgaaaaacaaggcctggatggttcatagacagtggttctttgatctcccgctgccctggacatccggggcgaccactgaaacacctacgtggaataaaaaggagcttctggtgaccttcaaaaacgcccacgcaaagaagcaagaagtcgtggtcttgggctcacaggagggagctatgcacactgccctcacaggcgctaccgaaatccagacaagtgggggaactagcatctttgccggtcatctgaaatgtaggttaaagatggacaaactggagctaaagggcatgtcttatgcaatgtgctccaatgccttcgtgctcaaaaaggaggtttcagaaacccagcacgggacgattctgataaaggtggagtacaaaggagaagatgctccatgtaagatccccttcagcaccgaggacggccaaggtaaagcgcataacgggcggcttattacagcaaaccctgtagtcactaagaaagaggaaccagtgaatatcgaggccgaacccccgtttggcgagagtaacataattatcggaatcggcgataaggctttgaagattaattggtacaaaaaggggtcttccatcggaaaaatgttcgaagccaccgcacgtggtgcccgcagaatggctattctgggcgacacagcctgggattttgggagcgttggaggcgtgctcaactcgctgggtaagatggtccaccagatattcgggtctgcatatactgcgcttttttccggcgtgtcatggatcatgaaaattggaatcggcgtactgttgacctggatcgggctcaatagtaagaacacgagcatgtccttctcttgcattgtgataggaatcattacactgtacttaggcgctgttgtccaggccgacatgggttgtgtgatcaattggaaggggaaagagctgaagtgcggaagcggcatttttgtgaccaacgaggtccatacttggacagaacagtataaattccaagcagattcacctaagaggctagccaccgctatcgccggtgcatgggagaatggcgtttgtgggatacggagtactacccgaatggaaaacctcctgtggaaacagatcgctaatgagcttaactacattttgtgggaaaataacatcaagctgacagtggtggtaggagacattacgggcatcctcgagcaggggaaacgcaccctgactccccagccaatggagttaaagtattcctggaagacatggggaaaagccaagatagtcaccgcggaaacacaaaatagctcttttattatcgatggccctaacactcccgagtgcccatcagccagtagagcttggaacgtgtgggaagttgaggactacggtttcggggtgtttaccacgaatatttggctgaaacttagggaaatgtatacacagttgtgtgaccaccggctcatgagcgcagccgtcaaggatgagcgcgctgtgcacgccgacatgggatactggatcgagtcccagaaaaacggctcttggaagctggaaaaggcatcgctaatagaggttaaaacctgcacttggcccaagagccataccctgtggtccaatggtgtgctcgaatcagatatgatcattcctaaaagtctggcgggcccaatctctcagcacaactacagaccggggtatcatacacaaactgccggaccctggcaccttggcaagttggagctggacttcaattactgcgaggggaccacagtagtcattacggaaaactgtggaaccaggggccctagcttacgtactacaaccgtgtccggtaaactcatccacgagtggtgctgtcggtcatgcactctgccaccccttcgatatatgggggaagatggatgttggtacggcatggagataagacctattaatgaaaaggaggagaacatggtgaagagcctggtctctgctggttccggcaaagttgacaattttacaatgggggtgttgtgcctcgccatcctgttcgaagaggtaatgaggggaaagttcggcaaaaagcatatgatcgcaggggtgctatttaccttcgtcctgctcctgagtggacagattacgtggcgcgatatggctcggactcttatcatgattggcagcaacgcctctgacagaatgggtatgggggtgacctatttggcactgatagccacatttaaaatccagccattcttagctctcggatttttcctgaggaagcttacctcccgcgaaaatctgctactcggcgttggcctggcgatggccactacattgcaactgcccgaggatattgaacagatggcaaacgggatcgctttaggactcatggccctgaagcttattacccagtttgagacataccagctgtggactgccttggcttcactcatgtgtagtaataccatcttcacgctgacagtggcatggcgaaccgccactctaatactggcgggtatcagccttctcccggtctgccaatcgtcctctatgcggaaaaccgactggctgcctatgacagtggctgccatgggcgttccacccttgcctctgtttattttcagcttaaaggatactctcaaacgtagatcatggcccctgaacgagggggtgatggcagtcggacttgtaagtatcctggcctcctctttgctcaggaatgacgtgccaatggctggccctctggttgcaggtgggctactgattgcctgttatgtgatcaccggaacgagcgcggatcttacagtcgaaaaggctgccgacgtgacctgggaggaagaggcagaacagactggcgtatcccacaacctcatgataacagtggacgatgacggcaccatgcgcattaaagatgacgagactgagaacatcctgacagtcttgttaaagaccgccctgctcatcgtttcagggatttttccctacagcataccagctacgctgcttgtgtggcatacttggcagaaacagacccaacggagtggagtgctgtgggatgtcccgtctcctcccgaaacacagaaggccgagttggaagagggtgtgtacagaatcaagcagcagggcattttcgggaaaacccaagttggagtaggcgtgcagaaggagggtgtctttcacacaatgtggcatgtgactaggggggcagttctaacccacaatggaaaacgactggaaccaaactgggcttccgtgaagaaagacctcatcagctatggcggcgggtggcgcctgtcggcccagtggcaaaagggagaggaagtccaggtgattgcggtagagcccggtaagaatcctaaaaacttccagacgatgccaggcatcttccagacaactaccggggaaataggagccatcgcacttgattttaagcccggcacatcaggttctcctattatcaatcgggaggggaaagtcgtgggattatacggcaacggcgttgtgaccaagagtgggggatatgtctccggtattgctcaaactaatgccgagccggacggcccaacccccgaactggaggaagagatgttcaaaaagagaaacctcacaatcatggatttgcaccctgggagcggaaagacgaggaaatacctgccagctatagtgcgtgaagcaattaagcgccggctcagaactctgatccttgcccccaccagggttgtggccgctgagatggaggaagcgctgaaaggcttgcctatccgatatcagacaaccgcaactaagtctgagcatacaggtaaagaaattgtcgacctaatgtgccacgccacctttacgatgcggctgctcagcccggtgcgcgtacccaattacaacttaatcataatggatgaggctcatttcactgacccagcctccattgcagccagagggtatatctcaacaagggtgggaatgggcgaagctgcggccatttttatgaccgcaacccctcccggcactgctgatgccttcccacagagtaatgcacctatccaggacgaggagcgggacatacccgaacgaagctggaactctgggaatgattggattacagactttgccggaaagaccgtttggttcgtcccatccatcaaggctggtaacgatatcgccaattgtctgagaaaaaacggcaagaaagtgattcaactttcacgcaagacatttgacactgagtaccagaaaacgaagctgaacgattgggacttcgtggtcaccacagatatcagtgaaatgggggcgaattttaaggcagacagggtaattgatccgcgtcggtgcctcaaacctgtgatattgactgacggacccgagagagttatcctggccggcccaatgcccgtgaccgtcgctagcgccgctcagaggcgcggtcgagtggggagaaaccctcagaaggagaatgatcaatacattttcacaggccagccactcaacaatgacgaagaccacgcacattggaccgaggccaaaatgctgcttgataacatcaatactcccgaaggaatcattcctgctctattcgagccggaacgggagaagtccgccgcaatagacggcgagtataggctgaaaggggaatctcgcaagacgtttgttgagttgatgcgtagaggagatttaccagtgtggctggcgcacaaagtcgcctcggaaggtatcaagtacaccgaccggaagtggtgcttcgatggcgagaggaacaatcagattctcgaagagaacatggacgtggagatctggacaaaagaaggggagaagaaaaagctgcgcccccgatggcttgatgctagaacttatagcgaccctctggccctcaaagaatttaaggatttcgcagctggacggaagtcaattgcctttgacttggtaaccgagatcggcagggtgccctcccacctggcacatcgcacaagaaatgccctagataacctggttatgctccacaccagtgaacatggtgggagggcttaccggcacgcggtcgaggagcttccagaaactatggagacactgttattgctgggcctcatgatactgcttacgggaggcgccatgctgttcctcatctctgggaaaggaattggtaagaccagcatcggcttgatttgtgtggtggcatcctcagggatgctgtggatggctgacatccctttacagtggatagcctctgccattgtcctagaatttttcatgatggttctgctcatccccgagccagagaaacaacgtactcctcaggataatcagcttgcatatgtggtaattggaatcctgacattggctgccatagtggcggctaacgaaatgggcctgctcgagaccaccaagcgcgacctgggtatgagcaaagaaccgggggtcgtgagtcccacatcctaccttgacgttgatctccacccagccagcgcatggactctgtatgccgtggctacgaccgtcatcacacctatgttgcgacatactattgagaattctaccgcaaacgtatcactggccgcgatcgctaatcaagccgtggttttaatgggcctagacaagggatggcccatttccaagatggatctgggcgtgccactccttgcactggggtgctacagtcaggtcaaccctttgacactgaccgccgctgtgctcctgcttgtcactcactacgccatcataggacccggcttacaggcaaaagctacgagagaagcccagaagaggacagcggccggtattatgaaaaacccgaccgtggacgggatcatgactatcgatctggacccagttatttatgatagcaagtttgagaaacaactcggacaggtgatgttgctggtactatgtgcagtgcagctgctccttatgcggacctcgtgggctttctgcgaggccctgacattggcaactggccctatcaccacactgtgggaaggttctcccggcaagttttggaatacgaccatagctgtctccatggccaacattttccgcgggagctacctcgccggagcgggcctggctttttcaatcatgaagagtgttgggactggaaaaagaggcacaggttctcagggggagaccttaggagaaaagtggaaaaagaaacttaatcaactgtccaggaaggagttcgacctctataaaaagagcggcattactgaagtggatcggacagaggcaaaggagggtctaaaacgaggcgaaatcacccatcacgccgtctcaagagggagtgctaagctgcagtggttcgtggagcgcaacatggtaataccagaaggaagggtgatcgacttgggctgtgggcggggaggctggagctactattgcgccggtctgaaaaaggttacggaggtgcgtgggtacaccaaaggaggccccggccatgaagagcctgtcccgatgtccacatatgggtggaatattgtgaagctcatgtctggaaaggatgtcttttaccttcccccagagaaatgtgacactctgttgtgcgatatcggtgaaagctccccttcacccaccgtggaggaatctagaacaattagggttctgaagatggtagagccttggctcaaaaacaatcagttctgtatcaaggtgttaaacccatacatgcccactgtcattgagcacctggaacgccttcagcggaaacacggcgggatgctggtgcgaaatcctctaagtagaaactcgacccatgagatgtattggatcagcaatggaacaggcaacatagtttcctctgtgaatatggtctcaaggctcctgttgaaccgctttaccatgacttaccggagaccaacgattgaaaaggacgtggacctgggtgcagggacacgtcacgtaaatgccgagcccgaaaccccgaacatggatgtgatcggagagaggatccggcgcattaaggaggaacatagctccacttggcactatgacgatgagaacccttacaaaacctgggcttatcacggcagttacgaagttaaggcgacaggctctgccagctcaatgataaatggggtcgtgaaactccttacgaagccatgggacgtggtccccaccgttactcaaatggcaatgacagataccactcctttcggacagcagcgagtgtttaaagagaaggtagacacaagaaccccaaagcccatgccgggtacaaggaaagtgatggaaatcactgctgagtggctgtggcggaccttaggccgcaacaagagacctaggctgtgcacgcgagaggaattcaccaaaaaggtccggacaaatgccgcaatgggggccgtgtttactgaggaaaaccaatgggattccgctcgtgccgcggttgaggacgaagagttctggaaattggtggatagagagcgcgaactccataagctgggaaaatgtggcagttgcgtctataatatgatgggtaagagggagaagaaactaggggaatttggaaaggcaaaaggcagccgggccatttggtacatgtggcttggcgctagatacctggagttcgaggccctcgggtttctgaacgaagaccactggttctctcgcgagaattcctattcaggagtggaaggtgagggcttgcataagctggggtacatcctcagggatattagcaaaatccccggaggcgcaatgtatgctgacgacaccgccggttgggatacacgaataactgaagacgatcttcacaacgaggagaagatcacccagcagatggacccagaacatcggcagctggctaatgccatttttaagttaacgtaccaaaacaaagtagttaaggtgcagagacctacacccaaagggaccgtcatggatatcatttcgaggaaggaccagcgcggatctggccaggtgggcacttatgggctgaatacattcaccaacatggaggcacaattgatccgtcagatggaaggagagggtgtgctcagtaaaactgatctggaaaatccacacctacttgagaagcggataacccagtggctggagacaaagggcgtcgaaagactcaaaaggatggcgatttccggggacgattgcgttgtgaagcccatcgacgatcgcttcgccaacgctctgttggccttaaatgacatgggaaaagtacgaaaggatatccctcagtggcaaccaagcaaaggctggcacgactggcagcaggtgccgttttgttcacatcacttccatgagctgattatgaaggacggtcggaagctcgtcgtgccctgcagacctcaggatgaacttatagggagggcacgcatctcccaaggagctggctggtctctgaaagagacggcctgtctaggcaaggcatacgcccagatgtgggcgctgatgtattttcacagacgggacctcaggttggctagcaacgccatttgcagtgcagttccagtgcactgggtccccacctcccgtactacatggagcatccatgcccaccatcagtggatgaccactgaagatatgctgacagtgtggaaccgagtatggattgaggacaatccttggatggaggataaaaccccagttacgacatgggaagacgtgccctaccttgggaagcgcgaggatcaatggtgtggatctctgatcggtctcacctcaagagctacttgggcccagaacatattaaccgcaatccagcaggtccggagtctgattggcaatgaagagttcttggactacatgccttccatgaaaaggtttcgcaaggaggaagagagcgaaggggctatctggtga

SEQ ID NO: 15088 - RNA, 9873 nt, synthetic construct
  misc_feature 1..9873: note = derived and/or modified CDS sequence (opt3) from DENV-3__JX669489__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagcccatagagggaaaagtggtccagtatgaaaatctgaagtacacagtgattatcactgttcacaccggtgaccagcatcaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaaaaacaaggcgtggatggtgcacaggcagtggtttttcgatctccccctgccttggacaagcggggccaccactgaaacaccaacgtggaatcggaaagagcttctggtaacctttaagaacgcacatgctaaaaagcaagaagttgtggtcttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtgctcaagaaagaggtctctgaaacgcagcatgggaccatcctgattaaggtggagtaccgcggagaagatgctccctgtaagatccctttctccacagaggacggccaaggtaaagcgcacaacgggagacttataactgcaaatccagttgtgaccaagaaagaggaacccgtaaacattgaggccgaaccgcctttcggcgagtcaaatatcgtcatcggaattggcgataacgctttgaagatcaattggtataaaaaggggagcagtattggaaagatgtttgaagccacagcaaggggtgcccggcgaatggctatactgggcgacactgcctgggatttcgggtctgtgggaggcgttctcaactccctgggtaaaatggtgcatcagatctttgggagcgcatacaccgcgcttttctcgggcgtctcttgggtgatgaagattggaatcggcgtactgttgacgtggatcgggctcaattccaaaaacacatcaatgagttttagctgcattgctataggaatcattaccctgtatttaggcgccgtggttcaggcagacatgggttgtgtcatcaattggaaggggaaagagctgaagtgcggatccggcattttcgtgactaacgaggtgcacacatggaccgaacagtacaagtttcaagccgattctcccaaacgcctagctactgccatcgcaggtgcttgggagaatggcgtctgtgggataagaagcaccacaaggatggaaaacctcctgtggaagcagatcgccaatgagcttaactatattttgtgggaaaataacatcaaactgacggttgtggtgggagacattatcggcgtactcgagcaggggaagcggaccctgactccacagcctatggagttaaaatactcatggaagacatggggaaaagcgaagatagtcaccgccgaaacacaaaacagttccttcattatcgatggccccaatactccagagtgccccagcgcttctcgcgcatggaacgtgtgggaagttgaggactatggttttggggtgttcaccacgaatatttggctgaagcttagagaagtctacacacagttgtgtgaccataggctcatgtcagccgctgtgaaagatgagcgtgccgttcacgcagacatgggatactggatcgagagtcagaagaacggcagctggaaactggaaaaggcgtccctaatagaggtgaaaacctgcacttggcctaagtctcacaccctgtggtcgaatggtgtactcgaaagcgatatgatcattccaaagtccctggccggcccgatctcacagcataaccaccggcccgggtatcatacacaaactgctggaccttggcaccttggcaaattggagctggactttaattactgcgaggggaccacagtcgtgattacggaaaactgtggaacccgaggcccaagtttaagaactacaaccgtgtctggtaagctcatccacgagtggtgctgtaggagctgcactctgccccctcttcgctatatgggggaagatggatgttggtacggcatggagatacggccaatttccgaaaaagaggagaatatggtcaagtcactggttagcgccggttctggcaaagtggacaacttcacaatgggggtattgtgcctcgcaatcctgtttgaagaggtgatgagaggaaagttcggcaagaaacatatgatcgctggggtcctattcacctttgtgctgctcctgtccggacagattacgtggagggatatggcccacactcttatcatgattggcagtaatgcaagcgaccgcatgggtatgggggttacctatttggccctgatagctacattcaagatccagccctttttagcgctcggattctttctgcgaaaacttacctctcgggaaaacctgctactcggcgtgggcctggccatggcaactacattgcaactgccggaggatattgaacagatcgctaatgggattgccttaggactcatggccctgaagcttatcacccagttcgagacataccagctgtggactgctttgatatccctcacctgttcaaacacgatgtttacactgaccgtcgcatggcgtactgccaccctaatcctggcgggtgtgagtcttctccctgtttgccaaagctcgtccatgagaaaaacagactggctgccaatggctgtggccgcaatgggcgtcccccctttgcccctgttcattttttctttaaaggatactctcaagaggcgcagctggccactgaatgagggggtaatggccgtgggacttgtttcaatcctggctagttccttgctccggaacgacgtgcctatggcaggccccctggtcgccggtgggctactgattgcgtgttatgtgatcaccggaacgtctgctgatcttacagtagaaaaagccgcagacataacctgggaggaagaggccgaacagactggcgtgagccataacctcatgattacagtcgacgatgacggcaccatgagaatcaaggatgacgagactgagaatatcctgacagttttgttaaaaaccgctctgctcattgtgtccggggtgttcccatactcaataccggccacgctgcttgtctggcacacttggcagaagcagacccaaaggagcggagtgctgtgggatgttcctagtcccccagaaacacagaaagcagagttggaagagggtgtataccgaatcaagcagcagggcatttttgggaaaacccaagtgggagtcggcgtgcagaaggagggtgttttccatacaatgtggcacgtgactcgcggggctgtcctaacctataacggaaagcggctggaacccaattgggcctctgtgaaaaaggacctcatctcctacggcggcgggtggagactgagcgcgcagtggcaaaaaggagaggaagtacaggtcattgccgtggagcctggtaagaacccaaaaaattttcagacgatgcccggcacattccagactaccacaggggaaatcggagcaatagctcttgatttcaagcctggcacctcgggttcaccgatcattaacagggaggggaaggttgtgggattatatggcaatggcgtcgtgactaaaaacgggggatacgtttctggtatcgcccaaaccaatgctgagccagacggccccacacctgaactggaggaagagatgtttaagaaacgtaacctcacgattatggatttgcacccagggagtggaaagactcgcaaatatctgcccgcaatcgtgcgggaagccataaagagaaggctccgaaccctgattcttgcccctacacgggtcgtggctgcggagatggaggaagcactgaagggcttgccgatccgctaccagaccactgccacaaaatccgagcataccggtagagaaatcgtagacctaatgtgccacgctacgttcactatgaggctgctcagccccgtgcgggttccaaattataacttaattatcatggatgaggcccattttacagaccctgcatctatagccgctcgagggtacattagcaccagagtcggaatgggcgaagcggccgcaatcttcatgaccgctactcccccaggcacagccgatgcatttcctcagtccaatgcccccattcaggacgaggagcgcgacatcccagaaaggtcatggaacagtgggaatgagtggataaccgatttcgctggaaagacagtgtggtttgtgccgagcattaaagccggtaacgacatcgcgaactgtctgcgtaagaatggcaaaaaggtcatccaactttctcggaagactttcgatacggaataccagaaaaccaagctgaacgactgggattttgtagtgacaactgacatttccgagatgggggcaaatttcaaagccgatagagttatcgaccctaggcgctgcctcaagcccgtgattttgaccgatggaccagagcgagtcatactggctggccccatgcctgtgacagccgcttcagcagcccagagacggggtagggttgggcgcaacccacagaaagaaaatgaccaatatatctttaccggccagcccctcaacaatgatgaggaccacgctcattggactgaagccaagatgctgcttgacaacattaatacgcctgagggaatcatcccggcactattcgaaccagagcgtgagaagagtgcggccattgatggcgaatacagactgaaaggggagagccggaagaccttcgtggaattgatgaggcgcggagacttacccgtctggctggctcacaaagtggcctccgagggtataaagtatacagatcgaaaatggtgctttgacggccagagaaacaatcagatcctcgaagagaacatggatgtagagatttggactaaggaaggggagaaaaagaagctgcggcctaggtggcttgacgcacgcacctactctgatcccctggctctcaaagaattcaaggactttgccgcaggaagaaaatcgatcgccttggatctggtgacagagattggcagggttccaagccacctagctcatcggacccgtaatgcgctggacaacctcgtcatgcttcacacttcagaacatggtgggcgcgcctatcgacacgcagtggaggagctgcctgaaacaatggagacgttattgctgctcggcctgatgatccttctgaccggaggcgctatgctcttcttgatatccgggaagggaatcggtaaaactagtattggcctgatctgtgtgattgcctctagcgggatgttatggatggccgaaatccccctacaatggatagcatccgctattgtcctggagtttttcatgatggttctccttatcccagagcctgaaaagcagagaacaccgcaggataatcaactggcctacgtggtaattggaatcttgaccctggcggctataatcgccgcaaacgagatgggcctcctggaaaccacaaagagggaccttggtatgtcaaaagagcccggggtggtctctccaactagctatctcgatgtggacctgcaccctgccagtgcttggacgttgtacgcagttgccaccacagtgattactcccatgctgcggcataccatcgaaaattccacagcgaacgtcagcttagctgccattgcaaaccaggccgtagtgctaatgggcctggacaagggatggccaatctctaaaatggatctcggcgttcctcttctggctttggggtgctactcacaggtgaatcccctgaccctcactgccgcagtcctgcttttaataacgcactatgctattatcggaccgggcctgcaggccaaggcgacacgcgaggcccaaaaaagaaccgcagctggtatcatgaagaacccaactgtggacgggattatgaccatcgatctcgaccctgtcatatacgattccaagtttgagaaacagttgggacaggtgatgctgctagttctgtgtgccgtgcagctccttctgatgaggacaagttgggcattgtgcgaagctctgactctcgccaccggccccattacaacgctgtgggagggtagcccaggcaagttctggaataccactatcgccgtatcgatggcgaacatttttcgggggtcttatttagctggagcaggccttgccttctccatcatgaaaagcgtggggacaggaaagcgaggcaccggttcacaaggggaaactctgggagagaaatggaagaagaaactcaatcagctaagtagaaaggaatttgacctgtacaaaaagtctggcataacagaggtcgatcgcaccgaggctaaagaaggtttgaagaggggcgagatcacgcatcacgccgtttcccgggggagcgcaaaactgcagtggttcgtggaacgtaacatggtcattcccgagggaagagtgatcgacctcggctgtgggaggggaggctggtcatattactgcgccggtcttaagaaggtaaccgaagtgcgcgggtatacaaaaggaggccctggccatgaggagccggttcccatgagtacttacgggtggaatattgtgaagctgatgagcggaaaagatgtcttttacttgccacctgaaaagtgtgacaccctgctctgcgatatcggtgagtcctctcccagccctacagtggaagagtcccggactattcgagtcttaaaaatggtggagccatggctgaagaacaatcagttctgtatcaaggttcttaacccctatatgcctaccgtaatagaacacctggagagactacaaaggaaacacggcgggatgctcgtgcgcaatccactgtcacggaactctacacatgaaatgtactggattagtaatggaaccggcaacatcgtcgcttcggtgaatatggttagcagattgctgctcaaccgtttcactatgacgcacaggcggcccacaatcgagaaggacgtggatcttggtgcggggacccgccatgtcaacgccgaaccggagactcctaatatggacgtgattggagagcgaataaaaagaatcaaggaagagcacaactccacctggcactatgacgatgaaaatccatacaaaacatgggcatatcatggctcttacgaggtaaaggctacgggctcagccagctccatgattaacggggtggttaagctgttaaccaaaccctgggacgtcgtgcctatggtgactcagatggcaatgacagataccactccatttggacagcaaagggtcttcaaggaaaaagttgacacacggaccccccgcagtatgccgggtacaagaagggtgatgggcatcactgccgagtggctgtggcgaaccttggggcggaataagaaacctcgtctctgcacgagagaggaatttaccaagaaggtacgcacaaacgctgccatgggagcggtgttcactgaggaaaatcagtgggattctgcaaaagccgctgtcgaggacgaagatttttggaagctggtggacagggagcgggagctacacaaacttggcaagtgtggtagctgcgtttataacatgatggggaaaagagaaaagaaactgggagagttcggcaaggccaagggctcacgcgcaatttggtacatgtggctcggggctaggtacctggaatttgaggccttgggattcctgaatgaggatcattggttttcccgagaaaacagttatagcggtgtggagggcgaagggctccacaaacttggatacatcctgcgggacatatctaagatccccggcggtgctatgtatgccgatgacaccgcagggtgggacacaagaattactgaggatgacttacataatgaagagaaaatcacccagcagatggatccagagcacaggcaactggcgaacgccattttcaagttgacgtaccagaataaagtcgtgaaggtacagcgccctacacccaccggaactgttatggacatcatatcccgtaaggatcagcggggctcaggccaagtggggacatatggactcaacacctttactaatatggaagctcagctgattagacagatggagggtgaaggcgtcctaagcaaagccgaccttgagaacccacacctgcccgaaaagaaaatcacccagtggctcgagacaaagggggtggagaggctgaaacgcatggcaatctcgggagatgactgcgtggtcaagcctattgatgaccgattcgctaacgccttgttagcactgaatgatatgggcaaggttcggaaagacataccacaatggcagccgtctaagggttggcatgattggcagcaggtgcccttttgtagtcaccatttccacgaactcatcatgaaagacgggagaaagcttgtagtgccttgcaggccacaagacgagctgattggacgcgccagaatctcccagggcgcgggctggagcctacgggaaacggcttgtctggggaaagcctacgcacagatgtggtcactcatgtatttccacaggcgtgatttgcgactggcctccaacgctatttgctctgccgtccccgtgcattgggttcctaccagccgcactacatggagtatccacgcacatcaccaatggatgaccactgaggacatgcttacagtgtggaatagagtctggatagaagataacccatggatggaggacaagacccccgtgacgacatgggagaatgtaccttacctgggaaagcgggaagatcagtggtgtggttccctcatcggcttaaccagcagggctacttgggcccagaacattccgaccgcgatccagcaagttcgctctctgattgggaatgaggaatttttggactacatgccatcaatgaaaagattccggaaggaggaggaaagtgagggagctatctggtga

SEQ ID NO: 15089 - RNA, 9873 nt, synthetic construct
  misc_feature 1..9873: note = derived and/or modified CDS sequence (opt3) from DENV-3__JX669498__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagtccatagagggaaaagtggtccagtatgaaaatctgaagtacacagtgattatcactgttcacaccggtgaccagcatcaggtgggcaacgagacacaaggggtcaccgcagaaattactccccaggcttctacgacagaggccatcctccctgaatatggaacccttggcctggagtgcagcccaagaactggtttggacttcaatgagatgatcctactgaccatgaaaaacaaggcgtggatggtgcacaggcagtggtttttcgatctcccgctgccctggacatccggggccaccactgaaacacctacgtggaatcggaaagagcttctggtaacctttaagaacgcacatgctaaaaagcaagaagttgtggtcttgggctcacaggagggagccatgcacactgctctcacaggcgccaccgaaattcagaatagtgggggaacaagcatattcgcaggtcacctgaagtgtcgtttaaaaatggacaagctggagctaaaaggcatgtcttacgccatgtgcactaacacctttgtgctcaagaaagaggtctccgaaacgcagcatgggaccatcctgattaaggtggagtacaagggagaagatgctccatgtaaaatccccttctcaacagaggacggccaaggtaaggcgcacaacgggcgccttataactgcaaatcctgttgtgaccaaaaaggaggaaccagtaaacattgaggccgaacccccgttcggcgagagcaatatcgtcatcggaacaggcgataacgctttgaaaattaattggtataagaaggggagttctatcggaaaaatgtttgaagccactgcaagaggtgccaggcggatggctattctgggcgacaccgcctgggatttcgggtccgtgggaggcgttctcaacagcctgggtaagatggtgcatcagatatttgggtcggcatacacggcgcttttctctggcgtctcctgggtgatgaaaatcggaattggcgtactgttgacatggatcgggctcaattcaaagaacaccagtatgagcttttcctgcatcgctattggaataatcactctgtatttaggcgccgtggttcaggcagacatgggttgtgtcattaattggaaagggaaggagctgaagtgcggatctggcatcttcgtgacaaacgaggtgcacacctggactgaacagtacaaatttcaagccgatagccctaagcgactagctaccgccattgcaggtgcttgggagaatggcgtctgtgggatccgctcaacaacgagaatggaaaacctcctgtggaaacagatagccaatgagcttaactatatcttgtgggaaaataacattaagctgaccgttgtggtgggagacatcattggcgtactcgagcaggggaaaaggactctgacaccccagccaatggagttaaagtacagttggaaaacctggggaaaggcgaagatcgtcacagccgaaactcaaaactccagcttcataattgatggccctaatacccccgagtgcccatctgcttcacgggcatggaacgtgtgggaagttgaggactatggttttggggtgttcacgacaaatatctggctgaaacttcgcgaagtctacacccagttgtgtgaccatagactcatgagtgccgctgtgaaggatgagagggccgttcacgcagacatgggatactggattgagagccagaaaaacggctcctggaagctggaaaaagcgtctctaatcgaggtgaagacttgcacctggcccaagtcgcacacactgtggagcaatggtgtactcgaatccgatatgataatccctaaatcactggccggcccaattagtcagcataaccaccgtccggggtatcatactcaaaccgctggaccctggcaccttggcaagttggagctggactttaattactgcgaggggacaacggtcgtgatcaccgaaaactgtggaactcggggcccttctttacgaacaaccactgtgagcggtaaactcattcacgagtggtgctgtagatcctgcacactgccaccccttaggtatatgggggaagatggatgttggtacggcatggagatccgccctatatcagaaaaggaggagaatatggtcaaaagcctggtttctgccggttccggcaaggtggacaacttcaccatgggggtattgtgcctcgcaattctgtttgaagaggtgatgcggggaaagttcggcaaaaagcatatgatcgctggggtcttctttacgttcgtgctactgctcagtggacagatcacttggagagatatggcccacaccctgattatgatcggcagcaatgcatctgacaggatgggtatgggggttacatatcttgccttgattgctacctttaaaatacagccattcctggcgttaggatttttcctccgcaagctgacttcccgagaaaaccttctgctaggcgtgggcctcgccatggcaacaaccctgcaattgcccgaggatatcgaacagatggctaatgggattgccctgggattaatggccctcaaactgatcacacagtttgagacttaccagctttggaccgctctgatttcattgacgtgtagtaacacaatgttcaccctcactgtcgcatggcggaccgccacactgatcctagcgggtgtgagcctgcttccggtttgccaatcgtcctctatgcgtaagactgactggctccctatggctgtggccgcaatgggcgtcccacccctgcctttgtttatattcagcctgaaggataccttaaaaagaaggtcatggcccctcaatgagggggtaatggccgtgggactggttagtatccttgcttcctctctgttgcgcaacgacgtgccaatggcaggccctctcgtcgccggtgggctgctaattgcgtgttatgtgatcacgggaacaagcgctgatctgaccgtagaaaaggccgcagacattacttgggaggaagaggccgaacagacaggcgtgtcccataaccttatgatcaccgtcgacgatgacggcactatgcggataaaagatgacgagacagagaatattctcaccgttctgttgaagacggctttactgatcgtgtcaggggtgtttccctacagcatcccagccactctcctggtctggcacacctggcagaaacagacacaaagaagtggagtgctttgggatgttccgtctcctcccgaaacccagaaggcagagctggaagagggtgtatacaggattaaacagcagggcatattcgggaagacacaagtgggagtcggcgtgcagaaggagggtgtttttcatactatgtggcacgtgacccgaggggctgtcttgacgtataacggaaaacgcctagaaccaaattgggcctccgtgaagaaagacctgatcagctacggcggcgggtggcggctctcggcgcagtggcaaaagggagaggaagtacaggtcattgccgtggagcccggtaaaaaccctaagaatttccagacaatgccaggcactttccagaccacaaccggggaaatcggagcaattgctctggattttaagcccggcacttcaggttctcctatcataaacagagaggggaaagttgtgggactttatggcaatggcgtcgtgaccaagaacgggggatacgttagtggtatcgcccaaacaaatgctgagccggacggcccaacgcccgaattagaggaagagatgttcaaaaagaggaacctgactattatggatctccaccctgggtccggaaaaacccgtaagtatttgccagcaatcgtgcgcgaagccattaagcggagactgaggacactcatcctggcccccacccgagtcgtggctgcggagatggaggaagcacttaaaggcctgcctatacggtaccagactacagccaccaagagcgagcatacgggtcgcgaaattgtagacttgatgtgccacgctacttttacaatgagactactgtctccggtgagggttcccaattataacctcatcatcatggatgaggcccatttcaccgacccagcaagcattgccgctcgggggtacatctccacccgagtcggaatgggcgaagcggccgcaatatttatgactgctacacctcccggcaccgccgatgcattcccacagtcaaatgcccctattcaggacgaggagagagacatccccgaacgcagttggaacagcgggaatgagtggattacagattttgctggaaaaactgtgtggttcgtgccatctatcaaggccggtaacgacatagcgaactgtttaaggaaaaatggcaagaaggtcattcaactgtcccgtaaaacgtttgataccgaataccagaagacaaaacttaacgactgggatttcgtagtgactaccgacatctcagagatgggggcaaattttaaggccgatcgggttatcgacccgagaaggtgcctgaaacctgtgattctcacagatggacccgagcgcgtcatcttggctggcccaatgcccgtgaccgccgctagtgcagcccagcgaagaggtcgggttgggaggaaccctcagaaggaaaatgaccaatatattttcactggccagccactgaacaatgatgaggaccacgctcattggacggaagccaagatgctcctggacaacataaatacccccgagggaatcattcctgcacttttcgaaccggagcgcgagaaaagcgcggccatcgatggcgaataccgtctaaagggggagtccagaaaaacatttgtggaactgatgcggaggggagacttgccagtctggttagctcacaaggtggcctctgagggtatcaaatatactgatcgcaagtggtgcttcgacggccagcgaaacaatcagattctggaagagaacatggatgtagagatatggaccaaagaaggggagaagaagaaactcagaccccggtggctggacgcaaggacatactcggatcctcttgctctgaaggaatttaaagacttcgccgcaggacgcaagagcatcgccctcgatttggtgaccgagattggcagagttccctcacacctggctcataggactcggaatgcgctagacaacctggtcatgctccacacatccgaacatggtgggcgtgcctatcgccacgcagtggaggagcttccagaaacgatggagaccctgttattgctgggcctcatgatcctgcttactggaggcgctatgctgtttctcattagtgggaaaggaatcggtaagacatctataggcttgatctgtgtgattgccagctccgggatgctgtggatggccgaaatccctttacaatggattgcatcagctatcgtcctagagttctttatgatggttctgctcatacccgagccagaaaagcagcgaacccctcaggataatcaacttgcctacgtggtaattggaatcctgaccttggcggctattatcgccgcaaacgagatgggcctgctcgaaacaactaaaagagacctgggtatgtctaaggagccgggggtggtcagccccacgagttatcttgatgtggacctccacccagcctccgcttggaccctgtacgcagttgccacaactgtgataacccctatgttgaggcatacaatcgaaaatagcaccgcgaacgtctctctggctgccattgcaaaccaggccgtagtgttaatgggcctagacaaaggatggcccatctcaaagatggatctgggcgttccactccttgctctggggtgctactcccaggtgaatcctttgactctgacggccgcagtcctcctgcttattacacactatgctatcataggacccggcttacaggccaaagcgacccgggaggcccaaaagcgcactgcagctggtattatgaagaacccgaccgtggacgggatcatgacaatcgatctggacccagtcatttacgatagtaaattcgagaagcagctcggacaggtgatgttgctggttctatgtgccgtgcagctgctccttatgagaactagctgggcactgtgcgaagctttgaccctggccacaggccctatcacgaccctctgggagggttcgcccggcaaattttggaatactacaatagccgtatctatggcgaacattttcagggggtcctatctggctggagcaggcttagcctttagcatcatgaagtcagtggggaccggaaaacggggcactggtagtcaaggggaaacacttggagagaagtggaagaaaaagctgaatcagctctctcgaaaagaattcgacctatacaagaaatccggcattaccgaggtcgatagaacggaggctaaggaaggtctgaaacgcggcgagatcacccatcacgccgttagcagggggtcagcaaagttgcagtggtttgtggaacggaacatggtcataccagagggacgtgtgatcgacctgggctgtgggagaggaggctggagttattactgcgccggtctcaagaaagtaacagaagtgagggggtatactaagggaggccccggccatgaggagcctgttccgatgagcacctacgggtggaatattgtgaaacttatgtccggaaaggatgtcttctacctgcccccagaaaaatgtgacacattgctgtgcgatatcggtgagtctagcccttcccccactgtggaagagtcacgcaccattcgggtcctcaagatggtggagccttggttaaagaacaatcagttctgtatcaaagttctgaacccatatatgcccacagtaattgaacaccttgagcgactgcaaagaaagcacggcgggatgctagtgaggaatcctctctctcgcaacagtacccatgaaatgtactggatctcgaatggaactggcaacatagtcgctagcgtgaatatggtttcccggctgttgctgaacagatttacgatgacacaccgtaggccaaccattgagaaagacgtggatctcggtgcggggactcggcatgtcaacgccgaacccgagaccccgaatatggacgtgatcggagagcgcatcaagcgaattaaagaagagcacaactctacatggcactatgacgatgaaaatccttacaagacgtgggcatatcatggctcatacgaggtaaaggctaccggcagcgcctccagtatgataaacggggtggttaaacttctgactaagccatgggacgtcgtgcccatggtgacacagatggcaatgaccgatactacacctttcggacagcaaagagtctttaaagaaaaggttgacaccaggacaccacggtctatgcccggtactcgcagagtgatgggcatcaccgccgagtggttatggaggacgctggggcgaaataaaaagccgcggttgtgcacccgtgaggaattcacaaagaaagtaagaactaacgctgccatgggagcggtgtttaccgaggaaaatcagtgggatagcgcaaaggccgctgtcgaggacgaagatttctggaaactcgtggaccgcgagagggagctgcacaagctaggcaaatgtggttcatgcgtttataacatgatggggaagcgggaaaaaaagcttggagagtttggcaaggccaaaggctccagagcaatttggtacatgtggctgggggctcgctacctcgaattcgaggccctgggatttttgaatgaggatcattggttcagtagggaaaacagctattctggtgtggagggcgaagggctgcacaagctcggatacatccttcgagacatttccaaaatccctggcggtgctatgtatgccgatgacacagcagggtgggacactcggataaccgaggatgacctgcataatgaagagaagatcacgcagcagatggatcccgagcacagacaattagcgaacgccatttttaaactgacataccagaataaggtcgtgaaggtacagaggccaacccctactggaacagttatggacatcatttcacgcaaagatcagcgtggcagcggccaagtggggacctatggattgaacactttcaccaatatggaagctcagctcatccggcagatggagggtgaaggcgtcctgtcgaaggccgacctagagaacccccaccttccagaaaaaaagataacacagtggctggagacgaaaggggtggagagactcaagaggatggcaatttctggagatgactgcgtggtcaagcccatcgatgaccgctttggcaacgctctgttggccttaaatgatatgggtaaagttcgaaaggacatccctcaatggcagccaagtaaagggtggcatgattggcagcaggtgccgttctgttcccaccatttccacgaactgattatgaaggacggacggaaactcgtagtgccctgcagacctcaagacgagcttataggcagggcacgcatcagccagggcgccgggtggtcactgagagaaaccgcgtgtctaggaaaggcttacgcccagatgtggtccctgatgtattttcaccggagggatctccgtttggcatctaacgccatttgcagcgctgtcccagtgcattgggttcccactagtcgaacaacctggtccatccacgcccatcaccaatggatgactacagaggacatgctgaccgtgtggaatcgcgtctggattgaagataacccttggatggaggacaagacgccagtgacaacctgggagaatgtaccctaccttggtaaaagagaagatcagtggtgtggcagcctgatcgggctcacttctcgggcaacctgggctcagaacatacctacagccatccagcaagttaggtcattaattggaaatgaggaattcctggactacatgccgagtatgaagcgctttagaaaagaggaggaatccgagggcgcgatctggtga

SEQ ID NO: 15090 - RNA, 9873 nt, synthetic construct
  misc_feature 1..9873: note = derived and/or modified CDS sequence (opt3) from DENV-3__KF954946__SS-prME
  source 1..9873: mol_type = other RNA
accagcctgtgcctcatgatgatccttcccgccgctctggcattccacttgacttccagggacggcgagcctaggatgattgtggggaagaacgaacggggaaagtctttactgtttaagactgcctcaggtataaatatgtgtacgctcatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgccgagacaagcgtagcgtcgcccttgcaccccatgtgggcatgggtctggatacaagaacccagacgtggatgtccgccgagggggcttggaggcaggtcgaaaaggtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccatccttaggaaactgtgtattgagggaaagatcacaaacataaccacggatagccggtgccctacccagggcgaagctgtcttgccagaggaacaggaccagaattatgtttgtaaacacacatacgtggatcgcggttgggggaacggatgcggcctcttcggcaaggggagtctggtaacttgcgccaagtttcaatgtttagagcccattgagggaaaagtggtccagtatgaaaatctgaagtacaccgtgatcattacagttcatactggtgaccagcaccaggtgggcaacgagacccaagggatcacagcagaaatcacccctcaggcttccactacggaggccattctcccagaatatggaacacttggcctggagtgctctccgcgaaccggtttggacttcaatgagatgatactactgactatgaaaaacaaggcgtggatggtccatagacagtggtttttcgatctccccctgccttggaccagcggggccacaaccgaaactccaacatggaataggaaagagcttctggtgacgtttaagaacgcacacgctaaaaagcaagaagtagttgtgttgggctcccaggagggagccatgcacaccgctctcactggcgccacagaaatccaaaattcagggggaaccagtattttcgcaggtcatctgaagtgtcggttaaaaatggacaagctggagctaaaaggcatgagctacgccatgtgcacaaacacttttgtcctcaagaaagaggtgtctgaaacccagcacgggacgatcctgataaaggtcgagtacaagggagaagatgctccctgtaaaattcctttctccaccgaggacggccaaggtaaggcgcataacgggcgtcttatcacagcaaatccagtggttactaaaaaggaggaacccgtgaacatcgaggccgaaccgcctttcggcgagtcaaatattgtaatcggaattggcgataacgctttgaaaataaattggtataagaaggggagcagtatcggaaaaatgtttgaagccaccgcacgcggtgccagaaggatggctattctgggcgacacagcctgggatttcgggtctgtcggaggcgtgctcaactccctgggtaagatggttcaccagatctttgggagcgcatacactgcgcttttctcgggcgtgtcttgggtcatgaaaatcggaattggcgtgctgttgacctggatagggctcaattccaagaacacgtcaatgagttttagctgcatcgctattggaatcattacactgtatttaggcgccgtagtgcaggcagacatgggttgtgttatcaattggaaagggaaggagctgaagtgcggatccggcatattcgtcaccaacgaggtgcatacttggacagaacagtacaaatttcaagccgattctcccaagcggctagctaccgccatcgtgggtgcatgggagaatggcgtctgtgggattcgaagcactacccgcatggaaaacctcctgtggaaacagatcgctaatgagcttaactatattttgtgggaaaataacatcaagctgacagttgtggtgggagacacgataggcgtactcgagcaggggaaaagaaccctgactccacagcctatggagttaaagtactcatggaaaacatggggaaaggccaagattgtcaccgcggaaacacaaaacagttccttcatcattgatggccccaatactccagagtgccccagcgcctctagggcttggaacgtgtgggaagttgaggactatggttttggggtgttcaccacgaatatctggctgaaacttcgggaagtctacacacagatgtgtgaccaccgcttgatgtcagcagccgtgaaggatgagagagctgttcacgccgacatgggatactggatagagagtcagaaaaacggcagctggaagctcgaaaaagcatccctgatcgaggtgaagacctgcacttggcctaagtctcataccctatggtcgaatggtgtactggaaagcgatatgattatcccaaaatccctcgcgggcccgatttcacagcacaactataggcccgggtaccatacacaaactgccggaccttggcacctgggcaaacttgagttggactttaattattgcgaggggaccacagtcgtgatcacggaaaactgtggaacccgtggcccaagtctgcggactacaaccgtgtctggtaaattaatacacgagtggtgctgtcgaagctgcactctaccccctctgagatacatgggggaagatggatgttggtatggcatggagattaggccaatctccgaaaaggaggagaatatggtcaaatcacttgttagcgctggttctggcaaggtggacaacttcacaatgggggtactgtgcttggccatcctctttgaagaggtgatgcgcggaaagttcggcaaaaagcatatgattgcaggggtcttctttaccttcgtgctgctactgtccggacagatcacgtggcgggatatggctcacactctcattatgataggcagtaatgccagcgacagaatgggtatgggggttacctacctggcacttatcgccacatttaaaattcagcccttcttggctctgggatttttcttaaggaagctcacctctcgcgaaaacctgcttctgggcgtgggcctagcgatggccactacactccaactgccggaggatatcgaacagatggcaaatgggattgctttgggactgatggccttaaaactcatcacccagtttgagacatatcagctgtggactgcccttatatccctgacctgttcaaacacgatcttcacattgaccgtcgcttggcgaactgcaaccctcattctggccggtgtgagtctactgcctgtttgccaaagctcgtccatgcggaagacagactggcttccaatgactgtggcggctatgggcgtaccccctctccccctgtttatcttctctttgaaggataccctgaaacgtagaagctggccattaaatgagggggtaatggccgtgggactcgtttcaatgctggcaagttcccttctgaggaacgacgtgcctatggccggccccttggtcgctggtgggctcctgattgcatgttacgtgatcacgggaacatctgccgatctaaccgtagaaaaggcggctgacgtgacttgggaggaagaggccgaacagacaggcgtcagccataacctgatgataaccgttgacgatgacggcactatgcgcattaaagatgacgagacagagaatatccttaccgtgctcctgaagacggcattgttaatcgtgtccgggatttttccatactcaataccggccactctgctcgtctggcacacctggcagaaacagacacaacggagcggagtgctgtgggatgttcctagtcccccagaaacccagaaggctgagcttgaagagggtgtatatagaatcaaacagcagggcattctggggaagacacaagtgggagtcggcgtgcagaaggacggtgttttccatactatgtggcacgtgaccagaggggccgtcttgacgcacaacggaaaacgactagagcccaattgggcatctgtgaagaaagatctgatctcctacggcggcgggtggcgcctcagcgctcagtggcaaaagggagaagaggtacaggtcattgccgtggaacctggtaaaaacccaaagaattttcagacaatgcccggcactttccagaccacaaccggggagatcggagcgatagccctggacttcaagcctggcacttcgggttcaccgatcattaaccgggaagggaaagttgtgggactttatggcaatggcgtcgtgaccaagaacgggggatacgtttctggtatcgcacaaacaaatgctgagccagatggccccacgcctgagttagaagaggaaatgtttaaaaagagaaacctgactattatggacctccatccagggagtggaaaaaccaggaagtatttgcccgccatcgtgcgtgaggctataaagcgccggctgagaacactcattctggcacctaccagggtcgtggccgccgaaatggaggaggctcttaaaggcctgccgatccgataccagactacagcgaccaagtccgaacacacgggtcgggagatcgtagatttgatgtgccatgcaactttcacaatgcgcctactgagccccgtgagagttccaaattataacctcattatcatggacgaagcccactttaccgatcctgcttctatagccgcaagggggtacattagcacccgggtcggaatgggcgaggccgctgcgatcttcatgactgccacacccccaggcaccgcagacgcttttcctcagtccaatgcccccattcaggacgaggaacgagatatcccagagagatcatggaacagtgggaatgaatggataacagacttcgcaggaaaaactgtgtggtttgtgccgagcattaaggccggtaacgatatcgctaactgtttacgcaaaaatggcaagaaggtcatccaactgtctaggaaaacgttcgacaccgagtaccagaagacaaaacttaacgattgggactttgtagtgactaccgatatttccgaaatgggggccaatttcaaggcggaccgtgttatcgatcctcggagatgcctgaaacccgtgattctcacagacggaccagagagggtcatattggcaggccccatgcctgtgaccgccgcttcagccgctcagcgccgaggtagagttgggcggaacccacagaaggagaatgatcaatatatctttactggccagcccctgaacaatgacgaagaccatgcacactggacggaggccaagatgctcctggataacattaatacccctgaaggaatcatcccggctcttttcgagccagaaagggagaaaagtgccgcaattgacggcgagtaccgcctaaagggggaaagccgtaaaacattcgtggagctgatgagacggggagatttgcccgtctggttagcgcacaaggtggcctccgaaggtataaaatatactgacaggaagtggtgctttgatggccagcgcaacaatcagatcctggaggaaaacatggacgtagagatttggaccaaagagggggaaaagaagaaactccgacctagatggctggatgctcggacatactctgacccccttgccctgaaggagttcaaagattttgcagctggaaggaagtcgatcgccctcgacttggtgaccgaaattggccgcgttccaagccatctggcacacagaactaggaatgccctagataacctggtcatgctccatacatcagagcacggtgggcgggcttatcgtcacgcggtggaggaacttcctgagacgatggaaaccctgttattgctgggcctcatgatcctgcttactggaggcgccatgctgttcctcatatccgggaaaggaatcggtaagacaagtattggcttgatctgtgtgattgcatctagcgggatgctgtggatggctgagatccccttacaatggatagcctccgccattgtcctagaatttttcatgatggttctgctcatcccagagcctgagaagcagcgcaccccgcaggacaatcaacttgcatacgtggtaattggaatcctgaccatggctgccataatcgcggctaacgaaatgggcttgctggagacaactaaacgagatctcggtatgtcaaaggaacccggggtggtctctccaacgagctatctggacgtggaccttcatcctgccagtgcatggaccctctacgccgttgctacaactgtgattacccccatgctgagacacacaatcgaaaattccaccgcaaacgtcagcttggccgcgattgctaaccaggccgtagtgctgttaggcctagataaaggatggccaatctctaagatggacctgggcgttcctctccttgcactggggtgctactcacaggtgaatcccttgactctgacggccgctgtcctcctgcttgtgacacattatgccataattggaccgggcttacaggcaaaagctaccagggaagcccaaaagcggactgcggccggtatcatgaagaacccaaccgtcgatgggatcattacaatcgacctggatcctgtgatatacgactccaaatttgagaagcagctcggacaggttatgttgctggtgctatgtgcagtacagctgctccttatgcgcacaagttgggctctgtgcgaggccttgaccctggcaacaggccccattacgaccctctgggaaggtagcccaggcaaattctggaatactacaatcgctgtgtcgatggccaacatttttagagggtcttatctggccggagcgggcttagctttctccatcatgaaaagcgtcgggaccggaaaaaggggcactggttcacaaggggagacacttggagaaaagtggaagaaaaagctgaatcagctcagtcggaaagagtttgatctatacaagaaatctggcataaccgaagttgaccgaacggaggcaaaggagggtctgaaaagaggcgaaaccacacaccatgccgtgtcccgcgggagcgctaagttgcagtggttcgtcgagaggaacatggtgatccccgaaggacgggtaattgatctgggctgtgggcgtggaggctggtcatattactgcgccggtctcaagaaagtgactgaggttagagggtataccaagggaggccctggccacgaggaaccggtgcccatgagtacatacgggtggaatatcgtcaaacttatgagcggaaaggacgtgttttacctgccacctgagaaatgtgatactttgctgtgcgacattggtgaatcctctcccagccctaccgtcgaggaatccaggacaatccgcgtgctcaagatggttgagccatggttaaagaacaatcagttctgtattaaagtactgaacccctatatgcctgcagtgatcgagcaccttgaacggctgcaacgaaagcatggcgggatgctagtcagaaatccactctcaaggaactctacccacgagatgtactggataagtaatggaactggcaacattgtgtcgagcgttaatatggtgtcccgcctgttgctgaaccggttcacgatgacacatagacgtcccaccatcgaaaaagatgtcgacctcggtgccgggactaggcacgtgaacgctgagccggaaacccctaatatggacgtaatcggagagcggattaagcgcataaaagaggaacacaactctacatggcattatgatgacgagaatccatacaagacgtgggcgtatcacggctcatacgaagtgaaggccaccggcagcgcatccagtatgatcaacggggttgtcaaacttctgactaagccctgggatgtggtgcctatggtcacacagatggctatgaccgacactacaccatttggacagcaacgagttttcaaagagaaggtggataccagaacacccaggccgatgcctggtactcggaaagtaatggaaattaccgccgagtggttatggcgcacgctgggcagaaataagaggccccgattgtgcacccgggaggaatttacaaagaaagtgcgtactaacgcagccatgggggctgtcttcaccgaggaaaatcagtgggactctgccaaggcggcagtggaggatgaagagttttggaaactcgttgacagagagcgcgaactgcataagctaggaaaatgtggcagctgcgtgtataacatgatgggtaagagggagaagaaacttggggagttcggaaaagccaaaggctcacgggctatctggtacatgtggctgggcgccagatacctcgagtttgaggcactggggttcttgaatgaagatcactggttttcccgcgagaacagttatagcggagtcgaaggtgagggcctgcataagctcgggtacattcttagggacatctctaaaataccaggaggcgctatgtatgccgatgacacagctggttgggacactcgaatcaccgaagatgacctgcacaatgaggagaagattacgcagcagatggatcctgaacaccggttactggccaacgcaatcttcaaattgacataccaaaataaggtggtaaaggttcagagacccaccccaactgggacagtgatggacattatctccaggaaagatcagcgcggatcaggccaggtcggcacctatgggctcaacacttttaccaatatggaggcgcaactggtgcgtcagatggaaggagagggtgtgctaagcaagacagaccttgaaaacccccatctgcctgagaaaaagataacgcagtggctcgagaccaaaggcgtcgaacggctgaagagaatggccatttcgggggatgactgcgttgtgaagccaatcgatgacaggttcgctaacgccttgttagcactgaatgatatgggaaaagtacgcaaggacatcccgcagtggcaaccctctaaaggctggcacgattggcaacaggtgcctttttgtagtcatcacttccacgagctcattatgaaggacggtcgaaaacttgtcgtgccatgccggccccaggacgaactgatagggagagctaggatctcccaaggagccggctggagcctacgcgagactgcatgtctgggcaaggcctacgcgcagatgtggtcactcatgtatttccatagacgggatttgaggctggcttccaacgccatttgctctgcaatccctgttcactgggtgccaacaagccgtaccacttggagtattcatgcccaccatcagtggatgacaaccgaagacatgcttacggtctggaatcgagtgtggatcgaggataacccctggatggaggacaagacacctataaccacttgggaaaatgtaccgtacctggggaaacgcgaggatcaatggtgtggatccctcatcggtttaaccagcagagctacatgggcccagaacattccaactgcaatccagcaggttcggtctctgattggcaatgaagagtttttggactacatgccctcaatgaagaggttccgcaaagaggaagagagtgaaggggctatctggtga

SEQ ID NO: 15091 - RNA, 9873 nt, synthetic construct
  misc_feature 1..9873: note = derived and/or modified CDS sequence (opt3) from DENV-3__KF954947__SS-prME
  source 1..9873: mol_type = other RNA
accagcctgtgcctcatgatgatccttcccgccgctctggcattccacttgacatccagggacggagagcctaggatgattgtggggaagaacgaacggggaaagtctttactgtttaagactgcctcaggtataaatatgtgtacgctcatcgcgatggatctcggcgagatgtgcgacgataccgtcacctacaagtgtccacatattactgaagttgagccggaagacatcgattgctggtgtaacctgaccagtacatgggtgacctatgggacttgcaatcaggctggagagcaccgccgagacaagcgtagcgtcgcccttgcaccccatgtgggcatgggtctggatacaagaacccagacgtggatgtccgccgagggggcttggaggcaggtcgaaaaggtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaagggattaccgcagaaatcactcctcaggcttccacgacagaggccatcctcccagaatatggaacccttggcctggagtgctctccgcgaactggtttggacttcaatgagatgattctactgaccatgaaaaacaaggcgtggatggtccatagacagtggtttttcgatctccccctgccttggacaagcggggccaccactgaaacaccaacgtggaataggaaagagcttctggtgacctttaagaacgcacacgctaaaaagcaagaagtagttgtgttgggctcccaggagggagccatgcacactgctctcacaggcgccaccgaaatacaaaattcagggggaacaagtatcttcgcaggtcatctgaagtgtcggttaaaaatggacaagctggagctaaaaggcatgagctacgccatgtgcactaacacctttgtcctcaagaaagaggtgtctgaaacgcagcacgggaccattctgatcaaggtcgagtacaagggagaagatgctccctgtaaaatacctttctccacagaggacggccaaggtaaggcgcataacgggcgtcttattactgcaaatccagtggttaccaaaaaggaggaacccgtgaacatcgaggccgaaccgcctttcggcgagtcaaatatcgtaattggaatcggcgataacgctttgaaaattaattggtataagaaggggagcagtataggaaaaatgtttgaagccacagcacgcggtgccagaaggatggctatcctgggcgacactgcctgggatttcgggtctgtcggaggcgtgctcaactccctgggtaagatggttcaccagatttttgggagcgcatacaccgcgcttttctcgggcgtgtcttgggtcatgaaaatcggaatcggcgtgctgttgacgtggattgggctcaattccaagaacacatcaatgagttttagctgcatagctatcggaattatcaccctgtatttaggcgccgtagtgcaggcagacatgggttgtgttattaattggaaagggaaggagctgaagtgcggatccggcatcttcgtcactaacgaggtgcatacatggaccgaacagtacaaatttcaagccgattctcccaagcggctagctactgccatagtgggtgcatgggagaatggcgtctgtgggatccgaagcaccacacgcatggaaaacctcctgtggaaacagattgctaatgagcttaactatatcttgtgggaaaataacattaagctgacggttgtggtgggagacaccatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgcctctagggcttggaacgtgtgggaagttgaggactatggttttggggtgttcacgacaaatatttggctgaaacttcgggaagtctacacccagatgtgtgaccaccgcttgatgtcagcagccgtgaaggatgagagagctgttcacgccgacatgggatactggatcgagagtcagaaaaacggcagctggaagctcgaaaaagcatccctgatagaggtgaagacttgcacctggcctaagtctcatacactatggtcgaatggtgtactggaaagcgatatgatcattccaaaatccctcgcgggcccgatctcacagcacaactataggcccgggtaccatactcaaaccgccggaccttggcacctgggcaaacttgagttggactttaattattgcgaggggacaacggtcgtgattaccgaaaactgtggaactcgtggcccaagtctgcggacaaccactgtgtctggtaaattaatccacgagtggtgctgtcgaagctgcacactaccccctctgagatacatgggggaagatggatgttggtatggcatggagataaggccaatttccgaaaaggaggagaatatggtcaaatcacttgttagcgctggttctggcaaggtggacaacttcaccatgggggtactgtgcttggccatcctctttgaagaggtgatgcgcggaaagttcggcaaaaagcatatgatcgcaggggtcttctttacgttcgtgctgctactgtccggacagattacttggcgggatatggctcacaccctcatcatgattggcagtaatgccagcgacagaatgggtatgggggttacatacctggcacttatagccacctttaaaatccagcccttcttggctctgggatttttcttaaggaagctcacttctcgcgaaaacctgcttctgggcgtgggcctagcgatggccacaaccctccaactgccggaggatattgaacagatggcaaatgggatcgctttgggactgatggccttaaaactcattacacagtttgagacttatcagctgtggaccgcccttatctccctgacgtgttcaaacacaatattcaccttgactgtcgcttggcgaaccgcaacactcatcctggccggtgtgagtctactgcctgtttgccaaagctcgtccatgcggaagactgactggcttccaatgaccgtggcggctatgggcgtaccccctctccccctgtttattttctctttgaaggatacgctgaaacgtagaagctggccattaaatgagggggtaatggccgtgggactcgtttcaatgctggcaagttcccttctgaggaacgacgtgcctatggccggccccttggtcgctggtgggctcctgatcgcatgttacgtgattacaggaacctctgccgatctaactgtagaaaaggcggctgacgtgacatgggaggaagaggccgaacagaccggcgtcagccataacctgatgatcactgttgacgatgacggcacaatgcgcataaaagatgacgagaccgagaatattcttacggtgctcctgaagactgcattgttaatcgtgtccgggatctttccatactcaattccggccaccctgctcgtctggcacacatggcagaaacagacccaacggagcggagtgctgtgggatgttcctagtcccccagaaacacagaaggctgagcttgaagagggtgtatatagaataaaacagcagggcatcctggggaagactcaagtgggagtcggcgtgcagaaggacggtgttttccataccatgtggcacgtgacgagaggggccgtcttgacacacaacggaaaacgactagagcccaattgggcatctgtgaagaaagatctgatttcctacggcggcgggtggcgcctcagcgctcagtggcaaaagggagaagaggtacaggtcatcgccgtggaacctggtaaaaacccaaagaattttcagactatgcccggcaccttccagacaaccactggggagattggagcgatcgccctggacttcaagcctggcacctcgggttcaccgataatcaaccgggaagggaaagttgtgggactttatggcaatggcgtcgtgacaaagaacgggggatacgtttctggtattgcacaaacgaatgctgagccagatggccccactcctgagttagaagaggaaatgtttaaaaagagaaacctgaccatcatggacctccatccagggagtggaaaaacaaggaagtatttgcccgccattgtgcgtgaggctatcaagcgccggctgagaaccctcatactggcacctactagggtcgtggccgccgaaatggaggaggctcttaaaggcctgccgattcgataccagacaaccgcgacgaagtccgaacacactggtcgggagatcgtagatttgatgtgccatgcaacattcaccatgcgcctactgagccccgtgagagttccaaattataacctcatcattatggacgaagcccactttaccgatcctgcttctatcgccgcaagggggtacataagcactcgggtcggaatgggcgaggccgctgcgattttcatgacagccacacccccaggcacagcagacgcttttcctcagtccaatgcccccatccaggacgaggaacgagatattccagagagatcatggaacagtgggaatgaatggatcactgacttcgcaggaaaaacggtgtggtttgtgccgagcataaaggccggtaacgatattgctaactgtttacgcaaaaatggcaagaaggtcatccaactgtctaggaaaaccttcgacacagagtaccagaagactaaacttaacgattgggactttgtagtgaccacagatatctccgaaatgggggccaatttcaaggcggaccgtgttattgatcctcggagatgcctgaaacccgtgatcctcaccgacggaccagagagggtcattttggcaggccccatgcctgtgactgccgcttcagccgctcagcgccgaggtagagttgggcggaacccacagaaggagaatgatcaatatatatttacgggccagcccctgaacaatgacgaagaccatgcacactggaccgaggccaagatgctcctggataacatcaatacacctgaaggaattatcccggctcttttcgagccagaaagggagaaaagtgccgcaatcgacggcgagtaccgcctaaagggggaaagccgtaaaactttcgtggagctgatgagacggggagatttgcccgtctggttagcgcacaaggtggcctccgaaggtattaaatataccgacaggaagtggtgctttgatggccagcgcaacaatcagatactggaggaaaacatggacgtagagatctggacaaaagagggggaaaagaagaaactccgacctagatggctggatgctcggacctactctgacccccttgccctgaaggagttcaaagattttgcagctggaaggaagtcgattgccctcgacttggtgactgaaatcggccgcgttccaagccatctggcacacagaacaaggaatgccctagataacctggtcatgctccatacgtcagagcacggtgggcgggcttatcgtcacgcggtggaggaacttcctgagaccatggaaactctgttattgctgggcctcatgattctgcttacaggaggcgccatgctgttcctcatctccgggaaaggaataggtaagaccagtatcggcttgatttgtgtgatcgcatctagcgggatgctgtggatggctgagattcccttacaatggatcgcctccgccatagtcctagaatttttcatgatggttctgctcattccagagcctgagaagcagcgcaccccgcaggacaatcaacttgcatacgtggtaatcggcattctgacaatggctgccatcatagcggctaacgaaatgggcttgctggagactacgaaacgagatctcggtatgtcaaaggaacccggggtggtctctccaaccagctatctggacgtggaccttcatcctgccagtgcatggacactctacgccgttgctactaccgtgatcacacccatgctgagacacaccattgaaaattccactgcaaacgtcagcttggccgcgatcgctaaccaggccgtagtgctgatgggcttagataaaggatggccaatttctaagatggacctaggcgttcctctgctcgcacttgggtgctactcacaggtgaatcccctgacgttgacagccgctgtcctgctcctggtgacccattatgccatcataggaccgggccttcaggcaaaagctactagggaagcccaaaagcggaccgcggccggtattatgaagaacccaacagtcgatgggatcatcactattgacttagatcctgtgatctacgactccaaatttgagaagcagctgggacaggttatgctcttggtgctgtgtgcagtacagctactgctcatgcgcaccagttgggctctttgcgaggccctgacattggcaacgggccccataaccactctgtgggaaggtagcccaggcaaattctggaatacaaccattgctgtgtcgatggccaacatctttagagggtcttatctcgccggagcgggcctggctttctccattatgaaaagcgtcgggactggaaaaaggggcacaggttcacaaggggagaccttaggagaaaagtggaagaagaaacttaatcagctgagtcggaaagagtttgatctctacaagaaatctggcatcacggaagttgaccgaaccgaggcaaaagagggtctaaaaagaggcgaaacaactcaccatgccgtgtcccgcgggagcgctaagctgcagtggttcgtcgagaggaacatggtgatacccgaaggacgggtaatcgatttgggctgtgggcgtggaggctggtcatattactgcgccggtctgaagaaagtgaccgaggttagagggtatacaaagggaggccctggccacgaggaaccggtgcccatgagtacttacgggtggaatattgtcaaactcatgagcggaaaggacgtgttttaccttccacctgagaaatgtgataccctgttgtgcgacatcggtgaatcctctcccagccctacagtcgaggaatccaggaccattcgcgtgctgaagatggttgagccatggctcaagaacaatcagttctgtatcaaagtattaaacccctatatgcctgcagtgattgagcacctggaacggcttcaacgaaagcatggcgggatgctggtcagaaatccactatcaaggaactctactcacgagatgtactggatcagtaatggaacgggcaacatagtgtcgagcgttaatatggtgtcccgcctcctgttgaaccggttcacaatgacccatagacgtcccactattgaaaaagatgtcgacctgggtgccgggaccaggcacgtgaacgctgagccggaaacacctaatatggacgtaatcggagagcggatcaagcgcattaaagaggaacacaactctacgtggcattatgatgacgagaatccatacaagacctgggcgtatcacggctcatacgaagtgaaggccactggcagcgcatccagtatgataaacggggttgtcaaactccttacaaagccctgggatgtggtgcctatggtcacccagatggctatgactgacacaaccccatttggacagcaacgagttttcaaagagaaggtggatacaagaactcccaggccgatgcctggtacccggaaagtaatggaaatcacggccgagtggctgtggcgcaccttaggcagaaataagaggccccgactgtgcacacgggaggaatttactaagaaagtgcgtaccaacgcagccatgggggctgtcttcacagaggaaaatcagtgggactctgccaaggcggcagtggaggatgaagagttttggaaattggttgacagagagcgcgaactccataagctgggaaaatgtggcagctgcgtgtataacatgatgggtaagagggagaaaaagctaggggagttcggaaaggccaaaggctcacgggctatttggtacatgtggcttggcgccagatacctggagtttgaggcactcgggttcctgaatgaagatcactggttttcccgcgagaacagttatagcggagtcgaaggtgagggcttgcataagctggggtacatcctcagggacatttctaaaatcccaggaggcgctatgtatgccgatgacactgctggttgggacacccgaataacggaagatgaccttcacaatgaggagaagatcacacagcggatggatcctgaacacagactgttagccaacgcaattttcaaactgacctaccagaataaggtggtaaaggttcaaaggcccactccaacagggaccgtgatggacatcatttcccgcaaagatcagcgtggatcaggccaggtcggcacttatgggttgaacacctttacaaatatggaggcgcagctcgtgcggcaaatggaaggagagggtgtgctgagcaagacggacctagaaaacccccatcttcctgagaaaaagatcacccagtggctggagactaaaggcgtcgaaagactcaagaggatggccatatcgggggatgactgcgttgtgaagccaattgatgaccgcttcgctaacgccctgttggcattaaatgatatgggaaaagtacgaaaggacatcccgcagtggcagccctctaaaggctggcacgattggcaacaggtgcctttttgtagtcatcacttccacgagctgatcatgaaggacggtcggaaactcgtcgtgccatgcagaccccaggacgaacttattgggagggctcgcatatcccagggagccggctggagcctgagagagacagcatgtctaggcaaggcctacgcgcaaatgtggtcactgatgtatttccatcggagggatctccgtttggcttccaacgccatctgctctgcaattcctgttcactgggtgccaaccagccgaactacatggagtatccatgcccaccatcagtggatgaccacggaagacatgctgacagtctggaatcgcgtgtggattgaggataacccctggatggaggacaagacccctatcactacctgggaaaatgtaccgtaccttgggaaaagagaggatcagtggtgtggatccctgataggtctcacaagccgggctacttgggcccaaaacatcccaaccgcaattcagcaggttaggtctttaatcggcaatgaagagtttctggactacatgccctcaatgaagcgcttcagaaaagaggaagagagtgaaggggctatttggtga

SEQ ID NO: 15092 - RNA, 9873 nt, synthetic construct
  misc_feature 1..9873: note = derived and/or modified CDS sequence (opt3) from DENV-3__KF954945__SS-prME
  source 1..9873: mol_type = other RNA
accagcctgtgcctcatgatgatccttcccgccgctctggcattccacttgacttccagggacggcgagcctaggatgattgtggggaagaacgaacggggaaagtctttactgtttaagactgcctcaggtataaatatgtgtacgctcatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgccgagacaagcgtagcgtcgcccttgcaccccatgtgggcatgggtctggatacaagaacccagacgtggatgtccgccgagggggcttggaggcaggtcgaaaaggtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccatccttaggaaactgtgtattgagggaaagatcacaaacataaccacggatagccggtgccctacccagggcgaagctgtcttgccagaggaacaggaccagaattatgtttgtaaacacacatacgtggatcgcggttgggggaacggatgcggcctcttcggcaaggggagtctggtaacttgcgccaagtttcaatgtttagagcccattgagggaaaagtggtccagtatgaaaatctgaagtacaccgtgatcattacagttcatactggtgaccagcaccaggtgggcaacgagacccaagggatcacagcagaaatcacccctcaggcttccactacggaggccattctcccagaatatggaacacttggcctggagtgctctccgcgaaccggtttggacttcaatgagatgatactactgactatgaaaaacaaggcgtggatggtccatagacagtggtttttcgatctccccctgccttggaccagcggggccacaaccgaaactccaacatggaataggaaagagcttctggtgacgtttaagaacgcacacgctaaaaagcaagaagtagttgtgttgggctcccaggagggagccatgcacaccgctctcactggcgccacagaaatccaaaattcagggggaaccagtattttcgcaggtcatctgaagtgtcggttaaaaatggacaagctggagctaaaaggcatgagctacgccatgtgcacaaacacttttgtcctcaagaaagaggtgtctgaaacccagcacgggacgatcctgataaaggtcgagtacaagggagaagatgctccctgtaaaattcctttctccaccgaggacggccaaggtaaggcgcataacgggcgtcttatcacagcaaatccagtggttactaaaaaggaggaacccgtgaacatcgaggccgaaccgcctttcggcgagtcaaatattgtaatcggaattggcgataacgctttgaaaataaattggtataagaaggggagcagtatcggaaaaatgtttgaagccaccgcacgcggtgccagaaggatggctattctgggcgacacagcctgggatttcgggtctgtcggaggcgtgctcaactccctgggtaagatggttcaccagatctttgggagcgcatacactgcgcttttctcgggcgtgtcttgggtcatgaaaatcggaattggcgtgctgttgacctggatagggctcaattccaagaacacgtcaatgagttttagctgcatcgctattggaatcattacactgtatttaggcgccgtagtgcaggcagacatgggttgtgttatcaattggaaagggaaggagctgaagtgcggatccggcatattcgtcaccaacgaggtgcatacttggacagaacagtacaaatttcaagccgattctcccaagcggctagctaccgccatcgtgggtgcatgggagaatggcgtctgtgggattcgaagcactacccgcatggaaaacctcctgtggaaacagatcgctaatgagcttaactatattttgtgggaaaataacatcaagctgacagttgtggtgggagacacgataggcgtactcgagcaggggaaaagaaccctgactccacagcctatggagttaaagtactcatggaaaacatggggaaaggccaagattgtcaccgcggaaacacaaaacagttccttcatcattgatggccccaatactccagagtgccccagcgcctctagggcttggaacgtgtgggaagttgaggactatggttttggggtgttcaccacgaatatctggctgaaacttcgggaagtctacacacagatgtgtgaccaccgcttgatgtcagcagccgtgaaggatgagagagctgttcacgccgacatgggatactggatagagagtcagaaaaacggcagctggaagctcgaaaaagcatccctgatcgaggtgaagacctgcacttggcctaagtctcataccctatggtcgaatggtgtactggaaagcgatatgattatcccaaaatccctcgcgggcccgatttcacagcacaactataggcccgggtaccatacacaaactgccggaccttggcacctgggcaaacttgagttggactttaattattgcgaggggaccacagtcgtgatcacggaaaactgtggaacccgtggcccaagtctgcggactacaaccgtgtctggtaaattaatacacgagtggtgctgtcgaagctgcactctaccccctctgagatacatgggggaagatggatgttggtatggcatggagattaggccaatctccgaaaaggaggagaatatggtcaaatcacttgttagcgctggttctggcaaggtggacaacttcacaatgggggtactgtgcttggccatcctctttgaagaggtgatgcgcggaaagttcggcaaaaagcatatgattgcaggggtcttctttaccttcgtgctgctactgtccggacagatcacgtggcgggatatggctcacactctcattatgataggcagtaatgccagcgacagaatgggtatgggggttacctacctggcacttatcgccacatttaaaattcagcccttcttggctctgggatttttcttaaggaagctcacctctcgcgaaaacctgcttctgggcgtgggcctagcgatggccactacactccaactgccggaggatatcgaacagatggcaaatgggattgctttgggactgatggccttaaaactcatcacccagtttgagacatatcagctgtggactgcccttatatccctgacctgttcaaacacgatcttcacattgaccgtcgcttggcgaactgcaaccctcattctggccggtgtgagtctactgcctgtttgccaaagctcgtccatgcggaagacagactggcttccaatgactgtggcggctatgggcgtaccccctctccccctgtttatcttctctttgaaggataccctgaaacgtagaagctggccattaaatgagggggtaatggccgtgggactcgtttcaatgctggcaagttcccttctgaggaacgacgtgcctatggccggccccttggtcgctggtgggctcctgattgcatgttacgtgatcacgggaacatctgccgatctaaccgtagaaaaggcggctgacgtgacttgggaggaagaggccgaacagacaggcgtcagccataacctgatgataaccgttgacgatgacggcactatgcgcattaaagatgacgagacagagaatatccttaccgtgctcctgaagacggcattgttaatcgtgtccgggatttttccatactcaataccggccactctgctcgtctggcacacctggcagaaacagacacaacggagcggagtgctgtgggatgttcctagtcccccagaaacccagaaggctgagcttgaagagggtgtatatagaatcaaacagcagggcattctggggaagacacaagtgggagtcggcgtgcagaaggacggtgttttccatactatgtggcacgtgaccagaggggccgtcttgacgcacaacggaaaacgactagagcccaattgggcatctgtgaagaaagatctgatctcctacggcggcgggtggcgcctcagcgctcagtggcaaaagggagaagaggtacaggtcattgccgtggaacctggtaaaaacccaaagaattttcagacaatgcccggcactttccagaccacaaccggggagatcggagcgatagccctggacttcaagcctggcacttcgggttcaccgatcattaaccgggaagggaaagttgtgggactttatggcaatggcgtcgtgaccaagaacgggggatacgtttctggtatcgcacaaacaaatgctgagccagatggccccacgcctgagttagaagaggaaatgtttaaaaagagaaacctgactattatggacctccatccagggagtggaaaaaccaggaagtatttgcccgccatcgtgcgtgaggctataaagcgccggctgagaacactcattctggcacctaccagggtcgtggccgccgaaatggaggaggctcttaaaggcctgccgatccgataccagactacagcgaccaagtccgaacacacgggtcgggagatcgtagatttgatgtgccatgcaactttcacaatgcgcctactgagccccgtgagagttccaaattataacctcattatcatggacgaagcccactttaccgatcctgcttctatagccgcaagggggtacattagcacccgggtcggaatgggcgaggccgctgcgatcttcatgactgccacacccccaggcaccgcagacgcttttcctcagtccaatgcccccattcaggacgaggaacgagatatcccagagagatcatggaacagtgggaatgaatggataacagacttcgcaggaaaaactgtgtggtttgtgccgagcattaaggccggtaacgatatcgctaactgtttacgcaaaaatggcaagaaggtcatccaactgtctaggaaaacgttcgacaccgagtaccagaagacaaaacttaacgattgggactttgtagtgactaccgatatttccgaaatgggggccaatttcaaggcggaccgtgttatcgatcctcggagatgcctgaaacccgtgattctcacagacggaccagagagggtcatattggcaggccccatgcctgtgaccgccgcttcagccgctcagcgccgaggtagagttgggcggaacccacagaaggagaatgatcaatatatctttactggccagcccctgaacaatgacgaagaccatgcacactggacggaggccaagatgctcctggataacattaatacccctgaaggaatcatcccggctcttttcgagccagaaagggagaaaagtgccgcaattgacggcgagtaccgcctaaagggggaaagccgtaaaacattcgtggagctgatgagacggggagatttgcccgtctggttagcgcacaaggtggcctccgaaggtataaaatatactgacaggaagtggtgctttgatggccagcgcaacaatcagatcctggaggaaaacatggacgtagagatttggaccaaagagggggaaaagaagaaactccgacctagatggctggatgctcggacatactctgacccccttgccctgaaggagttcaaagattttgcagctggaaggaagtcgatcgccctcgacttggtgaccgaaattggccgcgttccaagccatctggcacacagaactaggaatgccctagataacctggtcatgctccatacatcagagcacggtgggcgggcttatcgtcacgcggtggaggaacttcctgagacgatggaaaccctgttattgctgggcctcatgatcctgcttactggaggcgccatgctgttcctcatatccgggaaaggaatcggtaagacaagtattggcttgatctgtgtgattgcatctagcgggatgctgtggatggctgagatccccttacaatggatagcctccgccattgtcctagaatttttcatgatggttctgctcatcccagagcctgagaagcagcgcaccccgcaggacaatcaacttgcatacgtggtaattggaatcctgaccatggctgccataatcgcggctaacgaaatgggcttgctggagacaactaaacgagatctcggtatgtcaaaggaacccggggtggtctctccaacgagctatctggacgtggaccttcatcctgccagtgcatggaccctctacgccgttgctacaactgtgattacccccatgctgagacacacaatcgaaaattccaccgcaaacgtcagcttggccgcgattgctaaccaggccgtagtgctgatgggcttagataaaggatggccaatctctaagatggacctaggcgttcctctgctcgcacttgggtgctactcacaggtgaatcccctgactttgacggccgctgtcctgctcctggtgacacattatgccataattggaccgggccttcaggcaaaagctaccagggaagcccaaaagcggactgcggccggtatcatgaagaacccaaccgtcgatgggatcattacaatcgacttagatcctgtgatatacgactccaaatttgagaagcagctgggacaggttatgctcttggtgctgtgtgcagtacagctactgctcatgcgcacaagttgggctctttgcgaggccctgaccttggcaacaggccccattacgaccctgtgggaaggtagcccaggcaaattctggaatactacaatcgctgtgtcgatggccaacatttttagagggtcttatctcgccggagcgggcctggctttctccatcatgaaaagcgtcgggaccggaaaaaggggcactggttcacaaggggagacattaggagaaaagtggaagaagaaacttaatcagctgagtcggaaagagtttgatctctacaagaaatctggcataaccgaagttgaccgaacggaggcaaaagagggtctaaaaagaggcgaaaccacacaccatgccgtgtcccgcgggagcgctaagctgcagtggttcgtcgagaggaacatggtgatccccgaaggacgggtaattgatttgggctgtgggcgtggaggctggtcatattactgcgccggtctgaagaaagtgactgaggttagagggtataccaagggaggccctggccacgaggaaccggtgcccatgagtacatacgggtggaatatcgtcaaactcatgagcggaaaggacgtgttttaccttccacctgagaaatgtgatactctgttgtgcgacattggtgaatcctctcccagccctaccgtcgaggaatccaggacaatccgcgtgctgaagatggttgagccatggctcaagaacaatcagttctgtattaaagtattaaacccctatatgcctgcagtgatcgagcacctggaacggcttcaacgaaagcatggcgggatgctggtcagaaatccactatcaaggaactctacccacgagatgtactggataagtaatggaactggcaacattgtgtcgagcgttaatatggtgtcccgcctcctgttgaaccggttcacgatgacacatagacgtcccaccatcgaaaaagatgtcgacctgggtgccgggactaggcacgtgaacgctgagccggaaacccctaatatggacgtaatcggagagcggattaagcgcataaaagaggaacacaactctacatggcattatgatgacgagaatccatacaagacgtgggcgtatcacggctcatacgaagtgaaggccaccggcagcgcatccagtatgatcaacggggttgtcaaactccttactaagccctgggatgtggtgcctatggtcacacagatggctatgaccgacactacaccatttggacagcaacgagttttcaaagagaaggtggataccagaacacccaggccgatgcctggtactcggaaagtaatggaaattaccgccgagtggctgtggcgcacgttaggcagaaataagaggccccgactgtgcacccgggaggaatttacaaagaaagtgcgtactaacgcagccatgggggctgtcttcaccgaggaaaatcagtgggactctgccaaggcggcagtggaggatgaagagttttggaaattggttgacagagagcgcgaactccataagctgggaaaatgtggcagctgcgtgtataacatgatgggtaagagggagaaaaagctaggggagttcggaaaggccaaaggctcacgggctatctggtacatgtggcttggcgccagatacctggagtttgaggcactcgggttcctgaatgaagatcactggttttcccgcgagaacagttatagcggagtcgaaggtgagggcttgcataagctggggtacattctcagggacatctctaaaataccaggaggcgctatgtatgccgatgacacagctggttgggacactcgaatcaccgaagatgaccttcacaatgaggagaagattacgcagcagatggatcctgaacaccggctgttagccaacgcaatcttcaaactgacataccaaaataaggtggtaaaggttcagagacccaccccaactgggacagtgatggacattatctccaggaaagatcagcgcggatcaggccaggtcggcacctatgggttgaacacttttaccaatatggaggcgcaactcgtgcgtcagatggaaggagagggtgtgctgagcaagacagacctagaaaacccccatcttcctgagaaaaagataacgcagtggctggagaccaaaggcgtcgaacggctcaagagaatggccatttcgggggatgactgcgttgtgaagccaatcgatgacaggttcgctaacgccctgttggcattaaatgatatgggaaaagtacgcaaggacatcccgcagtggcaaccctctaaaggctggcacgattggcaacaggtgcctttttgtagtcatcacttccacgagctgattatgaaggacggtcgaaaactcgtcgtgccatgccggccccaggacgaacttatagggagagctaggatctcccaaggagccggctggagcctgcgcgagactgcatgtctaggcaaggcctacgcgcagatgtggtcactgatgtatttccatagacgggatctcaggttggcttccaacgccatttgctctgcaatccctgttcactgggtgccaacaagccgtaccacttggagtattcatgcccaccatcagtggatgacaaccgaagacatgctgacggtctggaatcgagtgtggatcgaggataacccctggatggaggacaagacacctataaccacttgggaaaatgtaccgtaccttgggaaacgcgaggatcaatggtgtggatccctgatcggtctcaccagcagagctacatgggcccagaacattccaactgcaatccagcaggttcggtctttaattggcaatgaagagtttctggactacatgccctcaatgaagaggttccgcaaagaggaagagagtgaaggggctatctggtga

SEQ ID NO: 15093 - RNA, 9873 nt, synthetic construct
  misc_feature 1..9873: note = derived and/or modified CDS sequence (opt3) from DENV-3__JX669495__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagcccatagagggaaaagtggtccagtatgaaaatctgaagtacacagtgattatcactgttcacaccggtgaccagcatcaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaaaaacaaggcgtggatggtgcacaggcagtggtttttcgatctccccctgccttggacaagcggggccaccactgaaacaccaacgtggaatcggaaagagcttctggtaacctttaagaacgcacatgctaaaaagcaagaagttgtggtcttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtgctcaagaaagaggtctctgaaacgcagcatgggaccatcctgattaaggtggagtacaagggagaagatgctccctgtaaaatccctttctccacagaggacggccaaggtaaggcgcacaacgggcgccttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcaagaggtgccaggcggatggctatactgggcgacactgcctgggatttcgggtctgtgggaggcgttctcaactccctgggtaagatggtgcatcagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcacacatggaccgaacagtacaaatttcaagccgattctcccaagcgactagctactgccatcgcaggtgcttgggagaatggcgtctgtgggatacgcagcaccacaagaatggaaaacctcctgtggaaacagatcgccaatgagcttaactatattttgtgggaaaataacatcaagctgacggttgtggtgggagacattatcggcgtactcgagcaggggaaaaggaccctgactccacagcctatggagttaaagtactcatggaaaacatggggaaaggcgaagatagtcaccgccgaaacacaaaacagttccttcattatcgatggccccaatactccagagtgccccagcgcttctcgggcatggaacgtgtgggaagttgaggactatggttttggggtgttcaccacgaatatttggctgaaacttcgcgaagtctacacacagttgtgtgaccatagactcatgtcagccgctgtgaaggatgagagggccgttcacgcagacatgggatactggatcgagagtcagaaaaacggcagctggaagctggaaaaagcgtccctaatagaggtgaagacctgcacttggcctaagtctcacaccctgtggtcgaatggtgtactcgaaagcgatatgatcattccaaaatccctggccggcccgatctcacagcataaccaccgtcccgggtatcatacacaaactgctggaccttggcaccttggcaagttggagctggactttaattactgcgaggggaccacagtcgtgattacggaaaactgtggaacccggggcccaagtttacgaactacaaccgtgtctggtaaactcatccacgagtggtgctgtagaagctgcactctgccccctcttaggtatatgggggaagatggatgttggtacggcatggagatacgcccaatttccgaaaaggaggagaatatggtcaaatcactggttagcgccggttctggcaaggtggacaacttcacaatgggggtattgtgcctcgcaatcctgtttgaagaggtgatgcggggaaagttcggcaaaaagcatatgatcgctggggtcttctttaccttcgtgctactgctctccggacagattacgtggagagatatggcccacactctgatcatgattggcagtaatgcaagcgacaggatgggtatgggggttacctatcttgccttgatagctacatttaaaatccagcccttcctggcgttaggatttttcctccgcaagctgacctctcgagaaaaccttctgctaggcgtgggcctcgccatggcaactacactgcaattgccggaggatattgaacagatggctaatgggatcgccctgggattaatggccctcaaactgattacccagtttgagacataccagctttggactgctctgatctccttgacctgttcaaacacgatgttcacactcaccgtcgcatggcggactgccaccctgatactagcgggtgtgagtctgcttcctgtttgccaaagctcgtccatgcgtaagacagactggctcccaatggctgtggccgcaatgggcgtcccccctctgcccttgtttatcttctctctgaaggatactttaaaaagaaggagctggccactcaatgagggggtaatggccgtgggactggtttcaattcttgctagttccctgttgcgcaacgacgtgcctatggcaggccccctcgtcgccggtgggctgctaatcgcgtgttatgtgattaccggaacgtctgctgatctgacagtagaaaaggccgcagacatcacctgggaggaagaggccgaacagactggcgtgagccataaccttatgataacagtcgacgatgacggcaccatgcggattaaagatgacgagactgagaatatcctcacagttctgttgaagaccgctttactgatcgtgtccggggtgtttccatactcaattccggccacgctcctggtctggcacacttggcagaaacagacccaaagaagcggagtgctttgggatgttcctagtcccccagaaacacagaaggcagagctggaagagggtgtatacaggataaaacagcagggcatcttcgggaagacccaagtgggagtcggcgtgcagaaggagggtgtttttcatacaatgtggcacgtgactcgaggggctgtcttgacctataacggaaaacgcctagaacccaattgggcctctgtgaagaaagacctgatttcctacggcggcgggtggcggctcagcgcgcagtggcaaaagggagaggaagtacaggtcatcgccgtggagcctggtaaaaacccaaagaatttccagacgatgcccggcacattccagactaccacaggggaaattggagcaatcgctctggattttaagcctggcacctcgggttcaccgataatcaacagagaggggaaagttgtgggactttatggcaatggcgtcgtgactaagaacgggggatacgtttctggtattgcccaaaccaatgctgagccagacggccccacacctgaattagaggaagagatgttcaaaaagaggaacctgacgatcatggatctccacccagggagtggaaaaactcgtaagtatttgcccgcaattgtgcgcgaagccatcaagcggagactgaggaccctcatactggcccctacacgagtcgtggctgcggagatggaggaagcacttaaaggcctgccgattcggtaccagaccactgccacaaagtccgagcataccggtcgcgaaatcgtagacttgatgtgccacgctacgtttactatgagactactgagccccgtgagggttccaaattataacctcatcattatggatgaggcccatttcacagaccctgcatctatcgccgctcgggggtacataagcacccgagtcggaatgggcgaagcggccgcaatttttatgaccgctactcccccaggcacagccgatgcattccctcagtccaatgcccccatccaggacgaggagagagacattccagaacgctcatggaacagtgggaatgagtggatcaccgattttgctggaaaaacagtgtggttcgtgccgagcataaaggccggtaacgacattgcgaactgtttaaggaaaaatggcaagaaggtcatccaactgtctcgtaaaacttttgatacggaataccagaagaccaaacttaacgactgggatttcgtagtgacaactgacatctccgagatgggggcaaattttaaggccgatcgggttattgaccctagaaggtgcctgaaacccgtgatcctcaccgatggaccagagcgcgtcattttggctggccccatgcctgtgacagccgcttcagcagcccagcgaagaggtcgggttgggaggaacccacagaaggaaaatgaccaatatatattcaccggccagcccctgaacaatgatgaggaccacgctcattggactgaagccaagatgctcctggacaacatcaatacgcctgagggaattatcccggcacttttcgaaccagagcgcgagaaaagtgcggccatcgatggcgaataccgtctaaagggggagagcagaaaaacctttgtggaactgatgcggaggggagacttgcccgtctggttagctcacaaggtggcctccgagggtattaaatatacagatcgcaagtggtgcttcgacggccagcgaaacaatcagatactggaagagaacatggatgtagagatctggactaaagaaggggagaagaagaaactcagacctcggtggctggacgcaaggacctactctgatccccttgctctgaaggaatttaaagacttcgccgcaggacgcaagtcgattgccctcgatttggtgacagagatcggcagagttccaagccacctggctcataggacccggaatgcgctagacaacctggtcatgctccacacttcagaacatggtgggcgtgcctatcgccacgcagtggaggagcttcctgaaacaatggagacgctgttattgctgggcctcatgattctgcttaccggaggcgctatgctgtttctcatctccgggaaaggaataggtaagactagtatcggcttgatttgtgtgatcgcctctagcgggatgctgtggatggccgaaattcccttacaatggatcgcatccgctatagtcctagagttctttatgatggttctgctcattccagagcctgaaaagcagcgaacaccgcaggataatcaacttgcctacgtggtaatcggaattctgaccttggcggctatcatagccgcaaacgagatgggcctgctcgaaaccacaaaaagagacctgggtatgtcaaaggagcccggggtggtctctccaactagctatcttgatgtggacctccaccctgccagtgcttggacgctgtacgcagttgccaccacagtgatcactcccatgttgaggcataccattgaaaattccacagcgaacgtcagcctggctgccatcgcaaaccaggccgtagtgttaatgggcctagacaaaggatggccaatttctaagatggatctgggcgttcctctccttgctctggggtgctactcacaggtgaatcccttgaccctgactgccgcagtcctcctgcttatcacgcactatgctataattggaccgggcttacaggccaaagcgacacgggaggcccaaaagcgcaccgcagctggtatcatgaagaacccaactgtggacgggatcatgaccattgatctggaccctgtcatctacgattccaaattcgagaagcagctcggacaggtgatgttgctggttctatgtgccgtgcagctgctccttatgagaacaagttgggcactgtgcgaagctttgactctggccaccggccccataacaacgctctgggagggtagcccaggcaaattttggaataccactattgccgtatcgatggcgaacatcttcagggggtcttatctggctggagcaggcttagccttttccattatgaagagcgtggggacaggaaaacggggcaccggttcacaaggggaaactcttggagagaagtggaagaaaaagctgaatcagctcagtcgaaaagaattcgacctatacaagaaatctggcatcacagaggtcgatagaaccgaggctaaggaaggtctgaaacgcggcgagataacgcatcacgccgtttccagggggagcgcaaagttgcagtggtttgtggaacggaacatggtcatccccgagggacgtgtgattgacctgggctgtgggagaggaggctggtcatattactgcgccggtctcaagaaagtaaccgaagtgagggggtatacaaagggaggccctggccatgaggagccggttcccatgagtacttacgggtggaatatcgtgaaacttatgagcggaaaggatgtcttctacctgccacctgaaaaatgtgacaccttgctgtgcgatattggtgagtcctctcccagccctacagtggaagagtcccgcactatccgggtcctcaagatggtggagccatggttaaagaacaatcagttctgtattaaagttctgaacccctatatgcctaccgtaatcgaacaccttgagcgactgcaaagaaagcacggcgggatgctagtgaggaatccactctcacgcaactctacacatgaaatgtactggataagtaatggaaccggcaacattgtcgcttcggtgaatatggttagccggctgttgctgaacagatttactatgacgcaccgtaggcccacaatcgagaaagacgtggatctcggtgcggggacccggcatgtcaacgccgaaccggagactcctaatatggacgtgatcggagagcgcattaagcgaataaaagaagagcacaactccacctggcactatgacgatgaaaatccatacaagacatgggcatatcatggctcttacgaggtaaaggctacgggctcagccagctccatgatcaacggggtggttaaacttctgaccaagccctgggacgtcgtgcctatggtgactcagatggcaatgacagataccactccattcggacagcaaagagtctttaaagaaaaggttgacacaaggaccccccggagtatgccgggtacacgcagagtgatgggcattactgccgagtggttatggaggaccctggggcgaaataaaaagcctcggttgtgcacgcgtgaggaattcaccaagaaagtaagaacaaacgctgccatgggagcggtgtttactgaggaaaatcagtgggattctgcaaaggccgctgtcgaggacgaagatttctggaaactcgtggaccgcgagagggagctgcacaagctaggcaaatgtggtagctgcgtttataacatgatggggaagcgggaaaaaaagcttggagagtttggcaaggccaaaggctcaagagcaatctggtacatgtggctgggggctcgctacctcgaattcgaggccctgggatttttgaatgaggatcattggttctccagggaaaacagttatagcggtgtggagggcgaagggctgcacaagctcggatacattcttcgagacatctctaaaatacccggcggtgctatgtatgccgatgacaccgcagggtgggacacacggatcactgaggatgacctgcataatgaagagaagattacccagcagatggatccagagcacagacaattagcgaacgccatctttaaactgacgtaccagaataaggtcgtgaaggtacagaggcctacacccaccggaactgttatggacattatctcccgcaaagatcagcgtggctcaggccaagtggggacatatggattgaacaccttcactaatatggaagctcagctcatacggcagatggagggtgaaggcgtcctgagcaaggccgacctagagaacccacaccttcccgaaaaaaaggtgacccagtggctggagacaaaaggggtggagagactcaagaggatggcaatttcgggagatgactgcgtcgttaagcctatcgatgaccgctttgctaacgccctgttggcattaaatgatatgggcaaagtgcgaaaggacatcccacaatggcagccgtctaaaggttggcatgattggcagcaggtacccttctgtagtcaccatttccacgaactgattatgaaggacgggcggaaactcgtggtcccttgcagaccacaagacgagcttataggaagggcccgcatctcccagggcgcgggctggagcctgagagaaacggcttgtctagggaaggcctacgcacagatgtggtcactgatgtattttcaccggagggatctccgtttggcctccaacgctatttgctctgccgtgcccgttcattgggtgcctaccagccgaactacatggagtatccacgcacatcaccaatggatgaccactgaggacatgctgacagtctggaatcgcgtgtggattgaagataacccatggatggaggacaagacccccgtaacgacatgggagaatgttccttaccttggaaaaagagaagatcagtggtgtggttccctgatcggcctcaccagccgggctacttgggcccagaacataccgaccgcgatccagcaagtgaggtctttaattgggaatgaggaattcctggactacatgccatcaatgaagcgctttagaaaagaggaggaaagtgagggagctatctggtga

SEQ ID NO: 15094 - RNA, 9873 nt, synthetic construct
  misc_feature 1..9873: note = derived and/or modified CDS sequence (opt3) from DENV-3__JX669499__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagcccatagagggaaaagtggtccagtatgaaaatctgaagtacacagtgattatcactgttcacaccggtgaccagcatcaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaaaaacaaggcgtggatggtgcacaggcagtggtttttcgatctccccctgccttggacaagcggggccaccactgaaacaccaacgtggaatcggaaagagcttctggtaacctttaagaacgcacatgctaaaaagcaagaagttgtggtcttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtgctcaagaaagaggtctctgaaacgcagcatgggaccatcctgattaaggtggagtacaagggagaagatgctccctgtaaaatccctttctccacagaggacggccaaggtaaggcgcacaacgggcgccttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcaagaggtgccaggcggatggctatactgggcgacactgcctgggatttcgggtctgtgggaggcgttctcaactccctgggtaagatggtgcatcagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcacacatggaccgaacagtacaaatttcaagccgattctcccaagcgactagctactgccatcgcaggtgcttgggagaatggcgtctgtgggatacgcagcaccacaagaatggaaaacctcctgtggaaacagatcgccaatgagcttaactatattttgtgggaaaataacatcaagctgacggttgtggtgggagacattatcggcgtactcgagcaggggaaaaggaccctgactccacagcctatggagttaaagtactcatggaaaacatggggaaaggcgaagatagtcaccgccgaaacacaaaacagttccttcattatcgatggccccaatactccagagtgccccagcgcttctcgggcatggaacgtgtgggaagttgaggactatggttttggggtgttcaccacgaatatttggctgaaacttcgcgaagtctacacacagttgtgtgaccatagactcatgtcagccgctgtgaaggatgagagggccgttcacgcagacatgggatactggatcgagagtcagaaaaacggcagctggaagctggaaaaagcgtccctaatagaggtgaagacctgcacttggcctaagtctcacaccctgtggtcgaatggtgtactcgaaagcgatatgatcattccaaaatccctggccggcccgatctcacagcataaccaccgtcccgggtatcatacacaaactgctggaccttggcaccttggcaagttggagctggactttaattactgcgaggggaccacagtcgtgattacggaaaactgtggaacccggggcccaagtttacgaactacaaccgtgtctggtaaactcatccacgagtggtgctgtagaagctgcactctgccccctcttaggtatatgggggaagatggatgttggtacggcatggagatacgcccaatttccgaaaaggaggagaatatggtcaaatcactggttagcgccggttctggcaaggtggacaacttcacaatgggggtattgtgcctcgcaatcctgtttgaagaggtgatgcggggaaagttcggcaaaaagcatatgatcgctggggtcttctttaccttcgtgctactgctctccggacagattacgtggagagatatggcccacactctgatcatgattggcagtaatgcaagcgacaggatgggtatggggataacctatcttgccttgatcgctacatttaaaattcagcccttcctggcgttaggatttttcctccgcaagctgacctctcgagaaaaccttctgctaggcgttggcctcgccatggcaactacactgcaattgccggaggatatcgaacagatggctaatgggattgccctgggattaatggccctcaaactgatcacccagtttgagacataccagctttggactgctctgatatccttgacctgttcaaacacgatgttcacactcaccgtggcatggcggactgccaccctgatcctagcgggtgtcagtctgcttcctgtgtgccaaagctcgtccatgcgtaagacagactggctcccaatggctgttgccgcaatgggcgtgccccctctgcccttgtttattttctctctgaaggatactttaaaaagaaggagctggccactcaatgagggggtcatggccgtaggactggtgtcaatccttgctagttccctgttgcgcaacgacgttcctatggcaggccccctcgtggccggtgggctgctaattgcgtgttatgtcatcaccggaacgtctgctgatctgacagtggaaaaggccgcagacataacctgggaggaagaggccgaacagactggcgtaagccataaccttatgattacagtggacgatgacggcaccatgcggatcaaagatgacgagactgagaatatcctcacagtcctgttgaagaccgctttactgattgtttccggggtgtttccatactcaataccggccacgctcctggtgtggcacacttggcagaaacagacccaaagaagcggagtcctttgggatgtgcctagtcccccagaaacacagaaggcagagctggaagagggtgtttacaggatcaaacagcagggcattttcgggaagacccaagtaggagtgggcgtccagaaggagggtgtgtttcatacaatgtggcacgttactcgaggggctgtgttgacctataacggaaaacgcctagaacccaattgggcctctgtcaagaaagacctgatctcctacggcggcgggtggcggctcagcgcgcagtggcaaaagggagaggaagtgcaggtaattgccgtcgagcctggtaaaaacccaaagaatttccagacgatgcccggcacattccagactaccacaggggaaatcggagcaatagctctggattttaagcctggcacctcgggttcaccgatcattaacagagaggggaaagtggttggactttatggcaatggcgtggtcactaagaacgggggatacgtgtctggtatcgcccaaaccaatgctgagccagacggccccacacctgaattagaggaagagatgttcaaaaagaggaacctgacgattatggatctccacccagggagtggaaaaactcgtaagtatttgcccgcaatcgttcgcgaagccataaagcggagactgaggaccctcattctggcccctacacgagtggtcgctgcggagatggaggaagcacttaaaggcctgccgatccggtaccagaccactgccacaaagtccgagcataccggtcgcgaaatcgtggacttgatgtgccacgctacgtttactatgagactactgagccccgtaagggtgccaaattataacctcattatcatggatgaggcccatttcacagaccctgcatctatagccgctcgggggtacattagcacccgagttggaatgggcgaagcggccgcaatctttatgaccgctactcccccaggcacagccgatgcattccctcagtccaatgcccccattcaggacgaggagagagacatcccagaacgctcatggaacagtgggaatgagtggataaccgattttgctggaaaaacagtctggttcgtgccgagcattaaggccggtaacgacatcgcgaactgtttaaggaaaaatggcaagaaggtgatccaactgtctcgtaaaacttttgatacggaataccagaagaccaaacttaacgactgggatttcgtcgtaacaactgacatttccgagatgggggcaaattttaaggccgatcgggtgatcgaccctagaaggtgcctgaaacccgttattctcaccgatggaccagagcgcgtgatattggctggccccatgcctgtcacagccgcttcagcagcccagcgaagaggtcgggtggggaggaacccacagaaggaaaatgaccaatatatcttcaccggccagcccctgaacaatgatgaggaccacgctcattggactgaagccaagatgctcctggacaacattaatacgcctgagggaatcatcccggcacttttcgaaccagagcgcgagaaaagtgcggccattgatggcgaataccgtctaaagggggagagcagaaaaacctttgttgaactgatgcggaggggagacttgcccgtgtggttagctcacaaggtcgcctccgagggtataaaatatacagatcgcaagtggtgcttcgacggccagcgaaacaatcagatcctggaagagaacatggatgtggagatttggactaaagaaggggagaagaagaaactcagacctcggtggctggacgcaaggacctactctgatccccttgctctgaaggaatttaaagacttcgccgcaggacgcaagtcgatcgccctcgatttggtaacagagattggcagagtgccaagccacctggctcataggacccggaatgcgctagacaacctggttatgctccacacttcagaacatggtgggcgtgcctatcgccacgcagtcgaggagcttcctgaaacaatggagacgctgttattgctgggcctcatgatcctgcttaccggaggcgctatgctgtttctcatatccgggaaaggaatcggtaagactagtattggcttgatctgtgtgattgcctctagcgggatgctgtggatggccgaaatccccttacaatggatagcatccgctattgtgctagagttctttatgatggtcctgctcatcccagagcctgaaaagcagcgaacaccgcaggataatcaacttgcctacgttgtgattggaatcctgaccttggcggctataatcgccgcaaacgagatgggcctgctcgaaaccacaaaaagagacctgggtatgtcaaaggagcccggggtagtgtctccaactagctatcttgatgtcgacctccaccctgccagtgcttggacgctgtacgcagtggccaccacagttattactcccatgttgaggcataccatcgaaaattccacagcgaacgtgagcctggctgccattgcaaaccaggccgtcgtattaatgggcctagacaaaggatggccaatctctaagatggatctgggcgtgcctctccttgctctggggtgctactcacaggttaatcccttgaccctgactgccgcagtgctcctgcttataacgcactatgctattatcggaccgggcttacaggccaaagcgacacgggaggcccaaaagcgcaccgcagctggtatcatgaagaacccaactgtcgacgggattatgaccatcgatctggaccctgtgatatacgattccaaattcgagaagcagctcggacaggtcatgttgctggtgctatgtgccgttcagctgctccttatgagaacaagttgggcactgtgcgaagctttgactctggccaccggccccattacaacgctctgggagggtagcccaggcaaattttggaataccactatcgccgtgtcgatggcgaacattttcagggggtcttatctggctggagcaggcttagccttttccatcatgaagagcgtagggacaggaaaacggggcaccggttcacaaggggaaactcttggagagaagtggaagaaaaagctgaatcagctcagtcgaaaagaattcgacctatacaagaaatctggcataacagaggtggatagaaccgaggctaaggaaggtctgaaacgcggcgagatcacgcatcacgccgtctccagggggagcgcaaagttgcagtggtttgttgaacggaacatggtgattcccgagggacgtgtcatcgacctgggctgtgggagaggaggctggtcatattactgcgccggtctcaagaaagtgaccgaagtaagggggtatacaaagggaggccctggccatgaggagccggtgcccatgagtacttacgggtggaatattgttaaacttatgagcggaaaggatgtgttctacctgccacctgaaaaatgtgacaccttgctgtgcgatatcggtgagtcctctcccagccctacagtcgaagagtcccgcactattcgggtgctcaagatggtcgagccatggttaaagaacaatcagttctgtatcaaagtgctgaacccctatatgcctaccgttatagaacaccttgagcgactgcaaagaaagcacggcgggatgctagtaaggaatccactctcacgcaactctacacatgaaatgtactggattagtaatggaaccggcaacatcgtggcttcggtcaatatggtgagccggctgttgctgaacagatttactatgacgcaccgtaggcccacaatcgagaaagacgttgatctcggtgcggggacccggcatgtgaacgccgaaccggagactcctaatatggacgtcattggagagcgcataaagcgaatcaaagaagagcacaactccacctggcactatgacgatgaaaatccatacaagacatgggcatatcatggctcttacgaggtgaaggctacgggctcagccagctccatgattaacggggtagtgaaacttctgaccaagccctgggacgttgtccctatggtgactcagatggcaatgacagataccactccattcggacagcaaagagtgtttaaagaaaaggtcgacacaaggaccccccggagtatgccgggtacacgcagagttatgggcatcactgccgagtggttatggaggaccctggggcgaaataaaaagcctcggttgtgcacgcgtgaggaattcaccaagaaagtgagaacaaacgctgccatgggagcggtatttactgaggaaaatcagtgggattctgcaaaggccgctgtggaggacgaagatttctggaaactcgtcgaccgcgagagggagctgcacaagctaggcaaatgtggtagctgcgtgtataacatgatggggaagcgggaaaaaaagcttggagagtttggcaaggccaaaggctcaagagcaatttggtacatgtggctgggggctcgctacctcgaattcgaggccctgggatttttgaatgaggatcattggttctccagggaaaacagttatagcggtgttgagggcgaagggctgcacaagctcggatacatccttcgagacatatctaaaatccccggcggtgctatgtatgccgatgacaccgcagggtgggacacacggattactgaggatgacctgcataatgaagagaagatcacccagcagatggatccagagcacagacaattagcgaacgccatttttaaactgacgtaccagaataaggtggtcaaggtgcagaggcctacacccaccggaactgtaatggacatcatatcccgcaaagatcagcgtggctcaggccaagttgggacatatggattgaacaccttcactaatatggaagctcagctcattcggcagatggagggtgaaggcgtgctgagcaaggccgacctagagaacccacaccttcccgaaaaaaagatcacccagtggctggagacaaaaggggtcgagagactcaagaggatggcaatctcgggagatgactgcgtggtgaagcctattgatgaccgctttgctaacgccctgttggcattaaatgatatgggcaaagtccgaaaggacataccacaatggcagccgtctaaaggttggcatgattggcagcaggttcccttctgtagtcaccatttccacgaactgatcatgaaggacgggcggaaactcgtggtaccttgcagaccacaagacgagcttattggaagggcccgcatctcccagggcgcgggctggagcctgagagaaacggcttgtctagggaaggcctacgcacagatgtggtcactgatgtattttcaccggagggatctccgtttggcctccaacgctatttgctctgccgtgcccgtccattgggtgcctaccagccgaactacatggagtatccacgcacatcaccaatggatgaccactgaggacatgctgacagtttggaatcgcgtgtggatagaagataacccatggatggaggacaagacccccgtcacgacatgggagaatgtgccttaccttggaaaaagagaagatcagtggtgtggttccctgatcggcctcaccagccgggctacttgggcccagaacattccgaccgcgatccagcaagtaaggtctttaattgggaatgaggaattcctggactacatgccatcaatgaagcgctttagaaaagaggaggaaagtgagggagctatctggtga

SEQ ID NO: 15095 - RNA, 9873 nt, synthetic construct
  misc_feature 1..9873: note = derived and/or modified CDS sequence (opt3) from DENV-3__JX669492__SS-prME
  source 1..9873: mol_type = other RNA
accagcttctgcctgatgatgatcctccccgcagctcttgcatttcacctgacttccagagacggagaacctaggatgattgtggggaagaacgaacggggaaagtctttgttattcaagactgcctcaggtataaatatgtgtacgctgatcgcgatggatctcggcgaaatgtgcgacgataccgtcacctacaaatgtccacatattactgaagttgagccggaagacatcgattgctggtgtaacctcaccagtacatgggtgacctatgggacttgcaatcaggctggagagcgccgacgtgacaagagaagcgtcgccctggcaccccacgtgggcatgggtcttgatacaaggacccagacgtggatgtccgccgagggggcttggcggcaggtcgaaaaagtggagacttgggcactgcgccatcctggatttaccattttggccctcttcctggctcactacatcggcacatctctgactcagaaggttgtgatatttatcctcttaatgctggtcaccccatcgatgacaatgagatgtgtgggcgtagggaacagggacttcgttgaaggactttcaggtgccacctgggtggatgtcgtgttggagcatggcgggtgcgtgacgactatggcgaagaataaacccacactggacattgagttgcagaagaccgaagcaactcagctcgccacactgcggaaactttgtatcgagggaaagattaccaacatcacgaccgatagccgctgccctacacagggcgaagctgtcctgccagaggaacaggaccagaattatgtttgtaaacacacttacgtggatcgaggttgggggaacggatgcggcttgtttggcaaggggagtctcgtaacctgcgccaagttccaatgtctggagcccatagagggaaaagtggtccagtatgaaaatttaaagtacacagtgattatcactgttcacaccggtgaccagcatcaggtgggcaacgagacacaaggggtcaccgcagaaattactcctcaggcttccacgacagaggccatcctgccagaatatggaaccctcggccttgagtgctctccgagaactggtctggactttaatgagatgatcttgctaaccatgaaaaacaaggcgtggatggtgcacaggcagtggttctttgatctgcccctcccttggacaagcggggccaccactgaaacaccaacgtggaatcggaaagagctgcttgtaaccttcaagaacgcacatgctaaaaagcaagaagttgtggtcctgggctcccaggagggagccatgcacactgctttgacaggcgccaccgaaattcaaaattcagggggaacaagtatatttgcaggtcacctcaagtgtcgtctgaaaatggacaagttagagctgaaaggcatgagctacgccatgtgcactaacaccttcgtgctaaagaaagaggtctctgaaacgcagcatgggaccatcctcattaaggtggagtacaagggagaagatgctccctgtaaaatccctttctccacagaggacggccaaggtaaggcgcacaacgggcgcctgataactgcaaatccagttgtgaccaaaaaggaggaacccgtaaacattgaggccgaaccgccttttggcgagtcaaatatcgtcatcggaattggcgataacgctcttaaaatcaattggtataagaaggggagcagtattggaaaaatgttcgaagccacagcaagaggtgccaggcggatggctatattgggcgacactgcctgggattttgggtctgtgggaggcgttctgaactccctcggtaagatggtgcatcagatcttcgggagcgcatacaccgcgctgttttcgggcgtctcttgggtgatgaaaattggaatcggcgtacttctgacgtggatcgggctaaattccaagaacacatcaatgagtttcagctgcattgctataggaatcattaccctctatctgggcgccgtggttcaggcagacatgggttgtgtcatcaattggaaagggaaggagttaaagtgcggatccggcatttttgtgactaacgaggtgcacacatggaccgaacagtacaaattccaagccgattctcccaagcgactggctactgccatcgccggtgcttgggagaatggcgtctgtgggatacgcagcaccacaagaatggaaaacctactctggaaacagatcgccaatgagctgaactatattctttgggaaaataacatcaagttgacggttgtggtgggagacattatcggcgtactggagcaggggaaaaggaccctcactccacagcctatggagctgaagtactcatggaaaacatggggaaaggcgaagatagtcaccgccgaaacacaaaacagttcctttattatcgatggccccaatactccagagtgccccagcgcttctcgggcatggaacgtgtgggaagttgaggactatggtttcggggtgtttaccacgaatatttggttaaaactgcgcgaagtctacacacagctttgtgaccatagattgatgtcagccgctgtgaaggatgagagggccgttcacgcagacatgggatactggatcgagagtcagaaaaacggcagctggaagctcgaaaaagcgtccctgatagaggtgaagacctgcacttggcctaagtctcacaccctatggtcgaatggtgtactggaaagcgatatgatcattccaaaatccctcgccggcccgatctcacagcataaccaccgtcccgggtatcatacacaaactgctggaccttggcacctgggcaaacttgagttggacttcaattactgcgaggggaccacagtcgtgattacggaaaactgtggaacccggggcccaagtctgcgaactacaaccgtgtctggtaaattaatccacgagtggtgctgtagaagctgcactctaccccctctgaggtatatgggggaagatggatgttggtacggcatggagatacgcccaatttccgaaaaggaggagaatatggtcaaatcacttgttagcgccggttctggcaaggtggacaactttacaatgggggtactgtgcttggcaatcctcttcgaagaggtgatgcggggaaagttcggcaaaaagcatatgatcgctggggtctttttcacctttgtgctgctactgtccggacagattacgtggagagatatggcccacactctcatcatgattggcagtaatgcaagcgacaggatgggtatgggggttacctatctggcccttatagctacattcaaaatccagccctttttggcgctgggattctttttacgcaagctcacctctcgagaaaacctgcttctgggcgtgggcctagccatggcaactacactccaactgccggaggatattgaacagatggctaatgggatcgccttgggactgatggccttaaaactcattacccagttcgagacataccagctgtggactgctcttatctccctgacctgttcaaacacgatgtttacattgaccgtcgcatggcggactgccaccctcatactggcgggtgtgagtctactgcctgtttgccaaagctcgtccatgcgtaagacagactggcttccaatggctgtggccgcaatgggcgtaccccctctccccctgttcatcttttctttgaaggatactctgaaaagaaggagctggccattaaatgagggggtaatggccgtgggactcgtttcaattctggctagttcccttctgcgcaacgacgtgcctatggcaggccccttggtcgccggtgggctcctgatcgcgtgttatgtgattaccggaacgtctgctgatctaacagtagaaaaggccgcagacatcacctgggaggaagaggccgaacagactggcgtgagccataacctgatgataacagtcgacgatgacggcaccatgcggattaaagatgacgagactgagaatatccttacagttctcctgaagaccgctttgttaatcgtgtccggggtgttcccatactcaattccggccacgctgctcgtctggcacacttggcagaaacagacccaaagaagcggagtgctgtgggatgttcctagtcccccagaaacacagaaggcagagcttgaagagggtgtatacaggataaaacagcagggcatctttgggaagacccaagtgggagtcggcgtgcagaaggagggtgttttccatacaatgtggcacgtgactcgaggggctgtcctgacctataacggaaaacgcttggaacccaattgggcctctgtgaagaaagacctaatttcctacggcggcgggtggcggctgagcgcgcagtggcaaaagggagaggaagtacaggtcatcgccgtggagcctggtaaaaacccaaagaatttccagacgatgcccggcacatttcagactaccacaggggaaattggagcaatcgctctcgatttcaagcctggcacctcgggttcaccgataatcaacagagaggggaaagttgtgggactgtatggcaatggcgtcgtgactaagaacgggggatacgtttctggtattgcccaaaccaatgctgagccagacggccccacacctgaacttgaggaagagatgtttaaaaagaggaacttaacgatcatggatctgcacccagggagtggaaaaactcgtaagtatctccccgcaattgtgcgcgaagccatcaagcggagattgaggaccctgatactcgcccctacacgagtcgtggctgcggagatggaggaagcactgaaaggccttccgattcggtaccagaccactgccacaaagtccgagcataccggtcgcgaaatcgtagacctgatgtgccacgctacgttcactatgagattgctaagccccgtgagggttccaaattataacctgatcattatggatgaggcccattttacagaccctgcatctatcgccgctcgggggtacataagcacccgagtcggaatgggcgaagcggccgcaattttcatgaccgctactcccccaggcacagccgatgcatttcctcagtccaatgcccccatccaggacgaggagagagacattccagaacgctcatggaacagtgggaatgagtggatcaccgatttcgctggaaaaacagtgtggtttgtgccgagcataaaggccggtaacgacattgcgaactgtctcaggaaaaatggcaagaaggtcatccaattatctcgtaaaactttcgatacggaataccagaagaccaaactgaacgactgggattttgtagtgacaactgacatctccgagatgggggcaaatttcaaggccgatcgggttattgaccctagaaggtgccttaaacccgtgatcctgaccgatggaccagagcgcgtcattctcgctggccccatgcctgtgacagccgcttcagcagcccagcgaagaggtcgggttgggaggaacccacagaaggaaaatgaccaatatatattcaccggccagcccttgaacaatgatgaggaccacgctcattggactgaagccaagatgctgctcgacaacatcaatacgcctgagggaattatcccggcactgtttgaaccagagcgcgagaaaagtgcggccatcgatggcgaataccgtcttaagggggagagcagaaaaaccttcgtggaactaatgcggaggggagacctgcccgtctggttggctcacaaggtggcctccgagggtattaaatatacagatcgcaagtggtgctttgacggccagcgaaacaatcagatattagaagagaacatggatgtagagatctggactaaagaaggggagaagaagaaactgagacctcggtggctcgacgcaaggacctactctgatcccctggctcttaaggagttcaaagactttgccgcaggacgcaagtcgattgccctggatctcgtgacagagatcggcagagttccaagccacttggctcataggacccggaatgcgctggacaacctagtcatgctgcacacttcagaacatggtgggcgtgcctatcgccacgcagtggaggagctccctgaaacaatggagacgcttctgttattgggcctgatgattctcctgaccggaggcgctatgcttttcctgatctccgggaaaggaataggtaagacaagtatcggcctcatttgtgtgatcgcctctagcgggatgttgtggatggccgaaattcccctgcaatggatcgcatccgctatagtcttagagtttttcatgatggttctactgattccagagcctgaaaagcagcgaacaccgcaggataatcaactcgcctacgtggtaatcggcattcttaccctggcggctatcatagccgcaaacgagatgggcttgctggaaaccacaaaaagagacctcggtatgtcaaaggagcccggggtggtctctccaactagctatctggatgtggaccttcaccctgccagtgcttggacgctctacgcagttgccaccacagtgatcactcccatgctgaggcataccattgaaaattccacagcgaacgtcagcttggctgccatcgcaaaccaggccgtagtgctgatgggcttagacaaaggatggccaatttctaagatggatctaggcgttcctctgctcgctcttgggtgctactcacaggtgaatcccctgaccttgactgccgcagtcctgctcctgatcacgcactatgctataattggaccgggccttcaggccaaagcgacacgggaggcccaaaagcgcaccgcagctggtatcatgaagaacccaactgtggacgggatcatgaccattgatttagaccctgtcatctacgattccaaatttgagaagcagctgggacaggtgatgctcttggttctgtgtgccgtgcagctactgctcatgagaacaagttgggcactttgcgaagctctgactttggccaccggccccataacaacgctgtgggagggtagcccaggcaaattctggaataccactattgccgtatcgatggcgaacatctttagggggtcttatctcgctggagcaggcctggccttctccattatgaaaagcgtggggacaggaaaacggggcaccggttcacaaggggaaactttaggagagaagtggaagaagaaacttaatcagctgagtcgaaaagaatttgacctctacaagaaatctggcatcacagaggtcgatagaaccgaggctaaagaaggtctaaaacgcggcgagataacgcatcacgccgtttccagggggagcgcaaagctgcagtggttcgtggaacggaacatggtcatccccgagggacgtgtgattgacttgggctgtgggagaggaggctggtcatattactgcgccggtctgaagaaagtaaccgaagtgagggggtatacaaagggaggccctggccatgaggagccggttcccatgagtacttacgggtggaatatcgtgaaactcatgagcggaaaggatgtcttctaccttccacctgaaaaatgtgacaccctgttgtgcgatattggtgagtcctctcccagccctacagtggaagagtcccgcactatccgggtcctgaagatggtggagccatggctcaagaacaatcagttttgtattaaagttttaaacccctatatgcctaccgtaatcgaacacctggagcgacttcaaagaaagcacggcgggatgctggtgaggaatccactatcacgcaactctacacatgaaatgtactggataagtaatggaaccggcaacattgtcgcttcggtgaatatggttagccggctcctgttgaacagattcactatgacgcaccgtaggcccacaatcgagaaagacgtggatctgggtgcggggacccggcatgtcaacgccgaaccggagactcctaatatggacgtgatcggagagcgcattaagcgaataaaagaagaacacaactccacctggcactatgacgatgaaaatccatacaagacatgggcatatcatggctcttacgaggtaaaggctacgggctcagccagctccatgatcaacggggtggttaaactccttaccaagccctgggacgtcgtgcctatggtgactcagatggcaatgacagataccactccatttggacagcaaagagtcttcaaagaaaaggttgacacaaggacaccccggagtatgccgggtacacgcagagtgatgggcattactgccgagtggctgtggaggaccttagggcgaaataaaaagcctcggctgtgcacgcgtgaggaatttaccaagaaagtaagaacaaacgctgccatgggagcggtgttcactgaggaaaatcagtgggattctgcaaaggccgctgtcgaggacgaagatttttggaaattggtggaccgcgagagggagctccacaagctgggcaaatgtggtagctgcgtttataacatgatggggaagcgggagaagaagctaggagagttcggcaaggccaaaggctcaagagcaatctggtacatgtggcttggggctcgctacctggaatttgaggccctcggattcctgaatgaggatcattggttttccagggaaaacagttatagcggtgtggagggcgaagggttgcacaagctgggatacattctccgagacatctctaaaatacccggcggtgctatgtatgccgatgacaccgcagggtgggacacacggatcactgaggatgaccttcataatgaagagaagattacccagcagatggatccagagcacagacaactggcgaacgccatcttcaaattaacgtaccagaataaggtcgtgaaggtacagaggcctacacccaccggaactgttatggacattatctcccgcaaagatcagcgtggctcaggccaagtggggacatatggactgaacacctttactaatatggaagctcagttgatacggcagatggagggtgaaggcgtcctcagcaaggccgacctggagaacccacacctacccgagaagaagattacccagtggcttgagacaaaaggggtggagagactgaagaggatggcaatctcgggagatgactgcgtggtcaagcctatcgatgaccgcttcgctaacgccctcctggcattgaatgatatgggcaaagttcgaaaggacattccacaatggcagccgtctaaaggttggcatgattggcaacaggtgcccttctgtagtcaccattttcacgaattaataatgaaggacgggcggaaactggtagtgccttgcagaccacaagacgagctcatcggaagggcccgcatttcccagggcgcgggctggagccttagagaaacggcttgtctggggaaggcctacgcacagatgtggtcactaatgtatttccaccggagggatctgcgtctcgcctccaacgctatctgctctgccgtccccgtgcattgggttcctaccagccgaactacatggagtattcacgcacatcaccaatggatgaccactgaggacatgttgacagtgtggaatcgcgtctggatcgaagataacccatggatggaggacaagacccccgtgacgacatgggagaatgtaccttacctgggaaaaagagaagatcagtggtgtggttcccttataggcctgaccagccgggctacttgggcccagaacatcccgaccgcgattcagcaagttaggtctctcatcgggaatgaggaatttttagactacatgccatcaatgaagcgcttcagaaaagaggaggaaagtgagggagctatttggtga

SEQ ID NO: 15096 - RNA, 9873 nt, synthetic construct
  misc_feature 1..9873: note = derived and/or modified CDS sequence (opt3) from DENV-3__JX669500__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagcccatagagggaaaagtggtccagtatgaaaatctgaagtacacagtgattatcactgttcacaccggtgaccagcatcaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaaaaacaaggcgtggatggtgcacaggcagtggtttttcgatctccccctgccttggacaagcggggccaccactgaaacaccaacgtggaatcggaaagagcttctggtaacctttaagaacgcacatgctaaaaagcaagaagttgtggtcttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtgctcaagaaagaggtctctgaaacgcagcatgggaccatcctgattaaggtggagtacaagggagaagatgctccctgtaaaatccctttctccacagaggacggccaaggtaaggcgcacaacgggcgccttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcaagaggtgccaggcggatggctatactgggcgacactgcctgggatttcgggtctgtgggaggcgttctcaactccctgggtaagatggtgcatcagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcacacatggaccgaacagtacaaatttcaagccgattctcccaagcgactagctactgccatcgcaggtgcttgggagaatggcgtctgtgggatacgcagcaccacaagaatggaaaacctcctgtggaaacagatcgccaatgagcttaactatattttgtgggaaaataacatcaagctgacggttgtggtgggagacattatcggcgtactcgagcaggggaaaaggaccctgactccacagcctatggagttaaagtactcatggaaaacatggggaaaggcgaagatagtcaccgccgaaacacaaaacagttccttcattatcgatggccccaatactccagagtgccccagcgcttctcgggcatggaacgtgtgggaagttgaggactatggttttggggtgttcaccacgaatatttggctgaaacttcgcgaagtctacacacagttgtgtgaccatagactcatgtcagccgctgtgaaggatgagagggccgttcacgcagacatgggatactggatcgagagtcagaaaaacggcagctggaagctggaaaaagcgtccctaatagaggtgaagacctgcacttggcctaagtctcacaccctgtggtcgaatggtgtactcgaaagcgatatgatcattccaaaatccctggccggcccgatctcacagcataaccaccgtcccgggtatcatacacaaactgctggaccttggcaccttggcaagttggagctggactttaattactgcgaggggaccacagtcgtgattacggaaaactgtggaacccggggcccaagtttacgaactacaaccgtgtctggtaaactcatccacgagtggtgctgtagaagctgcactctgccccctcttaggtatatgggggaagatggatgttggtacggcatggagatacgcccaatttccgaaaaggaggagaatatggtcaaatcactggttagcgccggttctggcaaggtggacaacttcacaatgggggtattgtgcctcgcaatcctgtttgaagaggtgatgcggggaaagttcggcaaaaagcatatgatcgctggggtcttctttaccttcgtgctactgctctccggacagattacgtggagagatatggcccacactctgatcatgattggcagtaatgcaagcgacaggatgggtatgggggttacctatcttgccttgatagctacatttaaaatccagcccttcctggcgttaggatttttcctccgcaagctgacctctcgagaaaaccttctgctaggcgtgggcctcgccatggcaactacactgcaattgccggaggatattgaacagatggctaatgggatcgccctgggattaatggccctcaaactgattacccagtttgagacataccagctttggactgctctgatctccttgacctgttcaaacacgatgttcacactcaccgtcgcatggcggactgccaccctgatactagcgggtgtgagtctgcttcctgtttgccaaagctcgtccatgcgtaagacagactggctcccaatggctgtggccgcaatgggcgtcccccctctgcccttgtttatcttctctctgaaggatactttaaaaagaaggagctggccactcaatgagggggtaatggccgtgggactggtttcaattcttgctagttccctgttgcgcaacgacgtgcctatggcaggccccctcgtcgccggtgggctgctaatcgcgtgttatgtgattaccggaacgtctgctgatctgacagtagaaaaggccgcagacatcacctgggaggaagaggccgaacagactggcgtgagccataaccttatgataacagtcgacgatgacggcaccatgcggattaaagatgacgagactgagaatatcctcacagttctgttgaagaccgctttactgatcgtgtccggggtgtttccatactcaattccggccacgctcctggtctggcacacttggcagaaacagacccaaagaagcggagtgctttgggatgttcctagtcccccagaaacacagaaggcagagctggaagagggtgtatacaggataaaacagcagggcatcttcgggaagacccaagtgggagtcggcgtgcagaaggagggtgtttttcatacaatgtggcacgtgactcgaggggctgtcttgacctataacggaaaacgcctagaacccaattgggcctctgtgaagaaagacctgatttcctacggcggcgggtggcggctcagcgcgcagtggcaaaagggagaggaagtacaggtcatcgccgtggagcctggtaaaaacccaaagaatttccagacgatgcccggcacattccagactaccacaggggaaattggagcaatcgctctggattttaagcctggcacctcgggttcaccgataatcaacagagaggggaaagttgtgggactttatggcaatggcgtcgtgactaagaacgggggatacgtttctggtattgcccaaaccaatgctgagccagacggccccacacctgaattagaggaagagatgttcaaaaagaggaacctgacgatcatggatctccacccagggagtggaaaaactcgtaagtatttgcccgcaattgtgcgcgaagccatcaagcggagactgaggaccctcatactggcccctacacgagtcgtggctgcggagatggaggaagcacttaaaggcctgccgattcggtaccagaccactgccacaaagtccgagcataccggtcgcgaaatcgtagacttgatgtgccacgctacgtttactatgagactactgagccccgtgagggttccaaattataacctcatcattatggatgaggcccatttcacagaccctgcatctatcgccgctcgggggtacataagcacccgagtcggaatgggcgaagcggccgcaatttttatgaccgctactcccccaggcacagccgatgcattccctcagtccaatgcccccatccaggacgaggagagagacattccagaacgctcatggaacagtgggaatgagtggatcaccgattttgctggaaaaacagtgtggttcgtgccgagcataaaggccggtaacgacattgcgaactgtttaaggaaaaatggcaagaaggtcatccaactgtctcgtaaaacttttgatacggaataccagaagaccaaacttaacgactgggatttcgtagtgacaactgacatctccgagatgggggcaaattttaaggccgatcgggttattgaccctagaaggtgcctgaaacccgtgatcctcaccgatggaccagagcgcgtcattttggctggccccatgcctgtgacagccgcttcagcagcccagcgaagaggtcgggttgggaggaacccacagaaggaaaatgaccaatatatattcaccggccagcccctgaacaatgatgaggaccacgctcattggactgaagccaagatgctcctggacaacatcaatacgcctgagggaattatcccggcacttttcgaaccagagcgcgagaaaagtgcggccatcgatggcgaataccgtctaaagggggagagcagaaaaacctttgtggaactgatgcggaggggagacttgcccgtctggttagctcacaaggtggcctccgagggtattaaatatacagatcgcaagtggtgcttcgacggccagcgaaacaatcagatactggaagagaacatggatgtagagatctggactaaagaaggggagaagaagaaactcagacctcggtggctggacgcaaggacctactctgatccccttgctctgaaggaatttaaagacttcgccgcaggacgcaagtcgattgccctcgatttggtgacagagatcggcagagttccaagccacctggctcataggacccggaatgcgctagacaacctggtcatgctccacacttcagaacatggtgggcgtgcctatcgccacgcagtggaggagcttcctgaaacaatggagacgctgttattgctgggcctcatgattctgcttaccggaggcgctatgctgtttctcatctccgggaaaggaataggtaagactagtatcggcttgatttgtgtgatcgcctctagcgggatgctgtggatggccgaaattcccttacaatggatcgcatccgctatagtcctagagttctttatgatggttctgctcattccagagcctgaaaagcagcgaacaccgcaggataatcaacttgcctacgtggtaatcggaattctgaccttggcggctatcatagccgcaaacgagatgggcctgctcgaaaccacaaaaagagacctgggtatgtcaaaggagcccggggtggtctctccaactagctatcttgatgtggacctccaccctgccagtgcttggacgctgtacgcagttgccaccacagtgatcactcccatgttgaggcataccattgaaaattccacagcgaacgtcagcctggctgccatcgcaaaccaggccgtagtgttaatgggcctagacaaaggatggccaatttctaagatggatctgggcgttcctctccttgctctggggtgctactcacaggtgaatcccttgaccctgactgccgcagtcctcctgcttatcacgcactatgctataattggaccgggcttacaggccaaagcgacacgggaggcccaaaagcgcaccgcagctggtatcatgaagaacccaactgtggacgggatcatgaccattgatctggaccctgtcatctacgattccaaattcgagaagcagctcggacaggtgatgttgctggttctatgtgccgtgcagctgctccttatgagaacaagttgggcactgtgcgaagctttgactctggccaccggccccataacaacgctctgggagggtagcccaggcaaattttggaataccactattgccgtatcgatggcgaacatcttcagggggtcttatctggctggagcaggcttagccttttccattatgaagagcgtggggacaggaaaacggggcaccggttcacaaggggaaactcttggagagaagtggaagaaaaagctgaatcagctcagtcgaaaagaattcgacctatacaagaaatctggcatcacagaggtcgatagaaccgaggctaaggaaggtctgaaacgcggcgagataacgcatcacgccgtttccagggggagcgcaaagttgcagtggtttgtggaacggaacatggtcatccccgagggacgtgtgattgacctgggctgtgggagaggaggctggtcatattactgcgccggtctcaagaaagtaaccgaagtgagggggtatacaaagggaggccctggccatgaggagccggttcccatgagtacttacgggtggaatatcgtgaaacttatgagcggaaaggatgtcttctacctgccacctgaaaaatgtgacaccttgctgtgcgatattggtgagtcctctcccagccctacagtggaagagtcccgcactatccgggtcctcaagatggtggagccatggttaaagaacaatcagttctgtattaaagttctgaacccctatatgcctaccgtaatcgaacaccttgagcgactgcaaagaaagcacggcgggatgctagtgaggaatccactctcacgcaactctacacatgaaatgtactggataagtaatggaaccggcaacattgtcgcttcggtgaatatggttagccggctgttgctgaacagatttactatgacgcaccgtaggcccacaatcgagaaagacgtggatctcggtgcggggacccggcatgtcaacgccgaaccggagactcctaatatggacgtgatcggagagcgcattaagcgaataaaagaagagcacaactccacctggcactatgacgatgaaaatccatacaagacatgggcatatcatggctcttacgaggtaaaggctacgggctcagccagctccatgatcaacggggtggttaaacttctgaccaagccctgggacgtcgtgcctatggtgactcagatggcaatgacagataccactccattcggacagcaaagagtctttaaagaaaaggttgacacaaggaccccccggccgatgcctggtacacgcagagtgatgggcattactgccgagtggttatggaggaccctggggcgaaataaaaagccccggttgtgcacgcgtgaggaattcaccaagaaagtaagaacaaacgctgccatgggagcggtgtttactgaggaaaatcagtgggatagtgcaaaggccgctgtcgaggacgaagatttctggaaactcgtggaccgcgagagggagctgcacaagctaggcaaatgtggttcttgcgtttataacatgatggggaagcgggaaaaaaagcttggagagtttggcaaggccaaaggcagcagagcaatctggtacatgtggctgggggctcgctacctcgaattcgaggccctgggatttttgaatgaggatcattggttctcaagggaaaactcctatagtggtgtggagggcgaagggctgcacaagctcggatacattcttcgagacatcagcaaaataccaggcggtgctatgtatgccgatgacaccgcagggtgggacacacggatcactgaggatgacctgcataatgaagagaagattacccagcagatggatcctgagcacagacaattagcgaacgccatctttaaactgacgtaccagaataaggtcgtgaaggtacagaggcccacaccaaccggaactgttatggacattatctctcgcaaagatcagcgtggctccggccaagtggggacatatggattgaacaccttcactaatatggaagctcagctcatacggcagatggagggtgaaggcgtcctgtcaaaggccgacctagagaacccccaccttcctgaaaaaaagattacccagtggctggagacaaaaggggtggagagactcaagaggatggcaatcagcggagatgactgcgtggtcaagccaatcgatgaccgctttgctaacgccctgttggcattaaatgatatgggcaaagttcgaaaggacattccgcaatggcagccctcgaaaggttggcatgattggcagcaggtgcctttctgttctcaccatttccacgaactgataatgaaggacgggcggaaactcgtagtgccatgcagaccccaagacgagcttatcggaagggcccgcattagtcagggcgcgggctggtccctgagagaaacggcttgtctagggaaggcctacgcacagatgtggagcctgatgtattttcaccggagggatctccgtttggcctcaaacgctatctgctccgccgtccctgtgcattgggttccaacctctcgaactacatggagcattcacgcacatcaccaatggatgaccactgaggacatgctgacagtgtggaatcgcgtctggatcgaagataacccctggatggaggacaagacccctgtgacgacatgggagaatgtaccgtaccttggaaaaagagaagatcagtggtgtggtagtctgataggcctcacctcccgggctacttgggcccagaacatcccaaccgcgattcagcaagttaggagcttaatcgggaatgaggaattcctggactacatgccctctatgaagcgctttagaaaagaggaggaatcagagggagctatttggtga

SEQ ID NO: 15097 - RNA, 9873 nt, synthetic construct
  misc_feature 1..9873: note = derived and/or modified CDS sequence (opt3) from DENV-3__JX669497__SS-prME
  source 1..9873: mol_type = other RNA
accagcctgtgcctcatgatgatccttcccgcagctctggcattccacttgacttccagagacggagaacctaggatgattgtggggaagaacgaacggggaaaatctttactgtttaagactgcctcaggtataaatatgtgtacgctcatcgcgatggatctcggcgaaatgtgcgacgataccgtcacctacaaatgtccacatattactgaagttgaaccggaagacatcgattgctggtgtaacctgaccagtacatgggtgacctatgggacttgcaatcaggctggagaacgccgacgtgacaagagaagcgtcgcccttgcaccccacgtgggcatgggtctggatacaaggacccagacgtggatgtccgccgaaggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacattggacattgagctccagaagaccgaagcaactcagctggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagcccatagagggaaaagtggtccagtatgaaaatctgaagtacacagtgattatcactgttcacaccggtgaccagcatcaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaaaaacaaggcgtggatggtgcacaggcagtggtttttcgatctccccctgccttggacaagcggggccaccactgaaacaccaacgtggaatcggaaagagcttctggtaacctttaagaacgcacatgctaaaaagcaagaagttgtggtcttgggctcccaggagggagccatgcacactgctctcacaggcgccaccgaaattcaaaattcagggggaacaagtatattcgcaggtcacctgaagtgtcgtttaaaaatggacaagctggagctaaaaggcatgagctacgccatgtgcactaacacctttgtgctcaagaaagaggtctctgaaacgcagcatgggaccatcctgattaaggtggagtacaagggagaagatgctccctgtaaaatccctttctccacagaggacggccaaggtaaggcgcacaacgggcgccttataactgcaaatccagttgtgaccaaaaaggaggaacccgtaaacattgaggccgaaccgcctttcggcgagtcaaatatcgtcatcggaattggcgataacgctagcaaaatcaattggtataagaaggggagttctattggaaaaatgtttgaagccacagcaagaggtgccaggcggatggctatattgggcgacactgcctgggatttcgggtccgtgggaggcgttctgaacagcctcggtaagatggtgcatcagatctttgggtcggcatacaccgcgctgttctctggcgtctcctgggtgatgaaaattggaatcggcgtacttctgacgtggatcgggctaaattcaaagaacacaagtatgagcttttcctgcattgctataggaatcattaccctctatctgggcgccgtggttcaggcagacatgggttgtgtcatcaattggaaagggaaggagttaaagtgcggatctggcattttcgtgactaacgaggtgcacacatggaccgaacagtacaaatttcaagccgatagccccaagcgactggctactgccatcgccggtgcttgggagaatggcgtctgtgggatacgctcaaccacaagaatggaaaacctactctggaaacagatcgccaatgagctgaactatattctttgggaaaataacatcaagttgacggttgtggtgggagacattatcggcgtactggagcaggggaaaaggaccctcactccacagcctatggagctgaagtacagttggaaaacatggggaaaggcgaagatagtcaccgccgaaacacaaaactccagcttcattatcgatggccccaatactccagagtgcccctctgcttcacgggcatggaacgtgtgggaagttgaggactatggttttggggtgttcaccacgaatatttggttaaaactgcgcgaagtctacacacagctttgtgaccatagattgatgagtgccgctgtgaaggatgagagggccgttcacgcagacatgggatactggatcgagagccagaaaaacggctcctggaagctcgaaaaagcgtctctgatagaggtgaagacctgcacttggcctaagtcgcacaccctatggagcaatggtgtactggaatccgatatgatcattccaaaatcactcgccggcccgatcagtcagcataaccaccgtcccgggtatcatacacaaactgctggaccttggcacctgggcaaacttgagttggactttaattactgcgaggggaccacagtcgtgattacggaaaactgtggaacccggggcccatctctgcgaactacaaccgtgagcggtaaattaatccacgagtggtgctgtagatcctgcactctaccccctctgaggtatatgggggaagatggatgttggtacggcatggagatacgcccaatttcagaaaaggaggagaatatggtcaaaagccttgtttctgccggttccggcaaggtggacaacttcacaatgggggtactgtgcttggcaatcctctttgaagaggtgatgcggggaaagttcggcaaaaagcatatgatcgctggggtcttctttaccttcgtgctgctactgagtggacagattacgtggagagatatggcccacactctcatcatgattggcagcaatgcatctgacaggatgggtatgggggttacctatctggcccttatagctacatttaaaatccagcccttcttggcgctgggatttttcttacgcaagctcacctcccgagaaaacctgcttctgggcgtgggcctagccatggcaactacactccaactgccggaggatattgaacagatggctaatgggatcgccttgggactgatggccttaaaactcattacccagtttgagacataccagctgtggactgctcttatctcactgacctgtagtaacacgatgttcacattgaccgtcgcatggcggactgccaccctcatactggcgggtgtgagcctactgcctgtttgccaatcgtcctctatgcgtaagacagactggcttccaatggctgtggccgcaatgggcgtaccccctctccccctgtttatcttcagcttgaaggatactctgaaaagaaggtcatggccattaaatgagggggtaatggccgtgggactcgttagtattctggcttcctctcttctgcgcaacgacgtgcctatggcaggccccttggtcgccggtgggctcctgatcgcgtgttatgtgattaccggaacgagcgctgatctaacagtagaaaaggccgcagacatcacctgggaggaagaggccgaacagactggcgtgtcccataacctgatgataacagtcgacgatgacggcaccatgcggattaaagatgacgagactgagaatatccttacagttctcctgaagaccgctttgttaatcgtgtcaggggtgtttccatacagcattccggccacgctgctcgtctggcacacttggcagaaacagacccaaagaagtggagtgctgtgggatgttccttctcccccagaaacacagaaggcagagcttgaagagggtgtatacaggataaaacagcagggcatcttcgggaagacccaagtgggagtcggcgtgcagaaggagggtgtttttcatacaatgtggcacgtgactcgaggggctgtcctgacctataacggaaaacgcttggaacccaattgggcctccgtgaagaaagacctaattagctacggcggcgggtggcggctgtcggcgcagtggcaaaagggagaggaagtacaggtcatcgccgtggagcctggtaaaaacccaaagaatttccagacgatgcccggcacattccagactaccacaggggaaattggagcaatcgctctcgattttaagcctggcacctcaggttctccgataatcaacagagaggggaaagttgtgggactgtatggcaatggcgtcgtgactaagaacgggggatacgttagtggtattgcccaaaccaatgctgagccagacggccccacacctgaacttgaggaagagatgttcaaaaagaggaacttaacgatcatggatctgcacccagggtccggaaaaactcgtaagtatctccccgcaattgtgcgcgaagccatcaagcggagattgaggaccctgatactcgcccctacacgagtcgtggctgcggagatggaggaagcactgaaaggccttccgattcggtaccagaccactgccacaaagagcgagcataccggtcgcgaaatcgtagacctgatgtgccacgctacgtttactatgagattgctatctcccgtgagggttccaaattataacctgatcattatggatgaggcccatttcacagaccctgcaagcatcgccgctcgggggtacatatccacccgagtcggaatgggcgaagcggccgcaatttttatgaccgctactcccccaggcacagccgatgcattccctcagtcaaatgcccccatccaggacgaggagagagacattccagaacgcagttggaacagcgggaatgagtggatcaccgattttgctggaaaaacagtgtggttcgtgccgtctataaaggccggtaacgacattgcgaactgtctcaggaaaaatggcaagaaggtcatccaattatcccgtaaaacttttgatacggaataccagaagaccaaactgaacgactgggatttcgtagtgacaactgacatctcagagatgggggcaaattttaaggccgatcgggttattgaccctagaaggtgccttaaacccgtgatcctgaccgatggaccagagcgcgtcattctcgctggccccatgcctgtgacagccgctagtgcagcccagcgaagaggtcgggttgggaggaacccacagaaggaaaatgaccaatatatattcaccggccagcccttgaacaatgatgaggaccacgctcattggactgaagccaagatgctgctcgacaacatcaatacgcctgagggaattatcccggcactgttcgaaccagagcgcgagaaaagcgcggccatcgatggcgaataccgtcttaagggggagtccagaaaaacctttgtggaactaatgcggaggggagacctgcccgtctggttggctcacaaggtggcctctgagggtattaaatatacagatcgcaagtggtgcttcgacggccagcgaaacaatcagatattagaagagaacatggatgtagagatctggactaaagaaggggagaagaagaaactgagacctcggtggctcgacgcaaggacctactcggatcccctggctcttaaggaatttaaagacttcgccgcaggacgcaagagcattgccctggatctcgtgacagagatcggcagagttccatcacacttggctcataggacccggaatgcgctggacaacctagtcatgctgcacacttccgaacatggtgggcgtgcctatcgccacgcagtggaggagctccctgaaacaatggagacgcttctgttattgggcctgatgattctcctgaccggaggcgctatgctttttctgatcagtgggaaaggaataggtaagacttctatcggcctcatttgtgtgatcgccagctccgggatgttgtggatggccgaaattcccctgcaatggatcgcatcagctatagtcttagagttctttatgatggttctactgattccagagcctgaaaagcagcgaacaccgcaggataatcaactcgcctacgtggtaatcggcattcttaccctggcggctatcatagccgcaaacgagatgggcttgctggaaaccacaaaaagagacctcggtatgtctaaggagcccggggtggtcagcccaacaagttatctggatgtggaccttcaccctgcctccgcttggacgctctacgcagttgccaccacagtgatcactcccatgctgaggcataccattgaaaatagcacagcgaacgtctctttggctgccatcgcaaaccaggccgtagtgctgatgggcttagacaaaggatggccaatttcaaagatggatctaggcgttcctctgctcgctcttgggtgctactcccaggtgaatcccctgaccttgactgccgcagtcctgctcctgatcacgcactatgctataattggaccgggccttcaggccaaagcgacacgggaggcccaaaagcgcaccgcagctggtatcatgaagaacccaactgtggacgggatcatgaccattgatttagaccctgtcatctacgatagtaaattcgagaagcagctgggacaggtgatgctcttggttctgtgtgccgtgcagctactgctcatgagaacaagctgggcactttgcgaagctctgactttggccaccggccccataacaacgctgtgggagggttcgccaggcaaattttggaataccactattgccgtatctatggcgaacatcttcagggggtcctatctcgctggagcaggcctggcctttagcattatgaagtcagtggggacaggaaaacggggcaccggtagtcaaggggaaactttaggagagaagtggaagaagaaacttaatcagctgtctcgaaaagagttcgacctctacaagaaatccggcatcacagaggtcgatagaaccgaggctaaagaaggtctaaaacgcggcgagataacgcatcacgccgttagcagggggtcagcaaagctgcagtggtttgtggaacggaacatggtcatccccgagggacgtgtgattgacttgggctgtgggagaggaggctggagttattactgcgccggtctgaagaaagtaaccgaagtgagggggtatacaaagggaggccctggccatgaggagccggttcccatgagcacttacgggtggaatatcgtgaaactcatgtccggaaaggatgtcttctaccttccacctgaaaaatgtgacaccctgttgtgcgatattggtgagtctagcccctcccctacagtggaagagtcacgcactatccgggtcctgaagatggtggagccatggctcaagaacaatcagttctgtattaaagttttaaacccctatatgcctaccgtaatcgaacacctggagcgacttcaaagaaagcacggcgggatgctggtgaggaatccactatctcgcaacagtacacatgaaatgtactggatatcgaatggaaccggcaacattgtcgctagcgtgaatatggtttcccggctcctgttgaacagatttactatgacgcaccgtaggcccacaatcgagaaagacgtggatctgggtgcggggacccggcatgtcaacgccgaaccggagactcctaatatggacgtgatcggagagcgcattaagcgaataaaagaagaacacaactctacctggcactatgacgatgaaaatccatacaagacatgggcatatcatggctcatacgaggtaaaggctacgggcagcgcctccagtatgatcaacggggtggttaaactccttaccaagccctgggacgtcgtgcctatggtgactcagatggcaatgacagataccactccattcggacagcaaagagtctttaaagaaaaggttgacacaaggacaccccggtctatgccgggtacacgcagagtgatgggcattactgccgagtggctgtggaggaccttagggcgaaataaaaagcctcggctgtgcacgcgtgaggagttcaccaagaaagtaagaacaaacgctgccatgggagcggtgtttactgaggaaaatcagtgggatagcgcaaaggccgctgtcgaggacgaagatttctggaaattggtggaccgcgagagggagctccacaagctgggcaaatgtggttcatgcgtttataacatgatggggaagcgggagaagaagctaggagagtttggcaaggccaaaggctccagagcaatctggtacatgtggcttggggctcgctacctggagttcgaggccctcggatttctgaatgaggatcattggttcagtagggaaaacagctattctggtgtggagggcgaagggttgcacaagctgggatacattctccgagacatctccaaaatacccggcggtgctatgtatgccgatgacaccgcagggtgggacacacggatcactgaggatgaccttcataatgaagagaagattacccagcagatggatccagagcacagacaactggcgaacgccatctttaaattaacgtaccagaataaggtcgtgaaggtacagaggcctacacccaccggaactgttatggacattatctcacgcaaagatcagcgtggcagcggccaagtggggacatatggactgaacaccttcactaatatggaagctcagttgatacggcagatggagggtgaaggcgtcctctcgaaggccgacctggagaacccacacctacccgagaagaagattacccagtggcttgagacaaaaggggtggagagactgaagaggatggcaatctctggagatgactgcgtggtcaagcctatcgatgaccgctttgctaacgccctcctggcattgaatgatatgggcaaagttcgaaaggacattccacaatggcagccgagtaaaggttggcatgattggcaacaggtgcccttctgttcccaccatttccacgaattaataatgaaggacgggcggaaactggtagtgccttgcagaccacaagacgagctcatcggaagggcccgcattagccagggcgcgggctggtcacttagagaaacggcttgtctggggaaggcctacgcacagatgtggtccctaatgtattttcaccggagggatctgcgtctcgcctctaacgctatctgcagcgccgtccccgtgcattgggttcctaccagtcgaactacatggtccattcacgcacatcaccaatggatgaccactgaggacatgttgacagtgtggaatcgcgtctggatcgaagataacccatggatggaggacaagacccccgtgacgacatgggagaatgtaccttacctgggaaaaagagaagatcagtggtgtggtagccttataggcctgacctctcgggctacttgggcccagaacatcccgaccgcgattcagcaagttaggtcactcatcgggaatgaggagttcttagactacatgccaagtatgaagcgctttagaaaagaggaggaatccgagggagctatttggtga

SEQ ID NO: 15098 - RNA, 9873 nt, synthetic construct
  misc_feature 1..9873: note = derived and/or modified CDS sequence (opt3) from DENV-3__JX669501__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagcccatagagggaaaagtggtccagtatgaaaatctgaagtacacagtgattatcactgttcacaccggtgaccagcatcaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaaaaacaaggcgtggatggtgcacaggcagtggtttttcgatctccccctgccttggacaagcggggccaccactgaaacaccaacgtggaatcggaaagagcttctggtaacctttaagaacgcacatgctaaaaagcaagaagttgtggtcttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtgctcaagaaagaggtctctgaaacgcagcatgggaccatcctgattaaggtggagtaccgcggagaagatgctccctgtaagatccctttctccacagaggacggccaaggtaaagcgcacaacgggagacttataactgcaaatccagttgtgaccaagaaagaggaacccgtaaacattgaggccgaaccgcctttcggcgagtcaaatatcgtcatcggaattggcgataacgctttgaagatcaattggtataaaaaggggagcagtattggaaagatgtttgaagccacagcaaggggtgcccggcgaatggctatactgggcgacactgcctgggatttcgggtctgtgggaggcgttctcaactccctgggtaaaatggtgcatcagatctttgggagcgcatacaccgcgcttttctcgggcgtctcttgggtgatgaagattggaatcggcgtactgttgacgtggatcgggctcaattccaaaaacacatcaatgagttttagctgcattgctataggaatcattaccctgtatttaggcgccgtggttcaggcagacatgggttgtgtcgtgaattggaaggggaaagagctgaagtgcggatccggcatcttcgtgactaacgaggtccacacatggaccgaacagtacaagtttcaagccgattctcccaaacgcctagctactgccattgcaggtgcttgggagaatggcgtttgtgggatcagaagcaccacaaggatggaaaacctcctgtggaagcagatagccaatgagcttaactatatcttgtgggaaaataacattaaactgacggtggtggtaggagacatcattggcgtcctcgagcaggggaagcggaccctgactccacagcctatggagttaaaatactcatggaagacatggggaaaagcgaagatcgtgaccgccgaaacacaaaacagttccttcataattgatggccccaatactccagagtgccccagcgcttctcgcgcatggaacgtttgggaagtggaggactatggttttggggtcttcaccacgaatatctggctgaagcttagagaagtgtacacacagttgtgtgaccataggctcatgtcagccgctgttaaagatgagcgtgccgtgcacgcagacatgggatactggattgagagtcagaagaacggcagctggaaactggaaaaggcgtccctaatcgaggtaaaaacctgcacttggcctaagtctcacaccctgtggtcgaatggtgtcctcgaaagcgatatgataatcccaaagtccctggccggcccgatttcacagcataaccaccggcccgggtatcatacacaaactgctggaccttggcaccttggcaaattggagctggactttaattactgcgaggggaccacagtggtgatcacggaaaactgtggaacccgaggcccaagtttaagaactacaaccgtctctggtaagctcattcacgagtggtgctgtaggagctgcactctgccccctcttcgctatatgggggaagatggatgttggtacggcatggagatccggccaatatccgaaaaagaggagaatatggttaagtcactggtgagcgccggttctggcaaagtagacaacttcacaatgggggtgttgtgcctcgcaattctgtttgaagaggtcatgagaggaaagttcggcaagaaacatatgatcgctggggtgttctttaccttcgttctactgctctccggacagatcacgtggagggatatggcccacactctgaccatgattggcagtaatgcaagcgaccgcatgggtatgggggtgacatatcttgccttgatcgctacctttaagattcagcccttcctggcgttaggatttttcctccgaaaactgacttctcgggaaaaccttctgctaggcgtcggcctcgccatggcaacaaccctgcaattgccggaggatatagaacagatggctaatgggatcgccctgggattaatggccctcaagctgattacacagtttgagacttaccagctttggaccgctctgatctccttgacgtgttcaaacacaatgttcaccctcactgtggcatggcgtaccgccacactgattctagcgggtgttagtctgcttcctgtgtgccaaagctcgtccatgagaaaaactgactggctcccaatggctgtcgccgcaatgggcgtaccccctctgcccttgtttatcttctctctgaaggataccttaaagaggcgcagctggccactcaatgagggggtgatggccgttggactggtgtcaatacttgctagttccctgttgcggaacgacgtccctatggcaggccccctcgtggccggtgggctgctaatcgcgtgttatgtaattacgggaacatctgctgatctgaccgtggaaaaagccgcagacatcacttgggaggaagaggccgaacagacaggcgtcagccataaccttatgattaccgttgacgatgacggcactatgagaatcaaggatgacgagacagagaatatactcaccgtgctgttgaaaacggctttactgattgtgtccggggtctttccatactcaatcccggccactctcctggtgtggcacacctggcagaagcagacacaaaggagcggagttctttgggatgtacctagtcccccagaaacccagaaagcagagctggaagagggtgtgtaccgaatcaagcagcagggcattttcgggaaaacacaagtcggagtgggcgttcagaaggagggtgtgtttcatactatgtggcacgtcacccgcggggctgtgttgacgtataacggaaagcggctagaacccaattgggcctctgtaaaaaaggacctgatatcctacggcggcgggtggagactcagcgcgcagtggcaaaaaggagaggaagtccaggtgatcgccgttgagcctggtaagaacccaaaaaatttccagacaatgcccggcactttccagaccacaaccggggaaattggagcaatcgctctggattttaagcctggcacttcgggttcaccgattatcaacagggaggggaaggtggtcggactttatggcaatggcgtggttaccaaaaacgggggatacgtgtctggtatagcccaaacaaatgctgagccagacggccccacgcctgaattagaggaagagatgttcaagaaacgtaacctgactatcatggatctccacccagggagtggaaagacccgcaaatatttgcccgcaattgtccgggaagccatcaagagaaggctgcgaacactcattctggcccctacccgggtggtagctgcggagatggaggaagcacttaagggcctgccgatccgctaccagactacagccaccaaatccgagcatacgggtagagaaatagtggacttgatgtgccacgctacttttacaatgaggctactgagccccgttcgggtcccaaattataacctcattatcatggatgaggcccatttcaccgaccctgcatctatcgccgctcgagggtacattagcaccagagtgggaatgggcgaagcggccgcaatctttatgactgctacacccccaggcaccgccgatgcattccctcagtccaatgcccccatacaggacgaggagcgcgacattccagaaaggtcatggaacagtgggaatgagtggatcacagattttgctggaaagactgtgtggttcgtcccgagcattaaagccggtaacgacatcgcgaactgtttacgtaagaatggcaaaaaggtaatacaactgtctcggaagacgtttgataccgaataccagaaaacaaagcttaacgactgggatttcgtggttactaccgacatttccgagatgggggcaaattttaaagccgatagagtgatcgaccctaggcgctgcctgaagcccgtcatcctcacagatggaccagagcgagtgattttggctggccccatgcctgttaccgccgcttcagcagcccagagacggggtagggtggggcgcaacccacagaaagaaaatgaccaatatatcttcactggccagcccctgaacaatgatgaggaccacgctcattggacggaagccaagatgctcctggacaacattaatacccctgagggaataatcccggcacttttcgaaccagagcgtgagaagagtgcggccattgatggcgaatacagactaaaaggggagagccggaagacatttgtcgaactgatgaggcgcggagacttgcccgtgtggttagctcacaaagtagcctccgagggtatcaagtatactgatcgaaaatggtgcttcgacggccagagaaacaatcagatcctggaagagaacatggatgtggagatttggaccaaggaaggggagaaaaagaagctccggcctaggtggctggacgcacgcacatactctgatccccttgctctgaaagaatttaaggacttcgccgcaggaagaaaatcgatagccctcgatttggttaccgagatcggcagggtcccaagccacctggctcatcggactcgtaatgcgctagacaacctggtgatgctccacacatcagaacatggtgggcgcgcctatcgacacgcaatggaggagcttcctgaaacgatggagaccctgttattgctgggcctcatgattctgcttactggaggcgctatgctgtttctcatctccgggaagggaattggtaaaacaagtatcggcttgatatgtgtgatcgcctctagcgggatgctgtggatggccgaaattcccttacaatggatcgcatccgctattgtcctagagttctttatgatggttctgctcatcccagagcctgaaaagcagagaaccccgcaggataatcaacttgcctacgtggtaataggaattctgaccttggcggctatcattgccgcaaacgagatgggcctgctcgaaacaactaagagggacctgggtatgtcaaaagagcccggggtggtctctccaacgagctatcttgatgtggacctccaccctgccagtgcttggaccctgtacgcagttgccacaactgtgatcacccccatgttgcggcatacaatagaaaattccaccgcgaacgtcagcctggctgccatcgcaaaccaggccgtagtgttaatgggcctagacaagggatggccaatttctaaaatggatctgggcgttcctctccttgctctggggtgctactcacaggtgaatcccttgactctgacggccgcagtcctcctgcttatcacacactatgctattatcggaccgggcttacaggccaaggcgacccgcgaggcccaaaaaagaactgcagctggtataatgaagaacccaaccgtggacgggattatgacaatcgatctggaccctgtcatgtacgattccaagttcgagaaacagctcggacaggtgatgttgctggttctatgtgccgtgcagctgctccttatgaggactagttgggcactgtgcgaagctttgaccctggccacaggccccatcacgaccctctgggagggtagcccaggcaagttttggaatactacaattgccgtatcgatggcgaacatcttccgggggtcttatctggctggagcaggcttagccttttccataatgaaaagcgtggggaccggaaagcgaggcactggttcacaaggggaaacacttggagagaaatggaagaagaaactgaatcagctcagtagaaaggaattcgacctatacaaaaagtctggcattaccgaggtcgatcgcacggaggctaaagaaggtctgaagaggggcgagatcacccatcacgccgtttcccgggggagcgcaaaattgcagtggtttgtggaacgtaacatggtcattcccgagggaagagtgatcgacctgggctgtgggaggggaggctggtcatattactgcgccggtctcaagaaggtaacagaagtgcgcgggtatactaaaggaggccctggccatgaggagccggttcccatgagtacctacgggtggaatatagtgaagcttatgagcggaaaagatgtcttctacctgccacctgaaaagtgtgacacattgctgtgcgatatcggtgagtcctctcccagccctactgtggaagagtcccggaccattcgagtcctcaaaatggtggagccatggttaaagaacaatcagttctgtatcaaggttctgaacccctatatgcctacagtaattgaacaccttgagagactgcaaaggaaacacggcgggatgctagtgcgcaatccactctcacggaactctacccatgaaatgtactggatcagtaatggaactggcaacattgtcgcttcggtgaatatggttagcagactgttgctgaaccgttttacgatgacacacaggcggcccaccatcgagaaggacgtggatctcggtgcggggactcgccatgtcaacgccgaaccggagacccctaatatggacgtgataggagagcgaattaaaagaatcaaggaagagcacaactccacatggcactatgacgatgaaaatccatacaaaacgtgggcatatcatggctcttacgaggtaaaggctaccggctcagccagctccatgatcaacggggtggttaagcttctgactaaaccctgggacgtcgtgcctatggtgacacagatggcaatgaccgatactacaccattcggacagcaaagggtctttaaggaaaaagttgacacccggacaccccgcagtatgccgggtactagaagggtgatgggcattaccgccgagtggttatggcgaacgctggggcggaataagaaacctcgtttgtgcaccagagaggaattcacaaagaaggtacgcactaacgctgccatgggagcggtgtttaccgaggaaaatcagtgggattctgcaaaagccgctgtcgaggacgaagatttctggaagctcgtggacagggagcgggagctgcacaaactaggcaagtgtggtagctgcgtttataacatgatggggaaaagagaaaagaaacttggagagtttggcaaggccaagggctcacgcgcaatatggtacatgtggctgggggctaggtacctcgaattcgaggccctgggatttttgaatgaggatcattggttctcccgagaaaacagttatagcggtgtggagggcgaagggctgcacaaactcggatacatccttcgggacatttctaagatccccggcggtgctatgtatgccgatgacacagcagggtgggacactagaattaccgaggatgacctgcataatgaagagaaaatcacgcagcagatggatccagagcacaggcaattagcgaacgccatatttaagctgacataccagaataaagtcgtgaaggtacagcgccctacccccactggaacagttatggacatcatttcccgtaaggatcagcggggctcaggccaagtggggacctatggattgaacactttcaccaatatggaagctcagctcatcagacagatggagggtgaaggcgtcctgagcaaagccgacctagagaacccacaccttcccgaaaagaaaattacacagtggctggagacgaagggggtggagaggctcaaacgcatggcaatctcgggagatgactgcgtggtcaagcctatagatgaccgatttgctaacgccctgttggcattaaatgatatgggcaaggttcggaaagacattccacaatggcagccgtctaagggttggcatgattggcagcaggtgcccttctgtagtcaccatttccacgaactgatcatgaaagacgggagaaagctcgtagtgccttgcaggccacaagacgagcttatcggacgcgccagaatttcccagggcgcgggctggagcctgcgggaaaccgcttgtctagggaaagcctacgcacagatgtggtcactgatgtattttcacaggcgtgatctccgattggcctccaacgctatatgctctgccgtccccgtgcattgggttcctactagccgcacaacctggagtatccacgcacatcaccaatggatgactacagaggacatgctgaccgtgtggaatagagtctggattgaagataacccatggatggaggacaagacgcccgtgacaacctgggagaatgtaccttaccttggaaagcgggaagatcagtggtgtggttccctgatcggcctcactagcagggctacctgggcccagaacattccgacagcgatccagcaagttcgctctttaatagggaatgaggaattcctggactacatgccatcaatgaaaagatttcggaaggaggaggaaagtgagggagctatctggtga

SEQ ID NO: 15099 - RNA, 9873 nt, synthetic construct
  misc_feature 1..9873: note = derived and/or modified CDS sequence (opt3) from DENV-3__JX669494__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtacgaatatgtgtaccctaatagcgatggatctcggcgagatgtgcgacgatacagtcacttacaaatgtccacatatcaccgaagttgagccggaagacattgattgctggtgtaacctgacaagtacctgggtgacttatgggacatgcaatcaggctggagagcgccgacgtgacaagagaagcgtagcccttgcaccccacgtgggcatgggtctggataccaggacgcaaacttggatgtccgccgagggggcttggcggcaggtcgaaaaagtggagacctgggcattgcgccatcctggattcacaatcctcgccctgtttctggctcactacattggcacttctctcacccagaaggttgtgatcttcatattactgatgcttgtcacaccatcgatgaccatgagatgtgtgggcgtagggaacagggactttgttgaaggattgtcaggtgccacgtgggtggatgtcgtgctggagcatggcgggtgcgtgactacaatggcgaagaataaacccaccctagacatcgagctccagaagactgaagcaacacaactggccacccttcggaaactgtgtattgagggaaagatcacgaacattaccacagatagccgctgccctactcagggcgaagctgtcttgccagaggaacaggaccagaattatgtttgtaaacacacctacgtggatcgaggttgggggaacggatgcggcctcttcggcaaggggagtctggtaacatgcgccaagtttcaatgtttagagcccatcgagggaaaagtggtccagtatgaaaatctgaagtacactgtgataattaccgttcacacaggtgaccagcatcaggtgggcaacgagacccaaggggtcactgcagaaatcacgcctcaggcttccacaaccgaggccattctcccagaatatggaactcttggcctggagtgctctccgagaaccggtttggacttcaatgagatgatcctactgacaatgaaaaacaaggcgtggatggtgcacaggcagtggtttttcgatctccccctgccttggaccagcggggccactacagaaacgccaacctggaatcggaaagagcttctggtaacttttaagaacgcacatgctaaaaagcaagaagttgtggtcttgggctcccaggagggagccatgcacacagctctcaccggcgccacagaaatccagaattcagggggaactagtattttcgcaggtcacctgaagtgtcgtttaaaaatggacaagctggagctaaaaggcatgagctacgccatgtgcaccaacacgtttgtgctcaagaaagaggtctctgaaacccagcatgggacaatactgatcaaggtggagtaccgcggagaagatgctccctgtaagattcctttctccactgaggacggccaaggtaaagcgcacaacgggagacttatcaccgcaaatccagttgtgacaaagaaagaggaacccgtaaacatagaggccgaaccgcctttcggcgagtcaaatattgtcatcggaatcggcgataacgctttgaagattaattggtataaaaaggggagcagtatcggaaagatgtttgaagccactgcaaggggtgcccggcgaatggctattctgggcgacaccgcctgggatttcgggtctgtgggaggcgttctcaactccctgggtaaaatggtgcatcagatatttgggagcgcatacacggcgcttttctcgggcgtctcttgggtgatgaagatcggaattggcgtactgttgacatggatcgggctcaattccaaaaacacctcaatgagttttagctgcatcgctattggaataatcactctgtatttaggcgccgtggttcaggcagacatgggttgtgtcattaattggaaggggaaagagctgaagtgcggatccggcatcttcgtgacaaacgaggtgcacacctggactgaacagtacaagtttcaagccgattctcccaaacgcctagctaccgccattgcaggtgcttgggagaatggcgtctgtgggatcagaagcacaacgaggatggaaaacctcctgtggaagcagatagccaatgagcttaactatatcttgtgggaaaataacattaaactgaccgttgtggtgggagacatcattggcgtactcgagcaggggaagcggactctgacaccacagcctatggagttaaaatactcatggaagacctggggaaaagcgaagatcgtcacagccgaaactcaaaacagttccttcataattgatggccccaataccccagagtgccccagcgcttctcgcgcatggaacgtgtgggaagttgaggactatggttttggggtgttcacgacaaatatctggctgaagcttagagaagtctacacccagttgtgtgaccataggctcatgtcagccgctgtgaaagatgagcgtgccgttcacgcagacatgggatactggattgagagtcagaagaacggcagctggaaactggaaaaggcgtccctaatcgaggtgaaaacttgcacctggcctaagtctcacacactgtggtcgaatggtgtactcgaaagcgatatgataatcccaaagtccctggccggcccgatttcacagcataaccaccggcccgggtatcatactcaaaccgctggaccttggcaccttggcaaattggagctggactttaattactgcgaggggacaacggtcgtgatcaccgaaaactgtggaactcgaggcccaagtttaagaacaaccactgtgtctggtaagctcattcacgagtggtgctgtaggagctgcacactgccccctcttcgctatatgggggaagatggatgttggtacggcatggagatccggccaatatccgaaaaagaggagaatatggtcaagtcactggttagcgccggttctggcaaagtggacaacttcaccatgggggtattgtgcctcgcaattctgtttgaagaggtgatgagaggaaagttcggcaagaaacatatgatcgctggggtcctattcacgtttgtgctgctcctgtccggacagatcacttggagggatatggcccacacccttattatgatcggcagtaatgcaagcgaccgcatgggtatgggggttacatatttggccctgattgctaccttcaagatacagccctttttagcgctcggattctttctgcgaaaacttacttctcgggaaaacctgctactcggcgtgggcctggccatggcaacaaccttgcaactgccggaggatatcgaacagatggctaatgggattgccttaggactcatggccctgaagcttatcacacagttcgagacttaccagctgtggaccgctttgatttccctcacgtgttcaaacacaatgtttaccctgactgtcgcatggcgtaccgccacactaatcctggcgggtgtgagtcttctccctgtttgccaaagctcgtccatgagaaaaactgactggctgccaatggctgtggccgcaatgggcgtcccccctttgcccctgttcatattttctttaaaggataccctcaagaggcgcagctggccactgaatgagggggtaatggccgtgggacttgtttcaatcctggctagttccttgctccggaacgacgtgcctatggcaggccccctggtcgccggtgggctactgattgcgtgttatgtgatcacgggaacatctgctgatcttaccgtagaaaaagccgcagacattacttgggaggaagaggccgaacagacaggcgtgagccataacctcatgatcaccgtcgacgatgacggcactatgagaataaaggatgacgagacagagaatattctgaccgttttgttaaaaacggctctgctcatcgtgtccggggtgttcccatactcaatcccggccactctgcttgtctggcacacctggcagaagcagacacaaaggagcggagtgctgtgggatgttcctagtcccccagaaacccagaaagcagagttggaagagggtgtataccgaattaagcagcagggcatatttgggaaaacacaagtgggagtcggcgtgcagaaggagggtgttttccatactatgtggcacgtgacccgcggggctgtcctaacgtataacggaaagcggctggaacccaattgggcctctgtgaaaaaggacctcatctcctacggcggcgggtggagactgagcgcgcagtggcaaaaaggagaggaagtacaggtcattgccgtggagcctggtaagaacccaaaaaattttcagacaatgcccggcactttccagaccacaaccggggaaatcggagcaattgctcttgatttcaagcctggcacttcgggttcaccgatcataaacagggaggggaaggttgtgggattatatggcaatggcgtcgtgaccaaaaacgggggatacgtttctggtatcgcccaaacaaatgctgagccagacggccccacgcctgaactggaggaagagatgtttaagaaacgtaacctcactattatggatttgcacccagggagtggaaagacccgcaaatatctgcccgcaatcgtgcgggaagccattaagagaaggctccgaacactgatccttgcccctacccgggtcgtggctgcggagatggaggaagcactgaagggcttgccgatacgctaccagactacagccaccaaatccgagcatacgggtagagaaattgtagacctaatgtgccacgctactttcacaatgaggctgctcagccccgtgcgggttccaaattataacttaatcatcatggatgaggcccattttaccgaccctgcatctattgccgctcgagggtacatcagcaccagagtcggaatgggcgaagcggccgcaatattcatgactgctacacccccaggcaccgccgatgcatttcctcagtccaatgcccccattcaggacgaggagcgcgacatcccagaaaggtcatggaacagtgggaatgagtggattacagatttcgctggaaagactgtgtggtttgtgccgagcatcaaagccggtaacgacatagcgaactgtctgcgtaagaatggcaaaaaggtcattcaactttctcggaagacgttcgataccgaataccagaaaacaaagctgaacgactgggattttgtagtgactaccgacatctccgagatgggggcaaatttcaaagccgatagagttatcgaccctaggcgctgcctcaagcccgtgattttgacagatggaccagagcgagtcatcctggctggccccatgcctgtgaccgccgcttcagcagcccagagacggggtagggttgggcgcaacccacagaaagaaaatgaccaatatatttttactggccagcccctcaacaatgatgaggaccacgctcattggacggaagccaagatgctgcttgacaacataaatacccctgagggaatcattccggcactattcgaaccagagcgtgagaagagtgcggccatcgatggcgaatacagactgaaaggggagagccggaagacattcgtggaattgatgaggcgcggagacttacccgtctggctggctcacaaagtggcctccgagggtatcaagtatactgatcgaaaatggtgctttgacggccagagaaacaatcagattctcgaagagaacatggatgtagagatatggaccaaggaaggggagaaaaagaagctgcggcctaggtggcttgacgcacgcacatactctgatcccctggctctcaaagaattcaaggactttgccgcaggaagaaaatcgatcgccttggatctggtgaccgagattggcagggttccaagccacctagctcatcggactcgtaatgcgctggacaacctcgtcatgcttcacacatcagaacatggtgggcgcgcctatcgacacgcagtggaggagctgcctgaaacgatggagaccttattgctgctcggcctgatgatccttctgactggaggcgctatgctcttcttgatttccgggaagggaatcggtaaaacaagtataggcctgatctgtgtgattgcctctagcgggatgttatggatggccgaaatccccctacaatggattgcatccgctatcgtcctggagtttttcatgatggttctccttataccagagcctgaaaagcagagaaccccgcaggataatcaactggcctacgtggtaattggaatcttgaccctggcggctattatcgccgcaaacgagatgggcctcctggaaacaactaagagggaccttggtatgtcaaaagagcccggggtggtctctccaacgagctatctcgatgtggacctgcaccctgccagtgcttggaccttgtacgcagttgccacaactgtgataacccccatgctgcggcatacaatcgaaaattccaccgcgaacgtcagcttagctgccattgcaaaccaggccgtagtgctaatgggcctggacaagggatggccaatctctaaaatggatctcggcgttcctcttctggctttggggtgctactcacaggtgaatcccctgactctcacggccgcagtcctgcttttaattacacactatgctatcataggaccgggcctgcaggccaaggcgacccgcgaggcccaaaaaagaactgcagctggtattatgaagaacccaaccgtggacgggatcatgacaatcgatctcgaccctgtcatttacgattccaagtttgagaaacagttgggacaggtgatgctgctagttctgtgtgccgtgcagctccttctgatgaggactagttgggcattgtgcgaagctctgaccctcgccacaggccccatcacgaccctgtgggagggtagcccaggcaagttctggaatactacaatagccgtatcgatggcgaacatttttcgggggtcttatttagctggagcaggccttgccttctccatcatgaaaagcgtggggaccggaaagcgaggcactggttcacaaggggaaacactgggagagaaatggaagaagaaactcaatcagctaagtagaaaggaatttgacctgtacaaaaagtctggcattaccgaggtcgatcgcacggaggctaaagaaggtttgaagaggggcgagatcacccatcacgccgtttcccgggggagcgcaaaactgcagtggttcgtggaacgtaacatggtcatacccgagggaagagtgatcgacctcggctgtgggaggggaggctggtcatattactgcgccggtcttaagaaggtaacagaagtgcgcgggtatactaaaggaggccctggccatgaggagccggttcccatgagtacctacgggtggaatattgtgaagctgatgagcggaaaagatgtcttttacttgccacctgaaaagtgtgacacactgctctgcgatatcggtgagtcctctcccagccctactgtggaagagtcccggaccattcgagtcttaaaaatggtggagccatggctgaagaacaatcagttctgtatcaaggttcttaacccctatatgcctacagtaattgaacacctggagagactacaaaggaaacacggcgggatgctcgtgcgcaatccactgtcacggaactctacccatgaaatgtactggatcagtaatggaactggcaacatagtcgcttcggtgaatacggttagcagattgctgctcaaccgtttcacaatgacccacaggcggcccactaccgagaaggacgtggatcttggtgcggggacacgccatgtcaacgccgaaccggagacgcctaatatggacgtgattggagagcgaatcaaaagaatcaaggaagagcacaactccacctggcactatgacgatgaaaatccatacaaaacttgggcatatcatggctcttacgaggtaaaggctacaggctcagccagctccatgattaacggggtggttaagctgttaaccaaaccctgggacgtcgtgcctatggtgactcagatggcaatgacagataccacaccatttggacagcaaagggtcttcaaggaaaaagttgacactcggaccccccgcagtatgccgggtacgagaagggtgatgggcataaccgccgagtggctgtggcgaacattggggcggaataagaaacctcgtctctgcactagagaggaatttaccaagaaggtacgcacaaacgctgccatgggagcggtgttcactgaggaaaatcagtgggattctgcaaaagccgctgtcgaggacgaagatttttggaagctggtggacagggagcgggagctacacaaacttggcaagtgtggtagctgcgtttataacatgatggggaaaagagaaaagaaactgggagagttcggcaaggccaagggctcacgcgcaatctggtacatgtggctcggggctaggtacctggaatttgaggccttgggattcctgaatgaggatcattggttttcccgagaaaacagttatagcggtgtggagggcgaagggctccacaaacttggatacattctgcgggacatctctaagattcccggcggtgctatgtatgccgatgacaccgcagggtgggacacgagaatcacagaggatgacttacataatgaagagaaaataacccagcagatggatccagagcacaggcaactggcgaacgccatcttcaagttgacttaccagaataaagtcgtgaaggtacagcgccctacacccaccggaactgttatggacattatctcccgtaaggatcagcggggctcaggccaagtggggacctatggactcaacacatttacgaatatggaagctcagctgattagacagatggagggtgaaggcgtcctaagcaaagccgaccttgagaacccacacctgcccgaaaagaaaatcacccagtggctcgagactaagggggtggagaggctgaaacgcatggcaatatcgggagatgactgcgtggtcaagcctattgatgaccgattcgctaacgccttgttagcactgaatgatatgggcaaggttcggaaagacatcccacaatggcagccgtctaagggttggcatgattggcagcaggtgcccttttgtagtcaccatttccacgaactcatcatgaaagacgggagaaagcttgtagtgccttgcaggccacaagacgagctgattggacgcgccagaatatcccagggcgcgggctggagcctacgggaaacagcttgtctggggaaagcctacgcacagatgtggtcactcatgtatttccacaggcgtgatttgcgactggcctccaacgctatctgctctgccgtccccgtgcattgggttcctaccagccgcactacatggagtattcacgcacatcaccaatggatgaccacggaggacatgcttacagtgtggaatagagtctggatcgaagataacccatggatggaggacaagacccccgtgactacctgggagaatgtaccttacctgggaaagcgggaagatcagtggtgtggttccctcattggcttaacaagcagggctacttgggcccagaacatcccgaccgcgatacagcaagttcgctctctgatcgggaatgaggaatttttggactacatgccatcaatgaaaagattccggaaggaggaggaaagtgagggagctatttggtga

SEQ ID NO: 15100 - RNA, 9873 nt, synthetic construct
  misc_feature 1..9873: note = derived and/or modified CDS sequence (opt3) from DENV-3__JX669503__SS-prME
  source 1..9873: mol_type = other RNA
accagcttctgcctgatgatgatcctccccgcagctcttgcatttcacctgacttccagagacggcgaacctaggatgattgtggggaagaacgaacggggaaagtctttgttattcaagactgcctcaggtataaatatgtgtacgctgatcgcgatggatctcggcgaaatgtgcgacgataccgtcacctacaaatgtccacatattactgaagttgagccggaagacatcgattgctggtgtaacctcaccagtacatgggtgacctatgggacttgcaatcaggctggagagcgccgacgtgacaagagaagcgtagccctggcaccccacgtgggcatgggtcttgatacaaggacccagacgtggatgtccgccgagggggcttggcggcaggtcgaaaaagtggagacttgggcactgcgccatcctggatttaccattttggccctcttcctggctcactacatcggcacatctctgactcagaaggttgtgatatttatcctcttaatgctggtcaccccatcgatgacaatgagatgtgtgggcgtagggaacagggacttcgttgaaggactttcaggtgccacctgggtggatgtcgtgttggagcatggcgggtgcgtgacgactatggcgaagaataaacccacactggacattgagttgcagaagaccgaagcaactcaactcgccacactgcggaaactttgtatcgagggaaagattaccaacatcacgaccgatagccgctgccctacacagggcgaagctgtcctgccagaggaacaggaccagaattatgtttgtaaacacacttacgtggatcgaggttgggggaacggatgcggcttgtttggcaaggggagtctcgtaacctgcgccaagttccaatgtctggagcccatagagggaaaagtggtccagtatgaaaatttaaagtacacagtgattatcactgttcacaccggtgaccagcatcaggtgggcaacgagacacaaggggtcaccgcagaaattactcctcaggcttccacgacagaggccatcctgccagaatatggaaccctcggccttgagtgctctccgagaactggtctggactttaatgagatgatcttgctaaccatgaaaaacaaggcgtggatggtgcacaggcagtggttctttgatctgcccctcccttggacaagcggggccaccactgaaacaccaacgtggaatcggaaagagctgcttgtaaccttcaagaacgcacatgctaaaaagcaagaagttgtggtcctgggctcccaggagggagccatgcacactgctttgacaggcgccaccgaaattcaaaattcagggggaacaagtatatttgcaggtcacctcaagtgtcgtctgaaaatggacaagttagagctgaaaggcatgagctacgccatgtgcactaacaccttcgtgctaaagaaagaggtctctgaaacgcagcatgggaccatcctcattaaggtggagtacaagggagaagatgctccctgtaaaatccctttctccacagaggacggccaaggtaaggcgcacaacgggcgcctgataactgcaaatccagttgtgaccaaaaaggaggaacccgtaaacattgaggccgaaccgccttttggcgagtcaaatatcgtcatcggaattggcgataacgctcttaaaatcaattggtataagaaggggagcagtattggaaaaatgttcgaagccacagcaagaggtgccaggcggatggctatattgggcgacactgcctgggattttgggtctgtgggaggcgttctgaactccctcggtaagatggtgcatcagatcttcgggagcgcatacaccgcgctgttttcgggcgtctcttgggtgatgaaaattggaatcggcgtacttctgacgtggatcgggctaaattccaagaacacatcaatgagtttcagctgcattgctataggaatcattaccctctatctgggcgccgtggttcaggcagacatgggttgtgtcatcaattggaaagggaaggagttaaagtgcggatccggcatttttgtgactaacgaggtgcacacatggaccgaacagtacaaattccaagccgattctcccaagcgactggctactgccatcgccggtgcttgggagaatggcgtctgtgggatacgcagcaccacaagaatggaaaacctactctggaaacagatcgccaatgagctgaactatattctttgggaaaataacatcaagttgacggttgtggtgggagacattatcggcgtactggagcaggggaaaaggaccctcactccacagcctatggagctgaagtactcatggaaaacatggggaaaggcgaagatagtcaccgccgaaacacaaaacagttcctttattatcgatggccccaatactccagagtgccccagcgcttctcgggcatggaacgtgtgggaagttgaggactatggtttcggggtgtttaccacgaatatttggttaaaactgcgcgaagtctacacacagctttgtgaccatagattgatgtcagccgctgtgaaggatgagagggccgttcacgcagacatgggatactggatcgagagtcagaaaaacggcagctggaagctcgaaaaagcgtccctgatagaggtgaagacctgcacttggcctaagtctcacaccctatggtcgaatggtgtactggaaagcgatatgatcattccaaaatccctcgccggcccgatctcacagcataaccaccgtcccgggtatcatacacaaactgctggaccttggcacctgggcaaacttgagttggacttcaattactgcgaggggaccacagtcgtgattacggaaaactgtggaacccggggcccaagtctgcgaactacaaccgtgtctggtaaattaatccacgagtggtgctgtagaagctgcactctaccccctctgaggtatatgggggaagatggatgttggtacggcatggagatacgcccaatttccgaaaaggaggagaatatggtcaaatcacttgttagcgccggttctggcaaggtggacaactttacaatgggggtactgtgcttggcaatcctcttcgaagaggtgatgcggggaaagttcggcaaaaagcatatgatcgctggggtctttttcacctttgtgctgctactgtccggacagattacgtggagagatatggcccacactctcatcatgattggcagtaatgcaagcgacaggatgggtatgggggttacctatctggcccttatagctacattcaaaatccagccctttttggcgctgggattctttttacgcaagctcacctctcgagaaaacctgcttctgggcgtgggcctagccatggcaactacactccaactgccggaggatattgaacagatggctaatgggatcgccttgggactgatggccttaaaactcattacccagttcgagacataccagctgtggactgctcttatctccctgacctgttcaaacacgatgtttacattgaccgtcgcatggcggactgccaccctcatactggcgggtgtgagtctactgcctgtttgccaaagctcgtccatgcgtaagacagactggcttccaatggctgtggccgcaatgggcgtaccccctctccccctgttcatcttttctttgaaggatactctgaaaagaaggagctggccattaaatgagggggtaatggccgtgggactcgtttcaattctggctagttcccttctgcgcaacgacgtgcctatggcaggccccttggtcgccggtgggctcctgatcgcgtgttatgtgattaccggaacgtctgctgatctaacagtagaaaaggccgcagacatcacctgggaggaagaggccgaacagactggcgtgagccataacctgatgataacagtcgacgatgacggcaccatgcggattaaagatgacgagactgagaatatccttacagttctcctgaagaccgctttgttaatcgtgtccggggtgttcccatactcaattccggccacgctgctcgtctggcacacttggcagaaacagacccaaagaagcggagtgctgtgggatgttcctagtcccccagaaacacagaaggcagagcttgaagagggtgtatacaggataaaacagcagggcatctttgggaagacccaagtgggagtcggcgtgcagaaggagggtgttttccatacaatgtggcacgtgactcgaggggctgtcctgacctataacggaaaacgcttggaacccaattgggcctctgtgaagaaagacctaatttcctacggcggcgggtggcggctgagcgcgcagtggcaaaagggagaggaagtacaggtcatcgccgtggagcctggtaaaaacccaaagaatttccagacgatgcccggcacatttcagactaccacaggggaaattggagcaatcgctctcgatttcaagcctggcacctcgggttcaccgataatcaacagagaggggaaagttgtgggactgtatggcaatggcgtcgtgactaagaacgggggatacgtttctggtattgcccaaaccaatgctgagccagacggccccacacctgaacttgaggaagagatgtttaaaaagaggaacttaacgatcatggatctgcacccagggagtggaaaaactcgtaagtatctccccgcaattgtgcgcgaagccatcaagcggagattgaggaccctgatactcgcccctacacgagtcgtggctgcggagatggaggaagcactgaaaggccttccgattcggtaccagaccactgccacaaagtccgagcataccggtcgcgaaatcgtagacctgatgtgccacgctacgttcactatgagattgctaagccccgtgagggttccaaattataacctgatcattatggatgaggcccattttacagaccctgcatctatcgccgctcgggggtacataagcacccgagtcggaatgggcgaagcggccgcaattttcatgaccgctactcccccaggcacagccgatgcatttcctcagtccaatgcccccatccaggacgaggagagagacattccagaacgctcatggaacagtgggaatgagtggatcaccgatttcgctggaaaaacagtgtggtttgtgccgagcataaaggccggtaacgacattgcgaactgtctcaggaaaaatggcaagaaggtcatccaattatctcgtaaaactttcgatacggaataccagaagaccaaactgaacgactgggattttgtagtgacaactgacatctccgagatgggggcaaatttcaaggccgatcgggttattgaccctagaaggtgccttaaacccgtgatcctgaccgatggaccagagcgcgtcgtgctcgctggccccatgcctgttacagccgcttcagcagcccagcgaagaggtcgggtggggaggaacccacagaaggaaaatgaccaatatattttcaccggccagcccttgaacaatgatgaggaccacgctcattggactgaagccaagatgctgctcgacaacataaatacgcctgagggaatcattccggcactgtttgaaccagagcgcgagaaaagtgcggccatcgatggcgaataccgtcttaagggggagagcagaaaaaccttcgtcgaactaatgcggaggggagacctgcccgtgtggttggctcacaaggtagcctccgagggtatcaaatatacagatcgcaagtggtgctttgacggccagcgaaacaatcagattttagaagagaacatggatgtggagatatggactaaagaaggggagaagaagaaactgagacctcggtggctcgacgcaaggacctactctgatcccctggctcttaaggagttcaaagactttgccgcaggacgcaagtcgatcgccctggatctcgttacagagattggcagagtcccaagccacttggctcataggacccggaatgcgctggacaacctagtgatgctgcacacttcagaacatggtgggcgtgcctatcgccacgcagtggaggagctccctgaaacaatggagacgcttctgttattgggcctgatgatcctcctgaccggaggcgctatgcttttcctgatttccgggaaaggaatcggtaagacaagtataggcctcatctgtgtcattgcctctagcgggatgttgtggatggccgaaatccccctgcaatggattgcatccgctatcgttttagagtttttcatgatggtgctactgataccagagcctgaaaagcagcgaacaccgcaggataatcaactcgcctacgtagtgattggaatccttaccctggcggctattatcgccgcaaacgagatgggcttgctggaaaccacaaaaagagacctcggtatgtcaaaggagcccggggtcgtgtctccaactagctatctggatgttgaccttcaccctgccagtgcttggacgctctacgcagtggccaccacagtcataactcccatgctgaggcataccatcgaaaattccacagcgaacgtcagcttggctgccattgcaaaccaggccgtggttctgatgggcttagacaaaggatggccaatctctaagatggatctaggcgtgcctctgctcgctcttgggtgctactcacaggtcaatcccctgaccttgactgccgcagtgctgctcctgattacgcactatgctatcataggaccgggccttcaggccaaagcgacacgggaggcccaaaagcgcaccgcagctggtattatgaagaacccaactgtcgacgggatcatgaccatcgatttagaccctgtgatttacgattccaaatttgagaagcagctgggacaggttatgctcttggtgctgtgtgccgtacagctactgctcatgagaacaagttgggcactttgcgaagctctgactttggccaccggccccatcacaacgctgtgggagggtagcccaggcaaattctggaataccactatagccgtgtcgatggcgaacatttttagggggtcttatctcgctggagcaggcctggccttctccatcatgaaaagcgtcgggacaggaaaacggggcaccggttcacaaggggaaactttaggagagaagtggaagaagaaacttaatcagctgagtcgaaaagaatttgacctctacaagaaatctggcattacagaggttgatagaaccgaggctaaagaaggtctaaaacgcggcgagatcacgcatcacgccgtgtccagggggagcgcaaagctgcagtggttcgtcgaacggaacatggtgatacccgagggacgtgtaatcgacttgggctgtgggagaggaggctggtcatattactgcgccggtctgaagaaagtgaccgaagttagggggtatacaaagggaggccctggccatgaggagccggtgcccatgagtacttacgggtggaatattgtcaaactcatgagcggaaaggatgtgttctaccttccacctgaaaaatgtgacaccctgttgtgcgatatcggtgagtcctctcccagccctacagtcgaagagtcccgcactattcgggtgctgaagatggttgagccatggctcaagaacaatcagttttgtatcaaagtattaaacccctatatgcctaccgtgattgaacacctggagcgacttcaaagaaagcacggcgggatgctggtcaggaatccactatcacgcaactctacacatgaaatgtactggatcagtaatggaaccggcaacatagtggcttcggttaatatggtgagccggctcctgttgaacagattcactatgacgcaccgtaggcccacaattgagaaagacgtcgatctgggtgcggggacccggcatgtgaacgccgaaccggagactcctaatatggacgtaatcggagagcgcatcaagcgaattaaagaagaacacaactccacctggcactatgacgatgaaaatccatacaagacatgggcatatcatggctcttacgaggtgaaggctacgggctcagccagctccatgataaacggggttgtcaaactccttaccaagccctgggacgtggtgcctatggtcactcagatggcaatgacagataccactccatttggacagcaaagagttttcaaagaaaaggtggacacaaggacaccccggagtatgccgggtacacgcagagtaatgggcatcactgccgagtggctgtggaggaccttagggcgaaataaaaagcctcggctgtgcacgcgtgaggaatttaccaagaaagtgagaacaaacgctgccatgggagcggtcttcactgaggaaaatcagtgggattctgcaaaggccgctgtggaggacgaagatttttggaaattggttgaccgcgagagggagctccacaagctgggcaaatgtggtagctgcgtgtataacatgatggggaagcgggagaagaagctaggagagttcggcaaggccaaaggctcaagagcaatttggtacatgtggcttggggctcgctacctggaatttgaggccctcggattcctgaatgaggatcattggttttccagggaaaacagttatagcggtgtcgagggcgaagggttgcacaagctgggatacatcctccgagacatttctaaaatccccggcggtgctatgtatgccgatgacaccgcagggtgggacacacggataactgaggatgaccttcataatgaagagaagatcacccagcagatggatccagagcacagacaactggcgaacgccattttcaaattaacgtaccagaataaggtggtaaaggttcagaggcctacacccaccggaactgtgatggacatcatttcccgcaaagatcagcgtggctcaggccaagtcgggacatatggactgaacacctttactaatatggaagctcagttgatccggcagatggagggtgaaggcgtgctcagcaaggccgacctggagaacccacacctacccgagaagaagataacccagtggcttgagacaaaaggggtggagagactgaagaggatggcaatttcgggagatgactgcgtcgttaagcctatcgatgaccgcttcgctaacgccctcctggcattgaatgatatgggcaaagtgcgaaaggacatcccacaatggcagccgtctaaaggttggcatgattggcagcaggtacccttctgtagtcaccattttcacgaattaattatgaaggacgggcggaaactggtggtcccttgcagaccacaagacgagctcataggaagggcccgcatctcccagggcgcgggctggagccttagagaaacggcttgtctggggaaggcctacgcacagatgtggtcactaatgtatttccaccggagggatctgcgtctcgcctccaacgctatttgctctgccgtgcccgttcattgggtgcctaccagccgaactacatggagtatccacgcacatcaccaatggatgaccactgaggacatgttgacagtctggaatcgcgtgtggattgaagataacccatggatggaggacaagacccccgtaacgacatgggagaatgttccttacctgggaaaaagagaagatcagtggtgtggttcccttatcggcctgaccagccgggctacttgggcccagaacataccgaccgcgatccagcaagtgaggtctctcattgggaatgaggaatttttagactacatgccatcaatgaagcgcttcagaaaagaggaggaaagtgagggagctatctggtga

SEQ ID NO: 15101 - RNA, 9873 nt, synthetic construct
  misc_feature 1..9873: note = derived and/or modified CDS sequence (opt3) from DENV-3__JX669493__SS-prME
  source 1..9873: mol_type = other RNA
accagcttctgcctgatgatgatcctccccgcagctcttgcatttcacctgacttccagagacggcgaacctaggatgattgtggggaagaacgaacggggaaagtctttgttattcaagactgcctcaggtattaatatgtgtacgctgatcgcgatggatctcggcgaaatgtgcgacgataccgtcacctacaaatgtccacatattactgaagttgagccggaagacatcgattgctggtgtaacctcaccagtacatgggtgacctatgggacttgcaatcaggctggagagcgccgacgtgacaagagaagcgtcgccctggcaccccacgtgggcatgggtcttgatacaaggacccagacgtggatgtccgccgagggggcttggcggcaggtcgaaaaagtggagacttgggcactgcgccatcctggatttaccattttggccctcttcctggctcactacatcggcacatctctgactcagaaggttgtgatatttatcctcttaatgctggtcaccccatcgatgacaatgagatgtgtgggcgtagggaacagggacttcgttgaaggactttcaggtgccacctgggtggatgtcgtgttggagcatggcgggtgcgtgacgactatggcgaagaataaacccacactggacattgagttgcagaagaccgaagcaactcagctcgccacactgcggaaactttgtatcgagggaaagattaccaacatcacgaccgatagccgctgccctacacagggcgaagctgtcctgccagaggaacaggaccagaattatgtttgtaaacacacttacgtggatcgaggttgggggaacggatgcggcttgtttggcaaggggagtctcgtaacctgcgccaagttccaatgtctggagcccatagagggaaaagtggtccagtatgaaaatttaaagtacacagtgattatcactgttcacaccggtgaccagcatcaggtgggcaacgagacacaaggggtcaccgcagaaattactcctcaggcttccacgacagaggccatcctgccagaatatggaaccctcggccttgagtgctctccgagaactggtctggactttaatgagatgatcttgctaaccatgaaaaacaaggcgtggatggtgcacaggcagtggttctttgatctgcccctcccttggacaagcggggccaccactgaaacaccaacgtggaatcggaaagagctgcttgtaaccttcaagaacgcacatgctaaaaagcaagaagttgtggtcctgggctcccaggagggagccatgcacactgctttgacaggcgccaccgaaattcaaaattcagggggaacaagtatatttgcaggtcacctcaagtgtcgtctgaaaatggacaagttagagctgaaaggcatgagctacgccatgtgcactaacaccttcgtgctaaagaaagaggtctctgaaacgcagcatgggaccatcctcattaaggtggagtacaagggagaagatgctccctgtaaaatccctttctccacagaggacggccaaggtaaggcgcacaacgggcgcctgataactgcaaatccagttgtgaccaaaaaggaggaacccgtaaacattgaggccgaaccgccttttggcgagtcaaatatcgtcatcggaattggcgataacgctcttaaaatcaattggtataagaaggggagcagtattggaaaaatgttcgaagccacagcaagaggtgccaggcggatggctatattgggcgacactgcctgggattttgggtctgtgggaggcgttctgaactccctcggtaagatggtgcatcagatcttcgggagcgcatacaccgcgctgttttcgggcgtctcttgggtgatgaaaattggaatcggcgtacttctgacgtggatcgggctaaattccaagaacacatcaatgagtttcagctgcattgctataggaatcattaccctctatctgggcgccgtggttcaggcagacatgggttgtgtcatcaattggaaagggaaggagttaaagtgcggatccggcatttttgtgactaacgaggtgcacacatggaccgaacagtacaaattccaagccgattctcccaagcgactggctactgccatcgccggtgcttgggagaatggcgtctgtgggatacgcagcaccacaagaatggaaaacctactctggaaacagatcgccaatgagctgaactatattctttgggaaaataacatcaagttgacggttgtggtgggagacattatcggcgtactggagcaggggaaaaggaccctcactccacagcctatggagctgaagtactcatggaaaacatggggaaaggcgaagatagtcaccgccgaaacacaaaacagttcctttattatcgatggccccaatactccagagtgccccagcgcttctcgggcatggaacgtgtgggaagttgaggactatggtttcggggtgtttaccacgaatatttggttaaaactgcgcgaagtctacacacagctttgtgaccatagattgatgtcagccgctgtgaaggatgagagggccgttcacgcagacatgggatactggatcgagagtcagaaaaacggcagctggaagctcgaaaaagcgtccctgatagaggtgaagacctgcacttggcctaagtctcacaccctatggtcgaatggtgtactggaaagcgatatgatcattccaaaatccctcgccggcccgatctcacagcataaccaccgtcccgggtatcatacacaaactgctggaccttggcacctgggcaaacttgagttggacttcaattactgcgaggggaccacagtcgtgattacggaaaactgtggaacccggggcccaagtctgcgaactacaaccgtgtctggtaaattaatccacgagtggtgctgtagaagctgcactctaccccctctgaggtatataggggaagatggatgttggtacggcatggagattcgcccaatctccgaaaaggaggagaatatggtcaaatcacttgttagcgccggttctggcaaggtggacaactttacaatgggggtactgtgcttggcaatcctcttcgaagaggtgatgcggggaaagttcggcaaaaagcatatgattgctggggtctttttcacctttgtgctgctactgtccggacagatcacgtggagagatatggcccacactctcattatgataggcagtaatgcaagcgacaggatgggtatgggggttacctatctggcccttatcgctacattcaaaattcagccctttttggcgctgggattctttttacgcaagctcacctctcgagaaaacctgcttctgggcgtgggcctagccatggcaactacactccaactgccggaggatatcgaacagatggctaatgggattgccttgggactgatggccttaaaactcatcacccagttcgagacataccagctgtggactgctcttatatccctgacctgttcaaacacgatgtttacattgaccgtcgcatggcggactgccaccctcatcctggcgggtgtgagtctactgcctgtttgccaaagctcgtccatgcgtaagacagactggcttccaatggctgtggccgcaatgggcgtaccccctctccccctgttcatattttctttgaaggatactctgaaaagaaggagctggccattaaatgagggggtaatggccgtgggactcgtttcaatcctggctagttcccttctgcgcaacgacgtgcctatggcaggccccttggtcgccggtgggctcctgattgcgtgttatgtgatcaccggaacgtctgctgatctaacagtagaaaaggccgcagacataacctgggaggaagaggccgaacagactggcgtgagccataacctgatgattacagtcgacgatgacggcaccatgcggatcaaagatgacgagactgagaatatccttacagttctcctgaagaccgctttgttaattgtgtccggggtgttcccatactcaataccggccacgctgctcgtctggcacacttggcagaaacagacccaaagaagcggagtgctgtgggatgttcctagtcccccagaaacacagaaggcagagcttgaagagggtgtatacaggatcaaacagcagggcatttttgggaagacccaagtgggagtcggcgtgcagaaggagggtgttttccatacaatgtggcacgtgactcgaggggctgtcctgacctataacggaaaacgcttggaacccaattgggcctctgtgaagaaagacctaatctcctacggcggcgggtggcggctgagcgcgcagtggcaaaagggagaggaagtacaggtcattgccgtggagcctggtaaaaacccaaagaatttccagacgatgcccggcacatttcagactaccacaggggaaatcggagcaatagctctcgatttcaagcctggcacctcgggttcaccgatcattaacagagaggggaaagttgtgggactgtatggcaatggcgtcgtgactaagaacgggggatacgtttctggtatcgcccaaaccaatgctgagccagacggccccacacctgaacttgaggaagagatgtttaaaaagaggaacttaacgattatggatctgcacccagggagtggaaaaactcgtaagtatctccccgcaatcgtgcgcgaagccataaagcggagattgaggaccctgattctcgcccctacacgagtcgtggctgcggagatggaggaagcactgaaaggccttccgatccggtaccagaccactgccacaaagtccgagcataccggtcgcgaaatcgtagacctgatgtgccacgctacgttcactatgagattgctaagccccgtgagggttccaaattataacctgattatcatggatgaggcccattttacagaccctgcatctatagccgctcgggggtacattagcacccgagtcggaatgggcgaagcggccgcaatcttcatgaccgctactcccccaggcacagccgatgcatttcctcagtccaatgcccccattcaggacgaggagagagacatcccagaacgctcatggaacagtgggaatgagtggataaccgatttcgctggaaaaacagtgtggtttgtgccgagcattaaggccggtaacgacatcgcgaactgtctcaggaaaaatggcaagaaggtcatccaattatctcgtaaaactttcgatacggaataccagaagaccaaactgaacgactgggattttgtagtgacaactgacatttccgagatgggggcaaatttcaaggccgatcgggttatcgaccctagaaggtgccttaaacccgtgattctgaccgatggaccagagcgcgtcatactcgctggccccatgcctgtgacagccgcttcagcagcccagcgaagaggtcgggttgggaggaacccacagaaggaaaatgaccaatatatcttcaccggccagcccttgaacaatgatgaggaccacgctcattggactgaagccaagatgctgctcgacaacattaatacgcctgagggaatcatcccggcactgtttgaaccagagcgcgagaaaagtgcggccattgatggcgaataccgtcttaagggggagagcagaaaaaccttcgtggaactaatgcggaggggagacctgcccgtctggttggctcacaaggtggcctccgagggtataaaatatacagatcgcaagtggtgctttgacggccagcgaaacaatcagatcttagaagagaacatggatgtagagatttggactaaagaaggggagaagaagaaactgagacctcggtggctcgacgcaaggacctactctgatcccctggctcttaaggagttcaaagactttgccgcaggacgcaagtcgatcgccctggatctcgtgacagagattggcagagttccaagccacttggctcataggacccggaatgcgctggacaacctagtcatgctgcacacttcagaacatggtgggcgtgcctatcgccacgcagtggaggagctccctgaaacaatggagacgcttctgttattgggcctgatgatcctcctgaccggaggcgctatgcttttcctgatatccgggaaaggaatcggtaagacaagtattggcctcatctgtgtgattgcctctagcgggatgttgtggatggccgaaatccccctgcaatggatagcatccgctattgtcttagagtttttcatgatggttctactgatcccagagcctgaaaagcagcgaacaccgcaggataatcaactcgcctacgtggtaattggaatccttaccctggcggctataatcgccgcaaacgagatgggcttgctggaaaccacaaaaagagacctcggtatgtcaaaggagcccggggtggtctctccaactagctatctggatgtggaccttcaccctgccagtgcttggacgctctacgcagttgccaccacagtgattactcccatgctgaggcataccatcgaaaattccacagcgaacgtcagcttggctgccattgcaaaccaggccgtagtgctgatgggcttagacaaaggatggccaatctctaagatggatctaggcgttcctctgctcgctcttgggtgctactcacaggtgaatcccctgaccttgactgccgcagtcctgctcctgataacgcactatgctattatcggaccgggccttcaggccaaagcgacacgggaggcccaaaagcgcaccgcagctggtatcatgaagaacccaactgtggacgggattatgaccatcgatttagaccctgtcatatacgattccaaatttgagaagcagctgggacaggtgatgctcttggttctgtgtgccgtgcagctactgctcatgagaacaagttgggcactttgcgaagctctgactttggccaccggccccattacaacgctgtgggagggtagcccaggcaaattctggaataccactatcgccgtatcgatggcgaacatttttagggggtcttatctcgctggagcaggcctggccttctccatcatgaaaagcgtggggacaggaaaacggggcaccggttcacaaggggaaactttaggagagaagtggaagaagaaacttaatcagctgagtcgaaaagaatttgacctctacaagaaatctggcataacagaggtcgatagaaccgaggctaaagaaggtctaaaacgcggcgagatcacgcatcacgccgtttccagggggagcgcaaagctgcagtggttcgtggaacggaacatggtcattcccgagggacgtgtgatcgacttgggctgtgggagaggaggctggtcatattactgcgccggtctgaagaaagtaaccgaagtgagggggtatacaaagggaggccctggccatgaggagccggttcccatgagtacttacgggtggaatattgtgaaactcatgagcggaaaggatgtcttctaccttccacctgaaaaatgtgacaccctgttgtgcgatatcggtgagtcctctcccagccctacagtggaagagtcccgcactattcgggtcctgaagatggtggagccatggctcaagaacaatcagttttgtatcaaagttttaaacccctatatgcctaccgtaatagaacacctggagcgacttcaaagaaagcacggcgggatgctggtgaggaatccactatcacgcaactctacacatgaaatgtactggattagtaatggaaccggcaacatcgtcgcttcggtgaatatggttagccggctcctgttgaacagattcactatgacgcaccgtaggcccacaatcgagaaagacgtggatctgggtgcggggacccggcatgtcaacgccgaaccggagactcctaatatggacgtgattggagagcgcataaagcgaatcaaagaagaacacaactccacctggcactatgacgatgaaaatccatacaagacatgggcatatcatggctcttacgaggtaaaggctacgggctcagccagctccatgattaacggggtggttaaactccttaccaagccctgggacgtcgtgcctatggtgactcagatggcaatgacagataccactccatttggacagcaaagagtcttcaaagaaaaggttgacacaaggacaccccggagtatgccgggtacacgcagagtgatgggcatcactgccgagtggctgtggaggaccttagggcgaaataaaaagcctcggctgtgcacgcgtgaggaatttaccaagaaagtaagaacaaacgctgccatgggagcggtgttcactgaggaaaatcagtgggattctgcaaaggccgctgtcgaggacgaagatttttggaaattggtggaccgcgagagggagctccacaagctgggcaaatgtggtagctgcgtttataacatgatggggaagcgggagaagaagctaggagagttcggcaaggccaaaggctcaagagcaatttggtacatgtggcttggggctcgctacctggaatttgaggccctcggattcctgaatgaggatcattggttttccagggaaaacagttatagcggtgtggagggcgaagggttgcacaagctgggatacatcctccgagacatatctaaaatccccggcggtgctatgtatgccgatgacaccgcagggtgggacacacggattactgaggatgaccttcataatgaagagaagatcacccagcagatggatccagagcacagacaactggcgaacgccattttcaaattaacgtaccagaataaggtcgtgaaggtacagaggcctacacccaccggaactgttatggacatcatatcccgcaaagatcagcgtggctcaggccaagtggggacatatggactgaacacctttactaatatggaagctcagttgattcggcagatggagggtgaaggcgtcctcagcaaggccgacctggagaacccacacctacccgagaagaagatcacccagtggcttgagacaaaaggggtggagagactgaagaggatggcaatctcgggagatgactgcgtggtcaagcctattgatgaccgcttcgctaacgccctcctggcattgaatgatatgggcaaagttcgaaaggacataccacaatggcagccgtctaaaggttggcatgattggcaacaggtgcccttctgtagtcaccattttcacgaattaatcatgaaggacgggcggaaactggtagtgccttgcagaccacaagacgagctcattggaagggcccgcatctcccagggcgcgggctggagccttagagaaacggcttgtctggggaaggcctacgcacagatgtggtcactaatgtatttccaccggagggatctgcgtctcgcctccaacgctatttgctctgccgtccccgtgcattgggttcctaccagccgaactacatggagtatccacgcacatcaccaatggatgaccactgaggacatgttgacagtgtggaatcgcgtctggatagaagataacccatggatggaggacaagacccccgtgacgacatgggagaatgtaccttacctgggaaaaagagaagatcagtggtgtggttcccttatcggcctgaccagccgggctacttgggcccagaacattccgaccgcgatccagcaagttaggtctctcattgggaatgaggaatttttagactacatgccatcaatgaagcgcttcagaaaagaggaggaaagtgagggagctatctggtga

SEQ ID NO: 15102 - RNA, 9873 nt, synthetic construct
  misc_feature 1..9873: note = derived and/or modified CDS sequence (opt3) from DENV-3__JX669504__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtacgaatatgtgtaccctaatagcgatggatctcggcgagatgtgcgacgatacagtcacttacaaatgtccacatatcaccgaagttgagccggaagacattgattgctggtgtaacctgacaagtacctgggtgacttatgggacatgcaatcaggctggagagcgccgacgtgacaagagaagcgtagcccttgcaccccacgtgggcatgggtctggataccaggacgcaaacttggatgtccgccgagggggcttggcggcaggtcgaaaaagtggagacctgggcattgcgccatcctggattcacaatcctcgccctgtttctggctcactacattggcacttctctcacccagaaggttgtgatcttcatattactgatgcttgtcacaccatcgatgaccatgagatgtgtgggcgtagggaacagggactttgttgaaggattgtcaggtgccacgtgggtggatgtcgtgctggagcatggcgggtgcgtgactacaatggcgaagaataaacccaccctagacatcgagctccagaagactgaagcaacacaactggccacccttcggaaactgtgtattgagggaaagatcacgaacattaccacagatagccgctgccctactcagggcgaagctgtcttgccagaggaacaggaccagaattatgtttgtaaacacacctacgtggatcgaggttgggggaacggatgcggcctcttcggcaaggggagtctggtaacatgcgccaagtttcaatgtttagagcccatcgagggaaaagtggtccagtatgaaaatctgaagtacactgtgataattaccgttcacacaggtgaccagcatcaggtgggcaacgagacccaaggggtcactgcagaaatcacgcctcaggcttccacaaccgaggccattctcccagaatatggaactcttggcctggagtgctctccgagaaccggtttggacttcaatgagatgatcctactgacaatgaaaaacaaggcgtggatggtgcacaggcagtggtttttcgatctccccctgccttggaccagcggggccactacagaaacgccaacctggaatcggaaagagcttctggtaacttttaagaacgcacatgctaaaaagcaagaagttgtggtcttgggctcccaggagggagccatgcacacagctctcaccggcgccacagaaatccagaattcagggggaactagtattttcgcaggtcacctgaagtgtcgtttaaaaatggacaagctggagctaaaaggcatgagctacgccatgtgcaccaacacgtttgtgctcaagaaagaggtctctgaaacccagcatgggacaatactgatcaaggtggagtaccgcggagaagatgctccctgtaagattcctttctccactgaggacggccaaggtaaagcgcacaacgggagacttatcaccgcaaatccagttgtgacaaagaaagaggaacccgtaaacatagaggccgaaccgcctttcggcgagtcaaatattgtcatcggaatcggcgataacgctttgaagattaattggtataaaaaggggagcagtatcggaaagatgtttgaagccactgcaaggggtgcccggcgaatggctattctgggcgacaccgcctgggatttcgggtctgtgggaggcgttctcaactccctgggtaaaatggtgcatcagatatttgggagcgcatacacggcgcttttctcgggcgtctcttgggtgatgaagatcggaattggcgtactgttgacatggatcgggctcaattccaaaaacacctcaatgagttttagctgcatcgctattggaataatcactctgtatttaggcgccgtggttcaggcagacatgggttgtgtcattaattggaaggggaaagagctgaagtgcggatccggcatcttcgtgacaaacgaggtgcacacctggactgaacagtacaagtttcaagccgattctcccaaacgcctagctaccgccattgcaggtgcttgggagaatggcgtctgtgggatcagaagcacaacgaggatggaaaacctcctgtggaagcagatagccaatgagcttaactatatcttgtgggaaaataacattaaactgaccgttgtggtgggagacatcattggcgtactcgagcaggggaagcggactctgacaccacagcctatggagttaaaatactcatggaagacctggggaaaagcgaagatcgtcacagccgaaactcaaaacagttccttcataattgatggccccaataccccagagtgccccagcgcttctcgcgcatggaacgtgtgggaagttgaggactatggttttggggtgttcacgacaaatatctggctgaagcttagagaagtctacacccagttgtgtgaccataggctcatgtcagccgctgtgaaagatgagcgtgccgttcacgcagacatgggatactggattgagagtcagaagaacggcagctggaaactggaaaaggcgtccctaatcgaggtgaaaacttgcacctggcctaagtctcacacactgtggtcgaatggtgtactcgaaagcgatatgataatcccaaagtccctggccggcccgatttcacagcataaccaccggcccgggtatcatactcaaaccgctggaccttggcaccttggcaaattggagctggactttaattactgcgaggggacaacggtcgtgatcaccgaaaactgtggaactcgaggcccaagtttaagaacaaccactgtgtctggtaagctcattcacgagtggtgctgtaggagctgcacactgccccctcttcgctatatgggggaagatggatgttggtacggcatggagatccggccaatatccgaaaaagaggagaatatggtcaagtcactggttagcgccggttctggcaaagtggacaacttcaccatgggggtattgtgcctcgcaattctgtttgaagaggtgatgagaggaaagttcggcaagaaacatatgatcgctggggtcttctttacgctagtgctgctcctgtccggacagatcacttggagggatatggcccacacccttattatgatcggcagtaatgcaagcgaccgcatgggtatgggggttacatatttggccctgattgctaccttcaagatacagccctttttagcgctcggattctttctgcgaaaacttacttctcgggaaaacctgctactcggcgtgggcctggccatggcaacaaccttgcaactgccggaggatatcgaacagatggctaatgggattgccttaggactcatggccctgaagcttatcacacagttcgagacttaccagctgtggaccgctttgatttccctcacgtgttcaaacacaatgtttaccctgactgtcgcatggcgtaccgccacactaatcctggcgggtgtgagtcttctccctgtttgccaaagctcgtccatgagaaaaactgactggctgccaatggctgtggccgcaatgggcgtcccccctttgcccctgttcatattttctttaaaggataccctcaagaggcgcagctggccactgaatgagggggtaatggccgtgggacttgtttcaatcctggctagttccttgctccggaacgacgtgcctatggcaggccccctggtcgccggtgggctactgattgcgtgttatgtgatcacgggaacatctgctgatcttaccgtagaaaaagccgcagacattacttgggaggaagaggccgaacagacaggcgtgagccataacctcatgatcaccgtcgacgatgacggcactatgagaataaaggatgacgagacagagaatattctgaccgttttgttaaaaacggctctgctcatcgtgtccggggtgttcccatactcaatcccggccactctgcttgtctggcacacctggcagaagcagacacaaaggagcggagtgctgtgggatgttcctagtcccccagaaacccagaaagcagagttggaagagggtgtataccgaattaagcagcagggcatatttgggaaaacacaagtgggagtcggcgtgcagaaggagggtgttttccatactatgtggcacgtgacccgcggggctgtcctaacgtataacggaaagcggctggaacccaattgggcctctgtgaaaaaggacctcatctcctacggcggcgggtggagactgagcgcgcagtggcaaaaaggagaggaagtacaggtcattgccgtggagcctggtaagaacccaaaaaattttcagacaatgcccggcactttccagaccacaaccggggaaatcggagcaattgctcttgatttcaagcctggcacttcgggttcaccgatcataaacagggaggggaaggttgtgggattatatggcaatggcgtcgtgaccaaaaacgggggatacgtttctggtatcgcccaaacaaatgctgagccagacggccccacgcctgaactggaggaagagatgtttaagaaacgtaacctcactattatggatttgcacccagggagtggaaagacccgcaaatatctgcccgcaatcgtgcgggaagccattaagagaaggctccgaacactgatccttgcccctacccgggtcgtggctgcggagatggaggaagcactgaagggcttgccgatacgctaccagactacagccaccaaatccgagcatacgggtagagaaattgtagacctaatgtgccacgctactttcacaatgaggctgctcagccccgtgcgggttccaaattataacttaatcatcatggatgaggcccattttaccgaccctgcatctattgccgctcgagggtacatcagcaccagagtcggaatgggcgaagcggccgcaatattcatgactgctacacccccaggcaccgccgatgcatttcctcagtccaatgcccccattcaggacgaggagcgcgacatcccagaaaggtcatggaacagtgggaatgagtggattacagatttcgctggaaagactgtgtggtttgtgccgagcatcaaagccggtaacgacatagcgaactgtctgcgtaagaatggcaaaaaggtcattcaactttctcggaagacgttcgataccgaataccagaaaacaaagctgaacgactgggattttgtagtgactaccgacatctccgagatgggggcaaatttcaaagccgatagagttatcgaccctaggcgctgcctcaagcccgtgattttgacagatggaccagagcgagtcatcctggctggccccatgcctgtgaccgccgcttcagcagcccagagacggggtagggttgggcgcaacccacagaaagaaaatgaccaatatatttttactggccagcccctcaacaatgatgaggaccacgctcattggacggaagccaagatgctgcttgacaacataaatacccctgagggaatcattccggcactattcgaaccagagcgtgagaagagtgcggccatcgatggcgaatacagactgaaaggggagagccggaagacattcgtggaattgatgaggcgcggagacttacccgtctggctggctcacaaagtggcctccgagggtatcaagtatactgatcgaaaatggtgctttgacggccagagaaacaatcagattctcgaagagaacatggatgtagagatatggaccaaggaaggggagaaaaagaagctgcggcctaggtggcttgacgcacgcacatactctgatcccctggctctcaaagaattcaaggactttgccgcaggaagaaaatcgatcgccttggatctggtgaccgagattggcagggttccaagccacctagctcatcggactcgtaatgcgctggacaacctcgtcatgcttcacacatcagaacatggtgggcgcgcctatcgacacgcagtggaggagctgcctgaaacgatggagaccttattgctgctcggcctgatgatccttctgactggaggcgctatgctcttcttgatttccgggaagggaatcggtaaaacaagtataggcctgatctgtgtgattgcctctagcgggatgttatggatggccgaaatccccctacaatggattgcatccgctatcgtcctggagtttttcatgatggttctccttataccagagcctgaaaagcagagaaccccgcaggataatcaactggcctacgtggtaattggaatcttgaccctggcggctattatcgccgcaaacgagatgggcctcctggaaacaactaagagggaccttggtatgtcaaaagagcccggggtggtctctccaacgagctatctcgatgtggacctgcaccctgccagtgcttggaccttgtacgcagttgccacaactgtgataacccccatgctgcggcatacaatcgaaaattccaccgcgaacgtcagcttagctgccattgcaaaccaggccgtagtgctaatgggcctggacaagggatggccaatctctaaaatggatctcggcgttcctcttctggctttggggtgctactcacaggtgaatcccctgactctcacggccgcagtcctgcttttaattacacactatgctatcataggaccgggcctgcaggccaaggcgacccgcgaggcccaaaaaagaactgcagctggtattatgaagaacccaaccgtggacgggatcatgacaatcgatctcgaccctgtcatttacgattccaagtttgagaaacagttgggacaggtgatgctgctagttctgtgtgccgtgcagctccttctgatgaggactagttgggcattgtgcgaagctctgaccctcgccacaggccccatcacgaccctgtgggagggtagcccaggcaagttctggaatactacaatagccgtatcgatggcgaacatttttcgggggtcttatttagctggagcaggccttgccttctccatcatgaaaagcgtggggaccggaaagcgaggcactggttcacaaggggaaacactgggagagaaatggaagaagaaactcaatcagctaagtagaaaggaatttgacctgtacaaaaagtctggcattaccgaggtcgatcgcacggaggctaaagaaggtttgaagaggggcgagatcacccatcacgccgtttcccgggggagcgcaaaactgcagtggttcgtggaacgtaacatggtcatacccgagggaagagtgatcgacctcggctgtgggaggggaggctggtcatattactgcgccggtcttaagaaggtaacagaagtgcgcgggtatactaaaggaggccctggccatgaggagccggttcccatgagtacctacgggtggaatattgtgaagctgatgagcggaaaagatgtcttttacttgccacctgaaaagtgtgacacactgctctgcgatatcggtgagtcctctcccagccctactgtggaagagtcccggaccattcgagtcttaaaaatggtggagccatggctgaagaacaatcagttctgtatcaaggttcttaacccctatatgcctacagtaattgaacacctggagagactacaaaggaaacacggcgggatgctcgtgcgcaatccactgtcacggaactctacccatgaaatgtactggatcagtaatggaactggcaacatagtcgcttcggtgaatacggttagcagattgctgctcaaccgtttcacaatgacccacaggcggcccactaccgagaaggacgtggatcttggtgcggggacacgccatgtcaacgccgaaccggagacgcctaatatggacgtgattggagagcgaatcaaaagaatcaaggaagagcacaactccacctggcactatgacgatgaaaatccatacaaaacttgggcatatcatggctcttacgaggtaaaggctacaggctcagccagctccatgattaacggggtggttaagctgttaaccaaaccctgggacgtcgtgcctatggtgactcagatggcaatgacagataccacaccatttggacagcaaagggtcttcaaggaaaaagttgacactcggaccccccgcagtatgccgggtacgagaagggtgatgggcataaccgccgagtggctgtggcgaacattggggcggaataagaaacctcgtctctgcactagagaggaatttaccaagaaggtacgcacaaacgctgccatgggagcggtgttcactgaggaaaatcagtgggattctgcaaaagccgctgtcgaggacgaagatttttggaagctggtggacagggagcgggagctacacaaacttggcaagtgtggtagctgcgtttataacatgatggggaaaagagaaaagaaactgggagagttcggcaaggccaagggctcacgcgcaatctggtacatgtggctcggggctaggtacctggaatttgaggccttgggattcctgaatgaggatcattggttttcccgagaaaacagttatagcggtgtggagggcgaagggctccacaaacttggatacattctgcgggacatctctaagattcccggcggtgctatgtatgccgatgacaccgcagggtgggacacgagaatcacagaggatgacttacataatgaagagaaaataacccagcagatggatccagagcacaggcaactggcgaacgccatcttcaagttgacttaccagaataaagtcgtgaaggtacagcgccctacacccaccggaactgttatggacattatctcccgtaaggatcagcggggctcaggccaagtggggacctatggactcaacacatttacgaatatggaagctcagctgattagacagatggagggtgaaggcgtcctaagcaaagccgaccttgagaacccacacctgcccgaaaagaaaatcacccagtggctcgagactaagggggtggagaggctgaaacgcatggcaatatcgggagatgactgcgtggtcaagcctattgatgaccgattcgctaacgccttgttagcactgaatgatatgggcaaggttcggaaagacatcccacaatggcagccgtctaagggttggcatgattggcagcaggtgcccttttgtagtcaccatttccacgaactcatcatgaaagacgggagaaagcttgtagtgccttgcaggccacaagacgagctgattggacgcgccagaatatcccagggcgcgggctggagcctacgggaaacagcttgtctggggaaagcctacgcacagatgtggtcactcatgtatttccacaggcgtgatttgcgactggcctccaacgctatctgctctgccgtccccgtgcattgggttcctaccagccgcactacatggagtattcacgcacatcaccaatggatgaccacggaggacatgcttacagtgtggaatagagtctggatcgaagataacccatggatggaggacaagacccccgtgactacctgggagaatgtaccttacctgggaaagcgggaagatcagtggtgtggttccctcattggcttaacaagcagggctacttgggcccagaacatcccgaccgcgatacagcaagttcgctctctgatcgggaatgaggaatttttggactacatgccatcaatgaaaagattccggaaggaggaggaaagtgagggagctatttggtga

SEQ ID NO: 15103 - RNA, 9873 nt, synthetic construct
  misc_feature 1..9873: note = derived and/or modified CDS sequence (opt3) from DENV-3__JX669506__SS-prME
  source 1..9873: mol_type = other RNA
accagcttctgcctgatgatgatcctccccgcagctcttgcatttcacctgacttccagagacggagaacctaggatgattgtggggaagaacgaacggggaaagtctttgttattcaagactgcctcaggtataaatatgtgtacgctgatcgcgatggatctcggcgaaatgtgcgacgataccgtcacctacaaatgtccacatattactgaagttgagccggaagacatcgattgctggtgtaacctcaccagtacatgggtgacctatgggacttgcaatcaggctggagagcgccgacgtgacaagagaagcgtcgccctggcaccccacgtgggcatgggtcttgatacaaggacccagacgtggatgtccgccgagggggcttggcggcaggtcgaaaaagtggagacttgggcactgcgccatcctggatttaccattttggccctcttcctggctcactacatcggcacatctctgactcagaaggttgtgatatttatcctcttaatgctggtcaccccatcgatgacaatgagatgtgtgggcgtagggaacagggacttcgttgaaggactttcaggtgccacctgggtggatgtcgtgttggagcatggcgggtgcgtgacgactatggcgaagaataaacccacactggacattgagttgcagaagaccgaagcaactcagctcgccacactgcggaaactttgtatcgagggaaagattaccaacatcacgaccgatagccgctgccctacacagggcgaagctgtcctgccagaggaacaggaccagaattatgtttgtaaacacacttacgtggatcgaggttgggggaacggatgcggcttgtttggcaaggggagtctcgtaacctgcgccaagttccaatgtctggagcccatagagggaaaagtggtccagtatgaaaatttaaagtacacagtgattatcactgttcacaccggtgaccagcatcaggtgggcaacgagacacaaggggtcaccgcagaaattactcctcaggcttccacgacagaggccatcctgccagaatatggaaccctcggccttgagtgctctccgagaactggtctggactttaatgagatgatcttgctaaccatgaaaaacaaggcgtggatggtgcacaggcagtggttctttgatctgcccctcccttggacaagcggggccaccactgaaacaccaacgtggaatcggaaagagctgcttgtaaccttcaagaacgcacatgctaaaaagcaagaagttgtggtcctgggctcccaggagggagccatgcacactgctttgacaggcgccaccgaaattcaaaattcagggggaacaagtatatttgcaggtcacctcaagtgtcgtctgaaaatggacaagttagagctgaaaggcatgagctacgccatgtgcactaacaccttcgtgctaaagaaagaggtctctgaaacgcagcatgggaccatcctcattaaggtggagtacaagggagaagatgctccctgtaaaatccctttctccacagaggacggccaaggtaaggcgtataacgggcgcctgataactgcaaatccagttgtgaccaaaaaggaggaacccgtaaacattgaggccgaaccgccttttggcgagtcaaatatcgtcatcggaattggcgataacgctcttaaaatcaattggtacaagaaggggagcagtattggaaaaatgttcgaagccacagcaagaggtgccaggcggatggctatattgggcgacactgcctgggattttgggtctgtgggaggcgttctgaactccctcggtaagatggtgcaccagatcttcgggagcgcatataccgcgctgttttcgggcgtctcttgggtgatgaaaattggaatcggcgtacttctgacgtggatcgggctaaattccaagaacacatcaatgagtttcagctgcattgctataggaatcattaccctctacctgggcgccgtggttcaggcagacatgggttgtgtcatcaattggaaagggaaggagttaaagtgcggatccggcatttttgtgactaacgaggtgcatacatggaccgaacagtataaattccaagccgattctcccaagcgactggctactgccatcgccggtgcttgggagaatggcgtctgtgggatacgcagcaccacaagaatggaaaacctactctggaaacagatcgccaatgagctgaactacattctttgggaaaataacatcaagttgacggttgtggtgggagacattatcggcgtactggagcaggggaaaaggaccctcactccacagcctatggagctgaagtattcatggaaaacatggggaaaggcgaagatagtcaccgccgaaacacaaaacagttcctttattatcgatggccccaatactccagagtgccccagcgcttctcgggcatggaacgtgtgggaagttgaggactacggtttcggggtgtttaccacgaatatttggttaaaactgcgcgaagtctacacacagctttgtgaccacagattgatgtcagccgctgtgaaggatgagagggccgttcatgcagacatgggatattggatcgagagtcagaaaaacggcagctggaagctcgaaaaagcgtccctgatagaggtgaagacctgcacttggcctaagtctcacaccctatggtcgaatggtgtactggaaagcgatatgatcattccaaaatccctcgccggcccgatctcacagcacaaccatcgtcccgggtaccacacacaaactgctggaccttggcatctgggcaaacttgagttggacttcaattattgcgaggggaccacagtcgtgattacggaaaactgtggaacccggggcccaagtctgcgaactacaaccgtgtctggtaaattaatccacgagtggtgctgtagaagctgcactctaccccctctgaggtacatgggggaagatggatgttggtatggcatggagatacgcccaatttccgaaaaggaggagaatatggtcaaatcacttgttagcgccggttctggcaaggtggacaactttacaatgggggtactgtgcttggcaatcctcttcgaagaggtgatgcggggaaagttcggcaaaaagcacatgatcgctggggtctttttcacctttgtgctgctactgtccggacagattacgtggagagatatggcccatactctcatcatgattggcagtaatgcaagcgacaggatgggtatgggggttacctacctggcccttatagctacattcaaaatccagccctttttggcgctgggattctttttacgcaagctcacctctcgagaaaacctgcttctgggcgtgggcctagccatggcaactacactccaactgccggaggatattgaacagatggctaatgggatcgccttgggactgatggccttaaaactcattacccagttcgagacatatcagctgtggactgctcttatctccctgacctgttcaaacacgatgtttacattgaccgtcgcatggcggactgccaccctcatactggcgggtgtgagtctactgcctgtttgccaaagctcgtccatgcgtaagacagactggcttccaatggctgtggccgcaatgggcgtaccccctctccccctgttcatcttttctttgaaggatactctgaaaagaaggagctggccattaaatgagggggtaatggccgtgggactcgtttcaattctggctagttcccttctgcgcaacgacgtgcctatggcaggccccttggtcgccggtgggctcctgatcgcgtgttacgtgattaccggaacgtctgctgatctaacagtagaaaaggccgcagacatcacctgggaggaagaggccgaacagactggcgtgagccacaacctgatgataacagtcgacgatgacggcaccatgcggattaaagatgacgagactgagaatatccttacagttctcctgaagaccgctttgttaatcgtgtccggggtgttcccatactcaattccggccacgctgctcgtctggcatacttggcagaaacagacccaaagaagcggagtgctgtgggatgttcctagtcccccagaaacacagaaggcagagcttgaagagggtgtatataggataaaacagcagggcatctttgggaagacccaagtgggagtcggcgtgcagaaggagggtgttttccacacaatgtggcatgtgactcgaggggctgtcctgacctacaacggaaaacgcttggaacccaattgggcctctgtgaagaaagacctaatttcctatggcggcgggtggcggctgagcgcgcagtggcaaaagggagaggaagtacaggtcatcgccgtggagcctggtaaaaacccaaagaatttccagacgatgcccggcacatttcagactaccacaggggaaattggagcaatcgctctcgatttcaagcctggcacctcgggttcaccgataatcaacagagaggggaaagttgtgggactgtacggcaatggcgtcgtgactaagaacgggggatatgtttctggtattgcccaaaccaatgctgagccagacggccccacacctgaacttgaggaagagatgtttaaaaagaggaacttaacgatcatggatctgcacccagggagtggaaaaactcgtaagtacctccccgcaattgtgcgcgaagccatcaagcggagattgaggaccctgatactcgcccctacacgagtcgtggctgcggagatggaggaagcactgaaaggccttccgattcggtatcagaccactgccacaaagtccgagcacaccggtcgcgaaatcgtagacctgatgtgccatgctacgttcactatgagattgctaagccccgtgagggttccaaattacaacctgatcattatggatgaggcccactttacagaccctgcatctatcgccgctcgggggtacataagcacccgagtcggaatgggcgaagcggccgcaattttcatgaccgctactcccccaggcacagccgatgcatttcctcagtccaatgcccccatccaggacgaggagagagacattccagaacgctcatggaacagtgggaatgagtggatcaccgatttcgctggaaaaacagtgtggtttgtgccgagcataaaggccggtaacgacattgcgaactgtctcaggaaaaatggcaagaaggtcatccaattatctcgtaaaactttcgatacggaatatcagaagaccaaactgaacgactgggattttgtagtgacaactgacatctccgagatgggggcaaatttcaaggccgatcgggttattgaccctagaaggtgccttaaacccgtgatcctgaccgatggaccagagcgcgtcattctcgctggccccatgcctgtgacagccgcttcagcagcccagcgaagaggtcgggttgggaggaacccacagaaggaaaatgaccaatacatattcaccggccagcccttgaacaatgatgaggaccatgctcactggactgaagccaagatgctgctcgacaacatcaatacgcctgagggaattatcccggcactgtttgaaccagagcgcgagaaaagtgcggccatcgatggcgaatatcgtcttaagggggagagcagaaaaaccttcgtggaactaatgcggaggggagacctgcccgtctggttggctcataaggtggcctccgagggtattaaatacacagatcgcaagtggtgctttgacggccagcgaaacaatcagatattagaagagaacatggatgtagagatctggactaaagaaggggagaagaagaaactgagacctcggtggctcgacgcaaggacctattctgatcccctggctcttaaggagttcaaagactttgccgcaggacgcaagtcgattgccctggatctcgtgacagagatcggcagagttccaagccacttggctcacaggacccggaatgcgctggacaacctagtcatgctgcatacttcagaacacggtgggcgtgcctaccgccatgcagtggaggagctccctgaaacaatggagacgcttctgttattgggcctgatgattctcctgaccggaggcgctatgcttttcctgatctccgggaaaggaataggtaagacaagtatcggcctcatttgtgtgatcgcctctagcgggatgttgtggatggccgaaattcccctgcaatggatcgcatccgctatagtcttagagtttttcatgatggttctactgattccagagcctgaaaagcagcgaacaccgcaggataatcaactcgcctatgtggtaatcggcattcttaccctggcggctatcatagccgcaaacgagatgggcttgctggaaaccacaaaaagagacctcggtatgtcaaaggagcccggggtggtctctccaactagctacctggatgtggaccttcaccctgccagtgcttggacgctctacgcagttgccaccacagtgatcactcccatgctgaggcacaccattgaaaattccacagcgaacgtcagcttggctgccatcgcaaaccaggccgtagtgctgatgggcttagacaaaggatggccaatttctaagatggatctaggcgttcctctgctcgctcttgggtgctattcacaggtgaatcccctgaccttgactgccgcagtcctgctcctgatcacgcattacgctataattggaccgggccttcaggccaaagcgacacgggaggcccaaaagcgcaccgcagctggtatcatgaagaacccaactgtggacgggatcatgaccattgatttagaccctgtcatctatgattccaaatttgagaagcagctgggacaggtgatgctcttggttctgtgtgccgtgcagctactgctcatgagaacaagttgggcactttgcgaagctctgactttggccaccggccccataacaacgctgtgggagggtagcccaggcaaattctggaataccactattgccgtatcgatggcgaacatctttagggggtcttacctcgctggagcaggcctggccttctccattatgaaaagcgtggggacaggaaaacggggcaccggttcacaaggggaaactttaggagagaagtggaagaagaaacttaatcagctgagtcgaaaagaatttgacctctataagaaatctggcatcacagaggtcgatagaaccgaggctaaagaaggtctaaaacgcggcgagataacgcaccatgccgtttccagggggagcgcaaagctgcagtggttcgtggaacggaacatggtcatccccgagggacgtgtgattgacttgggctgtgggagaggaggctggtcatactattgcgccggtctgaagaaagtaaccgaagtgagggggtacacaaagggaggccctggccacgaggagccggttcccatgagtacttacgggtggaatatcgtgaaactcatgagcggaaaggatgtcttctatcttccacctgaaaaatgtgacaccctgttgtgcgatattggtgagtcctctcccagccctacagtggaagagtcccgcactatccgggtcctgaagatggtggagccatggctcaagaacaatcagttttgtattaaagttttaaacccctacatgcctaccgtaatcgaacatctggagcgacttcaaagaaagcacggcgggatgctggtgaggaatccactatcacgcaactctacacacgaaatgtattggataagtaatggaaccggcaacattgtcgcttcggtgaatatggttagccggctcctgttgaacagattcactatgacgcatcgtaggcccacaatcgagaaagacgtggatctgggtgcggggacccggcacgtcaacgccgaaccggagactcctaatatggacgtgatcggagagcgcattaagcgaataaaagaagaacataactccacctggcactacgacgatgaaaatccatataagacatgggcataccacggctcttatgaggtaaaggctacgggctcagccagctccatgatcaacggggtggttaaactccttaccaagccctgggacgtcgtgcctatggtgactcagatggcaatgacagataccactccatttggacagcaaagagtcttcaaagaaaaggttgacacaaggacaccccggagtatgccgggtacacgcagagtgatgggcattactgccgagtggctgtggaggaccttagggcgaaataaaaagcctcggctgtgcacgcgtgaggaatttaccaagaaagtaagaacaaacgctgccatgggagcggtgttcactgaggaaaatcagtgggattctgcaaaggccgctgtcgaggacgaagatttttggaaattggtggaccgcgagagggagctccataagctgggcaaatgtggtagctgcgtttacaacatgatggggaagcgggagaagaagctaggagagttcggcaaggccaaaggctcaagagcaatctggtacatgtggcttggggctcgctatctggaatttgaggccctcggattcctgaatgaggatcactggttttccagggaaaacagttacagcggtgtggagggcgaagggttgcataagctgggatatattctccgagacatctctaaaatacccggcggtgctatgtacgccgatgacaccgcagggtgggacacacggatcactgaggatgaccttcacaatgaagagaagattacccagcagatggatccagagcatagacaactggcgaacgccatcttcaaattaacgtatcagaataaggtcgtgaaggtacagaggcctacacccaccggaactgttatggacattatctcccgcaaagatcagcgtggctcaggccaagtggggacatacggactgaacacctttactaatatggaagctcagttgatacggcagatggagggtgaaggcgtcctcagcaaggccgacctggagaacccacacctacccgagaagaagattacccagtggcttgagacaaaaggggtggagagactgaagaggatggcaatctcgggagatgactgcgtggtcaagcctatcgatgaccgcttcgctaacgccctcctggcattgaatgatatgggcaaagttcgaaaggacattccacaatggcagccgtctaaaggttggcacgattggcaacaggtgcccttctgtagtcatcactttcatgaattaataatgaaggacgggcggaaactggtagtgccttgcagaccacaagacgagctcatcggaagggcccgcatttcccagggcgcgggctggagccttagagaaacggcttgtctggggaaggcctatgcacagatgtggtcactaatgtacttccaccggagggatctgcgtctcgcctccaacgctatctgctctgccgtccccgtgcactgggttcctaccagccgaactacatggagtattcatgcacaccatcaatggatgaccactgaggacatgttgacagtgtggaatcgcgtctggatcgaagataacccatggatggaggacaagacccccgtgacgacatgggagaatgtaccttacctgggaaaaagagaagatcagtggtgtggttcccttataggcctgaccagccgggctacttgggcccagaacatcccgaccgcgattcagcaagttaggtctctcatcgggaatgaggaatttttagactatatgccatcaatgaagcgcttcagaaaagaggaggaaagtgagggagctatttggtga

SEQ ID NO: 15104 - RNA, 9873 nt, synthetic construct
  misc_feature 1..9873: note = derived and/or modified CDS sequence (opt3) from DENV-3__JX669496__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtacgaatatgtgtaccctaatagcgatggatctcggcgagatgtgcgacgatacagtcacttacaaatgtccacatatcaccgaagttgagccggaagacattgattgctggtgtaacctgacaagtacctgggtgacttatgggacatgcaatcaggctggagagcgccgacgtgacaagagaagcgtagcccttgcaccccacgtgggcatgggtctggataccaggacgcaaacttggatgtccgccgagggggcttggcggcaggtcgaaaaagtggagacctgggcattgcgccatcctggattcacaatcctcgccctgtttctggctcactacattggcacttctctcacccagaaggttgtgatcttcatattactgatgcttgtcacaccatcgatgaccatgagatgtgtgggcgtagggaacagggactttgttgaaggattgtcaggtgccacgtgggtggatgtcgtgctggagcatggcgggtgcgtgactacaatggcgaagaataaacccaccctagacatcgagctccagaagactgaagcaacacaactggccacccttcggaaactgtgtattgagggaaagatcacgaacattaccacagatagccgctgccctactcagggcgaagctgtcttgccagaggaacaggaccagaattatgtttgtaaacacacctacgtggatcgaggttgggggaacggatgcggcctcttcggcaaggggagtctggtaacatgcgccaagtttcaatgtttagagcccatcgagggaaaagtggtccagtatgaaaatctgaagtacactgtgataattaccgttcacacaggtgaccagcatcaggtgggcaacgagacccaaggggtcactgcagaaatcacgcctcaggcttccacaaccgaggccattctcccagaatatggaactcttggcctggagtgctctccgagaaccggtttggacttcaatgagatgatcctactgacaatgaaaaacaaggcgtggatggtgcacaggcagtggtttttcgatctccccctgccttggaccagcggggccactacagaaacgccaacctggaatcggaaagagcttctggtaacttttaagaacgcacatgctaaaaagcaagaagttgtggtcttgggctcccaggagggagccatgcacacagctctcaccggcgccacagaaatccagaattcagggggaactagtattttcgcaggtcacctgaagtgtcgtttaaaaatggacaagctggagctaaaaggcatgagctacgccatgtgcgctaacacctttgtgctcaagaaagaggtctctgaaacgcagcatgggaccatactgatcaaggtggagtaccgcggagaagatgcgccctgtaagattcctttctccacagaggacggccaaggtaaagcacacaacgggagacttatcactgccaatccagttgtgaccaagaaagaggaacccgtaaacatagaggctgaaccgcctttcggcgagtcaaatattgtcatcggaatcggcgataacgccttgaagattaattggtataaaaaggggagcagtatcggaaagatgtttgaagcaacagccaggggtgctcggcgaatggccattctgggcgacactgcatgggatttcgggtctgtgggaggcgttctcaactccctgggtaaaatggtgcatcagatatttgggagcgcgtacaccgctcttttctcgggcgtctcttgggtgatgaagatcggaattggcgtactgttgacgtggatcgggctcaattccaaaaacacatcaatgagttttagctgcatcgccattggaataatcaccctgtatttaggcgcagtggttcaggccgacatgggttgtgtcattaattggaaggggaaagagctgaagtgcggatccggcatcttcgtgactaacgaggtgcacacatggaccgaacagtacaagtttcaagctgattctcccaaacgcctagccactgcaattgctggtgcctgggagaatggcgtctgtgggatcagaagcaccacaaggatggaaaacctcctgtggaagcagatagcgaatgagcttaactatatcttgtgggaaaataacattaaactgacggttgtggtgggagacatcattggcgtactcgagcaggggaagcggaccctgactccacagcctatggagttaaaatactcatggaagacatggggaaaagccaagatcgtcaccgctgaaacacaaaacagttccttcataattgatggccccaatactccagagtgccccagcgcatctcgcgcctggaacgtgtgggaagttgaggactatggttttggggtgttcaccacgaatatctggctgaagcttagagaagtctacacacagttgtgtgaccataggctcatgtcagctgccgtgaaagatgagcgtgcagttcacgcggacatgggatactggattgagagtcagaagaacggcagctggaaactggaaaaggcctccctaatcgaggtgaaaacctgcacttggcctaagtctcacaccctgtggtcgaatggtgtactcgaaagcgatatgataatcccaaagtccctggctggcccgatttcacagcataaccaccggcccgggtatcatacacaaactgccggaccttggcaccttggcaaattggagctggactttaattactgcgaggggaccacagtcgtgatcacggaaaactgtggaacccgaggcccaagtttaagaactacaaccgtgtctggtaagctcattcacgagtggtgctgtaggagctgcactctgccccctcttcgctatatgggggaagatggatgttggtacggcatggagatccggccaatatccgaaaaagaggagaatatggtcaagtcactggttagcgcaggttctggcaaagtggacaacttcacaatgggggtattgtgcctcgctattctgtttgaagaggtgatgagaggaaagttcggcaagaaacatatgatcgccggggtcctattcacctttgtgctgctcctgtccggacagatcacgtggagggatatggcacacactcttattatgatcggcagtaatgccagcgaccgcatgggtatgggggttacctatttggctctgattgcgacattcaagatacagccctttttagccctcggattctttctgcgaaaacttacctctcgggaaaacctgctactcggcgtgggcctggcaatggctactacattgcaactgccggaggatatcgaacagatggccaatgggattgccttaggactcatggctctgaagcttatcacccagttcgagacataccagctgtggactgcattgatttccctcacctgttcaaacacgatgtttacactgaccgtcgcctggcgtactgcgaccctaatcctggctggtgtgagtcttctccctgtttgccaaagctcgtccatgagaaaaacagactggctgccaatggccgtggcagccatgggcgtcccccctttgcccctgttcatattttctttaaaggatactctcaagaggcgcagctggccactgaatgagggggtaatggctgtgggacttgtttcaatcctggcaagttccttgctccggaacgacgtgcctatggccggccccctggtcgcgggtgggctactgattgcttgttatgtgatcaccggaacgtctgccgatcttacagtagaaaaagcagccgacattacctgggaggaagaggctgaacagactggcgtgagccataacctcatgatcacagtcgacgatgacggcaccatgagaataaaggatgacgagactgagaatattctgacagttttgttaaaaaccgccctgctcatcgtgtccggggtgttcccatactcaatcccggcaacgctgcttgtctggcacacttggcagaagcagacccaaaggagcggagtgctgtgggatgttcctagtcccccagaaacacagaaagctgagttggaagagggtgtataccgaattaagcagcagggcatatttgggaaaacccaagtgggagtcggcgtgcagaaggagggtgttttccatacaatgtggcacgtgactcgcggggccgtcctaacctataacggaaagcggctggaacccaattgggcgtctgtgaaaaaggacctcatctcctacggcggcgggtggagactgagcgcccagtggcaaaaaggagaggaagtacaggtcattgcagtggagcctggtaagaacccaaaaaattttcagacgatgcccggcacattccagactaccacaggggaaatcggagctattgcccttgatttcaagcctggcacctcgggttcaccgatcataaacagggaggggaaggttgtgggattatatggcaatggcgtcgtgactaaaaacgggggatacgtttctggtatcgctcaaaccaatgcagagccagacggccccacacctgaactggaggaagagatgtttaagaaacgtaacctcacgattatggatttgcacccagggagtggaaagactcgcaaatatctgcccgccatcgtgcgggaagccattaagagaaggctccgaaccctgatccttgctcctacacgggtcgtggcggcagagatggaggaagccctgaagggcttgccgatacgctaccagaccactgctacaaaatccgagcataccggtagagaaattgtagacctaatgtgccacgccacgttcactatgaggctgctcagccccgtgcgggttccaaattataacttaatcatcatggatgaggcacattttacagaccctgcctctattgctgcgcgagggtacatcagcaccagagtcggaatgggcgaagccgcagctatattcatgaccgccactcccccaggcacagcagatgcctttcctcagtccaatgctcccattcaggacgaggagcgcgacatcccagaaaggtcatggaacagtgggaatgagtggattaccgatttcgccggaaagacagtgtggtttgtgccgagcatcaaagcgggtaacgacatagcaaactgtctgcgtaagaatggcaaaaaggtcattcaactttctcggaagactttcgatacggaataccagaaaaccaagctgaacgactgggattttgtagtgacaactgacatctccgagatgggggccaatttcaaagctgatagagttatcgaccctaggcgctgcctcaagcccgtgattttgaccgatggaccagagcgagtcatcctggccggccccatgcctgtgacagctgcatcagccgctcagagacggggtagggttgggcgcaacccacagaaagaaaatgaccaatatatttttaccggccagcccctcaacaatgatgaggaccacgcccattggactgaagcaaagatgctgcttgacaacataaatacgcctgagggaatcattccggcgctattcgaaccagagcgtgagaagagtgccgctatcgatggcgaatacagactgaaaggggagagccggaagaccttcgtggaattgatgaggcgcggagacttacccgtctggctggcccacaaagtggcatccgagggtatcaagtatacagatcgaaaatggtgctttgacggccagagaaacaatcagattctcgaagagaacatggatgtagagatatggactaaggaaggggagaaaaagaagctgcggcctaggtggcttgacgctcgcacctactctgatcccctggccctcaaagaattcaaggactttgcagccggaagaaaatcgatcgctttggatctggtgacagagattggcagggttccaagccacctagcgcatcggacccgtaatgccctggacaacctcgtcatgcttcacacttcagaacatggtgggcgcgcatatcgacacgctgtggaggagctgcctgaaacaatggagacgttattgctgctcggcctgatgatccttctgaccggaggcgccatgctcttcttgatttccgggaagggaatcggtaaaactagtataggcctgatctgtgtgattgcctctagcgggatgttatggatggcagaaatccccctacaatggattgcttccgccatcgtcctggagtttttcatgatggttctccttataccagagcctgaaaagcagagaacaccgcaggataatcaactggcgtacgtggtaattggaatcttgaccctggctgccattatcgcagccaacgagatgggcctcctggaaaccacaaagagggaccttggtatgtcaaaagagcccggggtggtctctccaactagctatctcgatgtggacctgcaccctgctagtgcatggacgttgtacgccgttgcgaccacagtgataactcccatgctgcggcataccatcgaaaattccacagctaacgtcagcttagccgcaattgccaaccaggctgtagtgctaatgggcctggacaagggatggccaatctctaaaatggatctcggcgttcctcttctggccttggggtgctactcacaggtgaatcccctgaccctcactgcagctgtcctgcttttaattacgcactatgccatcataggaccgggcctgcaggcgaaggccacacgcgaggcacaaaaaagaaccgctgccggtattatgaagaacccaactgtggacgggatcatgaccatcgatctcgaccctgtcatttacgattccaagtttgagaaacagttgggacaggtgatgctgctagttctgtgtgcagtgcagctccttctgatgaggacaagttgggctttgtgcgaagccctgactctcgccaccggccccatcacaacgctgtgggagggtagcccaggcaagttctggaataccactatagcggtatcgatggctaacatttttcgggggtcttatttagcaggagccggccttgctttctccatcatgaaaagcgtggggacaggaaagcgaggcaccggttcacaaggggaaactctgggagagaaatggaagaagaaactcaatcagctaagtagaaaggaatttgacctgtacaaaaagtctggcattacagaggtcgatcgcaccgaggccaaagaaggtttgaagaggggcgagatcacgcatcacgcagtttcccgggggagcgccaaactgcagtggttcgtggaacgtaacatggtcatacccgagggaagagtgatcgacctcggctgtgggaggggaggctggtcatattactgcgctggtcttaagaaggtaaccgaagtgcgcgggtatacaaaaggaggccctggccatgaggagccggttcccatgagtacttacgggtggaatattgtgaagctgatgagcggaaaagatgtcttttacttgccacctgaaaagtgtgacaccctgctctgcgatatcggtgagtcctctcccagccctacagtggaagagtcccggactattcgagtcttaaaaatggtggagccatggctgaagaacaatcagttctgtatcaaggttcttaacccctatatgcctaccgtaattgaacacctggagagactacaaaggaaacacggcgggatgctcgtgcgcaatccactgtcacggaactctacacatgaaatgtactggatcagtaatggaaccggcaacatagtcgcgtcggtgaatactgttagcagattgctgctcaaccgtttcacgatgacacacaggcggcccaccactgagaaggacgtggatcttggtgccgggacccgccatgtcaacgcagaaccggagacacctaatatggacgtgattggagagcgaatcaaaagaatcaaggaagagcacaactccacgtggcactatgacgatgaaaatccatacaaaacctgggcttatcatggctcttacgaggtaaaggccactggctcagcaagctccatgattaacggggtggttaagctgttaacaaaaccctgggacgtcgtgcctatggtgacccagatggccatgactgatacaaccccatttggacagcaaagggtcttcaaggaaaaagttgacacacggactccccgcagtatgccgggtaccagaagggtgatgggcataacggctgagtggctgtggcgaaccttggggcggaataagaaacctcgtctctgcacaagagaggaatttactaagaaggtacgcaccaacgccgcgatgggagcagtgttcacagaggaaaatcagtgggattctgccaaagctgccgtcgaggacgaagatttttggaagctggtggacagggagcgggagctacacaaacttggcaagtgtggtagctgcgtttataacatgatggggaaaagagaaaagaaactgggagagttcggcaaggcaaagggctcacgcgctatctggtacatgtggctcggggccaggtacctggaatttgaggctttgggattcctgaatgaggatcattggttttcccgagaaaacagttatagcggtgtggagggcgaagggctccacaaacttggatacattctgcgggacatctctaagattcccggcggtgccatgtatgcagatgacactgcggggtgggacaccagaatcacggaggatgacttacataatgaagagaaaataacacagcagatggatccagagcacaggcaactggccaacgctatcttcaagttgacctaccagaataaagtcgtgaaggtacagcgccctactcccacaggaaccgttatggacattatctcccgtaaggatcagcggggctcaggccaagtggggacttatggactcaacacctttacaaatatggaagcccagctgattagacagatggagggtgaaggcgtcctaagcaaagcagaccttgagaacccacacctgcccgaaaagaaaatcacgcagtggctcgagaccaagggggtggagaggctgaaacgcatggctatatcgggagatgactgcgtggtcaagcctattgatgaccgattcgccaacgcattgttagccctgaatgatatgggcaaggttcggaaagacatcccacaatggcagccgtctaagggttggcatgattggcagcaggtgcccttttgtagtcaccatttccacgaactcatcatgaaagacgggagaaagcttgtagtgccttgcaggccacaagacgagctgattggacgcgcgagaatatcccagggcgctggctggagcctacgggaaactgcctgtctggggaaagcatacgcccagatgtggtcactcatgtatttccacaggcgtgatttgcgactggcttccaacgccatctgctctgcagtccccgtgcattgggttcctacaagccgcaccacttggagtattcacgctcatcaccaatggatgacaaccgaggacatgcttacggtgtggaatagagtctggatcgaagataacccatggatggaggacaagacacccgtgaccacttgggagaatgtaccttacctgggaaagcgggaagatcagtggtgtggttccctcattggcttaaccagcagggccacatgggcgcagaacatcccgactgctatacagcaagttcgctctctgatcgggaatgaggaatttttggactacatgccatcaatgaaaagattccggaaggaggaggaaagtgagggagccatttggtga

SEQ ID NO: 15105 - RNA, 9873 nt, synthetic construct
  misc_feature 1..9873: note = derived and/or modified CDS sequence (opt3) from DENV-3__JX669490__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagcccatagagggaaaagtggtccagtatgaaaatctgaagtacacagtgattatcactgttcacaccggtgaccagcatcaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaaaaacaaggcgtggatggtgcacaggcagtggtttttcgatctccccctgccttggacaagcggggccaccactgaaacaccaacgtggaatcggaaagagcttctggtaacctttaagaacgcacatgctaaaaagcaagaagttgtggtcttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtgctcaagaaagaggtctctgaaacgcagcatgggaccatcctgattaaggtggagtaccgcggagaagatgctccctgtaagatccctttctccacagaggacggccaaggtaaagcgcacaacgggagacttataactgcaaatccagttgtgaccaagaaagaggaacccgtaaacattgaggccgaaccgcctttcggcgagtcaaatatcgtcatcggaattggcgataacgctttgaagatcaattggtataaaaaggggagcagtattggaaagatgtttgaagccacagcaaggggtgcccggcgaatggctatactgggcgacactgcctgggatttcgggtctgtgggaggcgttctcaactccctgggtaaaatggtgcatcagatctttgggagcgcatacaccgcgcttttctcgggcgtctcttgggtgatgaagattggaatcggcgtactgttgacgtggatcgggctcaattccaaaaacacatcaatgagttttagctgcattgctataggaatcattaccctgtatttaggcgccgtggttcaggcagacatgggttgtgtcatcaattggaaggggaaagagctgaagtgcggatccggcattttcgtgactaacgaggtgcacacatggaccgaacagtacaagtttcaagccgattctcccaaacgcctagctactgccatcgcaggtgcttgggagaatggcgtctgtgggataagaagcaccacaaggatggaaaacctcctgtggaagcagatcgccaatgagcttaactatattttgtgggaaaataacatcaaactgacggttgtggtgggagacattatcggcgtactcgagcaggggaagcggaccctgactccacagcctatggagttaaaatactcatggaagacatggggaaaagcgaagatagtcaccgccgaaacacaaaacagttccttcattatcgatggccccaatactccagagtgccccagcgcttctcgcgcatggaacgtgtgggaagttgaggactatggttttggggtgttcaccacgaatatttggctgaagcttagagaagtctacacacagttgtgtgaccataggctcatgtcagccgctgtgaaagatgagcgtgccgttcacgcagacatgggatactggatcgagagtcagaagaacggcagctggaaactggaaaaggcgtccctaatagaggtgaaaacctgcacttggcctaagtctcacaccctgtggtcgaatggtgtactcgaaagcgatatgatcattccaaagtccctggccggcccgatctcacagcataaccaccggcccgggtatcatacacaaactgctggaccttggcaccttggcaaattggagctggactttaattactgcgaggggaccacagtcgtgattacggaaaactgtggaacccgaggcccaagtttaagaactacaaccgtgtctggtaagctcatccacgagtggtgctgtaggagctgcactctgccccctcttcgctatatgggggaagatggatgttggtacggcatggagatacggccaatttccgaaaaagaggagaatatggtcaagtcactggttagcgccggttctggcaaagtggacaacttcacaatgggggtattgtgcctcgcaatcctgtttgaagaggtgatgagaggaaagttcggcaagaaacatatgatcgctggggtcttctttaccttcgtgctactgctctccggacagattacgtggagggatatggcccacactctgatcatgattggcagtaatgcaagcgaccgcatgggtatgggggttacctatcttgccttgatagctacatttaagatccagcccttcctggcgttaggatttttcctccgaaaactgacctctcgggaaaaccttctgctaggcgtgggcctcgccatggcaactacactgcaattgccggaggatattgaacagatggctaatgggatcgccctgggattaatggccctcaagctgattacccagtttgagacataccagctttggactgctctgatctccttgacctgttcaaacacgatgttcacactcaccgtcgcatggcgtactgccaccctgatactagcgggtgtgagtctgcttcctgtttgccaaagctcgtccatgagaaaaacagactggctcccaatggctgtggccgcaatgggcgtcccccctctgcccttgtttatcttctctctgaaggatactttaaagaggcgcagctggccactcaatgagggggtaatggccgtgggactggtttcaattcttgctagttccctgttgcggaacgacgtgcctatggcaggccccctcgtcgccggtgggctgctaatcgcgtgttatgtgattaccggaacgtctgctgatctgacagtagaaaaagccgcagacatcacctgggaggaagaggccgaacagactggcgtgagccataaccttatgataacagtcgacgatgacggcaccatgagaattaaggatgacgagactgagaatatcctcacagttctgttgaaaaccgctttactgatcgtgtccggggtgtttccatactcaattccggccacgctcctggtctggcacacttggcagaagcagacccaaaggagcggagtgctttgggatgttcctagtcccccagaaacacagaaagcagagctggaagagggtgtataccgaataaagcagcagggcatcttcgggaaaacccaagtgggagtcggcgtgcagaaggagggtgtttttcatacaatgtggcacgtgactcgcggggctgtcttgacctataacggaaagcggctagaacccaattgggcctctgtgaaaaaggacctgatttcctacggcggcgggtggagactcagcgcgcagtggcaaaaaggagaggaagtacaggtcatcgccgtggagcctggtaagaacccaaaaaatttccagacgatgcccggcacattccagactaccacaggggaaattggagcaatcgctctggattttaagcctggcacctcgggttcaccgataatcaacagggaggggaaggttgtgggactttatggcaatggcgtcgtgactaaaaacgggggatacgtttctggtattgcccaaaccaatgctgagccagacggccccacacctgaattagaggaagagatgttcaagaaacgtaacctgacgatcatggatctccacccagggagtggaaagactcgcaaatatttgcccgcaattgtgcgggaagccatcaagagaaggctgcgaaccctcatactggcccctacacgggtcgtggctgcggagatggaggaagcacttaagggcctgccgattcgctaccagaccactgccacaaaatccgagcataccggtagagaaatcgtagacttgatgtgccacgctacgtttactatgaggctactgagccccgtgcgggttccaaattataacctcatcattatggatgaggcccatttcacagaccctgcatctatcgccgctcgagggtacataagcaccagagtcggaatgggcgaagcggccgcaatttttatgaccgctactcccccaggcacagccgatgcattccctcagtccaatgcccccatccaggacgaggagcgcgacattccagaaaggtcatggaacagtgggaatgagtggatcaccgattttgctggaaagacagtgtggttcgtgccgagcataaaagccggtaacgacattgcgaactgtttacgtaagaatggcaaaaaggtcatccaactgtctcggaagacttttgatacggaataccagaaaaccaagcttaacgactgggatttcgtagtgacaactgacatctccgagatgggggcaaattttaaagccgatagagttattgaccctaggcgctgcctgaagcccgtgatcctcaccgatggaccagagcgagtcattttggctggccccatgcctgtgacagccgcttcagcagcccagagacggggtagggttgggcgcaacccacagaaagaaaatgaccaatatatattcaccggccagcccctgaacaatgatgaggaccacgctcattggactgaagccaagatgctcctggacaacatcaatacgcctgagggaattatcccggcacttttcgaaccagagcgtgagaagagtgcggccatcgatggcgaatacagactaaaaggggagagccggaagacctttgtggaactgatgaggcgcggagacttgcccgtctggttagctcacaaagtggcctccgagggtattaagtatacagatcgaaaatggtgcttcgacggccagagaaacaatcagatactggaagagaacatggatgtagagatctggactaaggaaggggagaaaaagaagctccggcctaggtggctggacgcacgcacctactctgatccccttgctctgaaagaatttaaggacttcgccgcaggaagaaaatcgattgccctcgatttggtgacagagatcggcagggttccaagccacctggctcatcggacccgtaatgcgctagacaacctggtcatgctccacacttcagaacatggtgggcgcgcctatcgacacgcagtggaggagcttcctgaaacaatggagacgctgttattgctgggcctcatgattctgcttaccggaggcgctatgctgtttctcatctccgggaagggaataggtaaaactagtatcggcttgatttgtgtgatcgcctctagcgggatgctgtggatggccgaaattcccttacaatggatcgcatccgctatagtcctagagttctttatgatggttctgctcattccagagcctgaaaagcagagaacaccgcaggataatcaacttgcctacgtggtaatcggaattctgaccttggcggctatcatagccgcaaacgagatgggcctgctcgaaaccacaaagagggacctgggtatgtcaaaagagcccggggtggtctctccaactagctatcttgatgtggacctccaccctgccagtgcttggacgctgtacgcagttgccaccacagtgatcactcccatgttgcggcataccattgaaaattccacagcgaacgtcagcctggctgccatcgcaaaccaggccgtagtgttaatgggcctagacaagggatggccaatttctaaaatggatctgggcgttcctctccttgctctggggtgctactcacaggtgaatcccttgaccctgactgccgcagtcctcctgcttatcacgcactatgctataattggaccgggcttacaggccaaggcgacacgcgaggcccaaaaaagaaccgcagctggtatcatgaagaacccaactgtggacgggatcatgaccattgatctggaccctgtcatctacgattccaagttcgagaaacagctcggacaggtgatgttgctggttctatgtgccgtgcagctgctccttatgaggacaagttgggcactgtgcgaagctttgactctggccaccggccccataacaacgctctgggagggtagcccaggcaagttttggaataccactattgccgtatcgatggcgaacatcttccgggggtcttatctggctggagcaggcttagccttttccattatgaaaagcgtggggacaggaaagcgaggcaccggttcacaaggggaaactcttggagagaaatggaagaagaaactgaatcagctcagtagaaaggaattcgacctatacaaaaagtctggcatcacagaggtcgatcgcaccgaggctaaagaaggtctgaagaggggcgagataacgcatcacgccgtttcccgggggagcgcaaaattgcagtggtttgtggaacgtaacatggtcatccccgagggaagagtgattgacctgggctgtgggaggggaggctggtcatattactgcgccggtctcaagaaggtaaccgaagtgcgcgggtatacaaaaggaggccctggccatgaggagccggttcccatgagtacttacgggtggaatatcgtgaagcttatgagcggaaaagatgtcttctacctgccacctgaaaagtgtgacaccttgctgtgcgatattggtgagtcctctcccagccctacagtggaagagtcccggactatccgagtcctcaaaatggtggagccatggttaaagaacaatcagttctgtattaaggttctgaacccctatatgcctaccgtaatcgaacaccttgagagactgcaaaggaaacacggcgggatgctagtgcgcaatccactctcacggaactctacacatgaaatgtactggataagtaatggaaccggcaacattgtcgcttcggtgaatatggttagcagactgttgctgaaccgttttactatgacgcacaggcggcccacaatcgagaaggacgtggatctcggtgcggggacccgccatgtcaacgccgaaccggagactcctaatatggacgtgatcggagagcgaattaaaagaataaaggaagagcacaactccacctggcactatgacgatgaaaatccatacaaaacatgggcatatcatggctcttacgaggtaaaggctacgggctcagccagctccatgatcaacggggtggttaagcttctgaccaaaccctgggacgtcgtgcctatggtgactcagatggcaatgacagataccactccattcggacagcaaagggtctttaaggaaaaagttgacacacggaccccccgcagtatgccgggtacaagaagggtgatgggcattactgccgagtggttatggcgaaccctggggcggaataagaaacctcgtttgtgcacgagagaggaattcaccaagaaggtacgcacaaacgctgccatgggagcggtgtttactgaggaaaatcagtgggattctgcaaaagccgctgtcgaggacgaagatttctggaagctcgtggacagggagcgggagctgcacaaactaggcaagtgtggtagctgcgtttataacatgatggggaaaagagaaaagaaacttggagagtttggcaaggccaagggctcacgcgcaatctggtacatgtggctgggggctaggtacctcgaattcgaggccctgggatttttgaatgaggatcattggttctcccgagaaaacagttatagcggtgtggagggcgaagggctgcacaaactcggatacattcttcgggacatctctaagatacccggcggtgctatgtatgccgatgacaccgcagggtgggacacaagaatcactgaggatgacctgcataatgaagagaaaattacccagcagatggatccagagcacaggcaattagcgaacgccatctttaagctgacgtaccagaataaagtcgtgaaggtacagcgccctacacccaccggaactgttatggacattatctcccgtaaggatcagcggggctcaggccaagtggggacatatggattgaacaccttcactaatatggaagctcagctcataagacagatggagggtgaaggcgtcctgagcaaagccgacctagagaacccacaccttcccgaaaagaaaattacccagtggctggagacaaagggggtggagaggctcaaacgcatggcaatctcgggagatgactgcgtggtcaagcctatcgatgaccgatttgctaacgccctgttggcattaaatgatatgggcaaggttcggaaagacattccacaatggcagccgtctaagggttggcatgattggcagcaggtgcccttctgtagtcaccatttccacgaactgataatgaaagacgggagaaagctcgtagtgccttgcaggccacaagacgagcttatcggacgcgccagaatttcccagggcgcgggctggagcctgcgggaaacggcttgtctagggaaagcctacgcacagatgtggtcactgatgtattttcacaggcgtgatctccgattggcctccaacgctatctgctctgccgtccccgtgcattgggttcctaccagccgcactacatggagtattcacgcacatcaccaatggatgaccactgaggacatgctgacagtgtggaatagagtctggatcgaagataacccatggatggaggacaagacccccgtgacgacatgggagaatgtaccttaccttggaaagcgggaagatcagtggtgtggttccctgataggcctcaccagcagggctacttgggcccagaacatcccgaccgcgattcagcaagttcgctctttaatcgggaatgaggaattcctggactacatgccatcaatgaaaagatttcggaaggaggaggaaagtgagggagctatttggtga

SEQ ID NO: 15106 - RNA, 9873 nt, synthetic construct
  misc_feature 1..9873: note = derived and/or modified CDS sequence (opt3) from DENV-3__JN406515__SS-prME
  source 1..9873: mol_type = other RNA
accagcctgtgcctcatgatgatgcttcccgccacactggctttccacttgacttcccgggacggagagcctagaatgatcgtggggaagaacgaacggggaaaatctttactgtttaagacggcctcaggtattaatatgtgtaccttaattgccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtggctctggcaccccacgtgggcatgggtttggataccagagcacagacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactggacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagctgatcgagggaaaagtggtccagcacgaaaatctcaagtatacagtgataattactgttcataccggtgaccagcaccaggtgggcaacgagacacaaggggtcaccgcagaaatcactccccaggcttccacggtggaggccattcttcctgaatacggaacactgggcttggagtgctctccacgaaccggtctcgactttaatgagatgatcctgctcactatgaaaaacaaggcgtggatggtacatagacagtggttctttgatctgccgcttccctggaccagcggggccacaaccgaaactcctacatggaataaaaaggagctgttggttacgttcaaaaacgcacacgctaagaagcaagaagtggtcgtgctcggctcccaggagggagccatgcacaccgctctgactggcgccacagaaatccagacctcagggggaacaagtatttttgcaggtcatttaaaatgtaggctgaagatggacaaactagagctcaagggcatgagctatgccatgtgctctaatgctttcgtcctgaaaaaggaggtgtccgaaactcagcacgggaccatacttatcaaggttgagtacaaaggagaagatgcgccatgtaagattcccttctcaacggaggacgagcaaggcaaagcacataacggtcggttgatcaccgccaaccctgtggtaacaaagaaagaagaaccagtcaatatagaagctgagcccccgtttggggaaagcaacattatcatcggcattggagataaggccctgaagatcaattggtacaaaaagggcagttctattgggaaaatgttcgaggcaactgcccgtggagctcgcagaatggccatactcggtgacaccgcatgggattttggctccgtagggggagttctgaacagccttggcaagatggtgcaccagatcttcggttcggcgtatacagctctgttttctggggtctcctggattatgaaaatcggcatcggagtgttgctcacttggattggcctaaattcaaagaacaccagtatgagcttctcctgcatagtaatcgggattatcacgttatacctgggagccgtggttcaggcagacatgggctgtgtcattaattggaagggtaaagagctaaagtgcgggtctggaatctttgtgacaaacgaagtgcatacctggactgagcagtataaattccaagccgatagccctaagaggctcgctacagccatagcaggcgcttgggaaaatggtgtctgtggcatccggtcaaccactcgaatggagaacctgctttggaaacagattgccaatgaattgaactacatcctgtgggagaataacattaagctcaccgttgtggtgggggacatcataggagtactggagcagggcaaacgcacattaacgccccagccaatggaactgaagtatagttggaagacctgggggaaagcgaagattgtcactgccgagacacaaaattccagctttatcattgatggacctaacacccccgaatgcccaaacgcttctagagcatggaatgtgtgggaggttgaagactacggcttcggtgtgtttacaactaacatctggcttaaattgagggagatgtatacccagctctgtgaccaccggctgatgtcagccgctgtcaaggatgagcgcgccgtgcacgcagacatggggtactggatagaaagtcagaaaaatggaagctggaagctagagaaggcgtccctgatcgaagttaaaacgtgcacatggcccaagtctcataccctctggtcgaacggcgtgctggagagcgatatgattatccctaaatcccttgccggtccaatttcacagcacaattacagaccgggctatcatactcaaaccgctgggccctggcacttgggaaagctggagttagacttcaactactgcgaaggcacaactgtagtcatcaccgagaattgtgggacaaggggacctagtctccgtacgaccactgtgtctggcaaactgatacacgaatggtgctgtcggagctgcacacttccacccctgcgatatatgggtgaggatgggtgttggtacggaatggaaattagacctatcaacgagaaggaggaaaatatggtgaagtccttggtctcagccggcagcggtaaagttgacaactttaccatgggcgtgctctgcctggcaatcctattcgaggaagtaatgagggggaagttcggcaagaagcatatgattgctggcgtgctgtttactttcgtcctcctgctttctgggcagatcacatggcgcgatatggcccggaccttgattatgataggatccaatgcaagtgacagaatgggcatgggtgtgacgtatctggccttaatcgctacttttaaaattcagccattcctcgcgctggggtttttccttaggaagctgaccagccgcgagaacctactcctgggagttggcttggccatggcaacaaccctgcaattacccgaagatgtggagcagatggctaatggcatcgccctcgggctgatggcccttaagctgattactcagtttgagacataccagttgtggaccgctctcgtctctctgatgtgttccaacacaatcttcactctaaccgtggcatggcgaacggccacactgatacttgcgggaatctcactctttccggtttgccaaagtagctcgatgcggaaaaccgactggctgcctatgactgtggctgccatgggtgtcccacccttgcctctgttcatattttccttaaaggataccctcaaacgtagatcttggcccctgaatgaaggcgtaatggcagtggggcttgttagcatcctggcctcaagtttgctcaggaacgacgtgccaatggctggacctctggtcgcaggcggtctactgattgcctgttatgtgatcacagggacttccgcggatcttaccgtagagaaggctgccgacgtgacgtgggaagaggaagcagagcagacaggagtctctcacaacctcatgataaccgttgacgatgacggcactatgcgcattaaagatgacgagacagaaaatatcctgaccgtgttgttaaagactgccctgctcatcgtgagcggcattttcccctactccataccagctacactgcttgtctggcatacctggcagaaacagacgcaacggtcaggggtgctgtgggatgttccgagccctcccgagactcagaaggccgaattggaggagggagtatacagaatcaagcagcagggtatttttggcaaaacccaagtgggggtcggagtgcagaaggaaggcgttttccacacaatgtggcatgtgaccaggggtgcagtcctaacatataacgggaaacgactggagccaaattgggctagtgtgaagaaagacctcatctcttacggaggcggctggcgcctgtccgcccagtggcaaaagggggaagaggtacaggtcattgcggtggaacccggaaagaaccctaaaaatttccagactatgccaggtatctttcagaccacgacaggcgagataggggccatcgcacttgatttcaagcccggaactagcggctcgcctattatcaaccgggagggtaaagttgtggggttatatggaaatggcgtcgtgaccaagaacggcgggtacgtttcaggaattgctcaaacaaatgccgaaccggacggtccaacccccgagctggaagaggaaatgtttaaaaagagaaacctcactatgatggatttgcaccctggctctgggaagaccaggaaatatctgccagctatcgtgcgtgaggcaataaagcgccggctcagaacactgattcttgcccccacgagggtcgtggccgctgagatggaagaggcgctgaaaggattgcctatccgataccagactaccgcaacaaagagtgaacacaccggcaaagagatcgtagacctaatgtgccatgccactttcacaatgcggctgctctccccggtgcgcgttcccaattataacttaattatcatggatgaagctcactttaccgacccagccagcatagcagccagaggttacatttctacgagggtcgggatgggagaggctgcggccatcttcatgactgcaacacctcccggcaccgctgatgcctttccacagagcaatgcacctattcaggacgaggaacgggacatccccgagcgatcctggaactcaggcaatgattggataaccgacttcgccgggaagactgtgtggtttgtgccaagtattaaggctggaaacgatatcgccaactgtctgaggaaaaatggtaagaaagtcatccaacttagccgcaagacattcgacaccgaataccagaaaacaaagctgaacgattgggactttgtagtgactacggatatttctgagatgggcgcgaatttcaaggcagacagggttatcgatccgcgtcggtgcctcaaacctgtgattttgaccgacgggcccgagagagtcatactggccggaccaatgcccgtgacagttgcttccgccgctcagaggcgcggccgagtgggtagaaaccctcagaaggaaaatgatcaatatatcttcactgggcagccactcaacaatgacgaggaccatgcacactggaccgaagccaaaatgctgcttgataacattaatacacccgagggcatcatccctgctctatttgaaccggagcgggagaagtcagccgcaattgacggagaatacaggctgaaaggcgagagtcgcaagaccttcgtcgaattgatgcgtagaggggatttaccagtgtggctggcgcataaagtagccagcgagggaataaagtatactgaccggaagtggtgctttgatggtgaaaggaacaatcagatcctcgaggagaacatggacgtggaaatttggacgaaagagggcgaaaagaaaaagctgcgcccccgatggcttgatgctagaacctactccgaccctctggccctcaaagagttcaaggattttgcagctgggcggaagtctatcgccttggacctggttacagaaattggaagggtcccctcgcacctagcacaccgcactagaaatgccctggataacctcgtgatgcttcataccagcgagcacggcggtagggcttatcggcatgcggtggaggaactgccagagacaatggaaaccttattgctgctcgggctgatgatccttctgactggcggagccatgctattcttgatatcaggcaaaggggtcggaaagacatccatcggtctgatttgtgttgtggcaagttctggcatgttatggatggctgacatccctctacagtggattgccagcgccatcgtactggagtttttcatgatggtgctccttatacccgagccagaaaaacaacgtacgcctcaggataatcagctggcatacgtcgtgattgggatcttgaccctggctgccattgttgcggctaacgagatgggactcctggaaactacaaagcgcgaccttggcatgtccaaagagccgggtgtggtctcacccacctcttatctcgacgtagatctgcacccagccagcgcatggaccttgtacgccgtggctacaactgttatcacgcctatgctgcgacacaccatagaaaatagtacagcaaacgtgtccttagccgcgatcgctaaccaagccgtcgtgctaatggggctggacaagggctggcccattagcaagatggatctcggagtcccacttctggcattgggctgctactctcaggtgaatcctctgactctcaccgccgctgttctgcttttagtgacacattatgccatcattgggcccggactgcaggcaaaagctaccagagaggcccagaagaggactgcggccggcatcatgaaaaacccgacggtagacggtataatgacaattgatctcgacccagtgatctacgattcaaagtttgagaaacaattggggcaggtcatgctgctagttctgtgtgcagtgcagctccttctgatgcggacctcctgggctttctgcgaagccttgactctggcaaccggacctatcacaactctctgggagggcagtcccggtaagttttggaataccacaattgctgtcagcatggccaacatcttccgcggctcgtatctggccggggcgggattagctttttctataatgaagtccgtgggcacggggaaaagaggaaccggcagccagggtgaaactcttggggagaagtggaaaaagaaactgaatcaactctcaaggaaggagttcgacctatacaaaaagagtggaattacagaggtagatcggaccgaggcaaaggaaggcctgaaacgaggtgagatcactcaccatgccgtgtctagaggctccgctaagttgcagtggttcgttgaacgcaacatggtgattccagaggggagggtcatcgacctgggatgtggcagagggggatggagctattactgcgccggcctcaaaaaggtgacagaagtccgtggttataccaaagggggacccggccacgaggagcctgtgccgatgtcaacgtacggctggaatatagttaaacttatgagtgggaaggatgtattttacctgcccccagaaaaatgtgacaccttgctgtgcgatatcggagagagctccccttctcccacagtggaagagagcagaactattagggtcctcaagatggtggagccttggttgaaaaacaatcagttctgtatcaaggttctgaacccatatatgcccaccgtgattgaacatcttgagcgcctgcagcggaaacacggtggcatgctagtccgaaatcctctctccagaaactcaacacacgaaatgtactggatctctaatgggactggaaacattgtgagttcggtaaatatggtgagcaggctgttgctgaaccgctttaccatgacatatcggagaccaaccatcgagaaggacgttgacctcggcgcaggtactcgtcatgtcaacgccgaacccgagacgccgaatatggatgtgataggggagaggattcggcgcatcaaggaggaacactcctctacatggcattacgacgatgaaaacccttataaaacctgggcttaccacggatcatatgaggtgaaggcgactggcagcgcctccagtatgatcaatggcgtcgttaaacttctgaccaagccatgggacgtggtacccacagtgacgcaaatggcaatgaccgatactacacctttcgggcagcagcgagtctttaaagaaaaggtggacaccagaactccaaagcccatgccgggaacaaggaaagttatggagattaccgctgagtggttatggcggacactgggtcgcaacaagagacctaggttgtgcactcgagaagagttcaccaaaaaggtgcggacgaatgccgcaatgggcgccgtctttaccgaagagaaccaatgggattctgctcgtgccgcggtggaagacgaggagttctggaaactcgtagatagagaacgcgagctgcacaagctagggaaatgtggaagctgcgtttacaatatgatgggcaagagggaaaagaaacttggtgagtttgggaaggcaaaaggatcacgggccatatggtacatgtggctgggcgctagatatctcgagttcgaagccctgggctttttgaacgaggaccattggttctcccgcgaaaatagttacagcggggtggagggagaaggtctgcacaagctcggctatatccttagggatatttctaaaatccccgggggagcaatgtacgctgacgacacagccggctgggatactcgaattaccgaggacgatctgcataacgaggaaaagatcacacagcagatggacccagagcaccggcagttagctaatgccatatttaagctgacttatcaaaacaaagtcgtgaaggtgcagagacctacccccaaaggtacggtcatggatatcatttccaggaaggaccagcgcgggtcaggacaggttggcacatacggcttgaataccttcactaacatggaagcacaactcatccgtcagatggagggggaaggagtgctgagcaaaacagatctagagaatccacatcttctggagaagaagattacccagtggctcgaaactaaaggtgtagagcggctgaagagaatggcgatctcgggcgacgattgcgtggtcaaacccatagacgataggttcgccaacgctttgttagccctgaacgacatggggaaggtgcgcaaagatattcctcagtggcaaccatctaagggatggcacgactggcagcaggttccgttttgtagtcaccatttccacgaactcatcatgaaggacggccgaaaacttgtggtcccctgccggcctcaggatgagctgatcggtagagcaaggatttcccaaggggctggatggagcctaaaggaaaccgcctgtctgggcaaagcatatgcccagatgtgggcgctcatgtactttcatcgcagagacttgcggctggcttcaaatgccatatgctccgcagtgccagtacactgggttcccacatctaggacgacctggagcatccacgcccatcaccagtggatgactacagaggatatgcttaccgtgtggaaccgtgtctggattgaggacaatccttggatggaagataaggctccagtgactacatgggaggacgttccctacctgggcaaacgagaagatcaatggtgtgggagtctcatcggattaacctcccgcgccacgtgggcacagaacattctgacagctatccaacaggtgagaagcctaataggtaatgaggagttcctggactatatgccttctatgaagcggtttaggaaggaagaggaatcagagggcgccatctggtga

SEQ ID NO: 15107 - RNA, 9873 nt, synthetic construct
  misc_feature 1..9873: note = derived and/or modified CDS sequence (opt3) from DENV-3__JN406514__SS-prME
  source 1..9873: mol_type = other RNA
accagcctgtgcctcatgatgatgcttcccgcaacactggctttccacttgacttccagagacggcgaacctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttctggaccttcccctgccttggaccagcggggcgacaaccgagaggccaacttggaatcggaaagaattgctcgtgacattcaagaacgcccatgcaaagaaacaagaggtcgtggtcctgggctcccaggaaggagctatgcacacggccttaaccggcgctactgagatccaaaattcagggggaacaagtatttttgccggtcacctgaagtgtcgtctaaaaatggataagctcgaactgaaaggcatgagctacgcaatgtgccttaacaccttcgtgttgaagaaagaggtttctgagacacagcatgggactatactgatcaaggtggaatacaagggagaggacgccccctgtaaaattcctttttccaccgaagatggccaaggtaaggctcacaacgggcgcctcatcacggcgaatccagtagtcaccaaaaaggaggagcccgtgaacatagaagcagagccgcctttcggcgaatcaaatattgttatcggaatcggcgacaaagccctgaagattaactggtataagaaagggagcagtatcggaaagatgttcgaggctacagccagaggtgcaaggcggatggccattcttggcgatactgcttgggactttgggtctgtgggaggcgtcctaaattccttgggtaaaatggtgcatcagatattcgggagcgcctacaccgcactcttttcgggcgtatcttggatcatgaagattggaatcggcgtgctgttaacatggatcgggctgaactccaaaaatacttcaatgagtttcagctgcattgttataggaatcattaccctatatctcggcgcggtcgtgcaggctgatatgggttgtgtgatcaactggaaggggaaggaactgaaatgcggatccggcatttttgtcacgaatgaggttcacacatggaccgagcagtacaagttccaagccgactctcccaaacgacttgcaactgccatcgctggtgcctgggaaaacggcgtgtgtgggatacgcagcacaaccagaatggagaatttgctgtggaagcagatcgcaaacgaactcaattatattctgtgggagaacaatatcaaattaactgtggtagtcggagataccattggcgtgctggaacaggggaagaggacacttacgccacagcctatggagttgaaatactcatggaagacctggggaaaggctaaaatcgttactgccgagacacaaaacagttcctttataattgacggccccaacaccccagaatgccccagcgcgtctcgggcctggaatgtgtgggaggtcgaagactatggtttcggggtgttttcaacaaacatctggctcaagctgcgcgaggtttacactcagagttgtgatcatagactaatgagcgctgcaattaaagacgaaagggccgtgcacgctgatatgggatactggatcgagtcccagaagaatggctcttggaaactggagaaggcctcgttcatagaagtaaagacctgcatctggcctaaaagccacacgctctggtccaacggtgtcctggagtcagacatgattatcccaaagagtcttgcaggcccgatttctcagcataatcaccgtcccgggtatcatacacaaaccgcgggaccttggcacttgggcaaactggaattagattttaactactgcgaggggactaccgtggtgatcacagagaattgtggaactcggggcccaagcctccgaaccacaacggtctccggtaagctgatacacgaatggtgctgtagatcatgcacccttccccctctgaggtatatgggggaggacggatgttggtacggcatggaaattcgcccaatcaacgagaaagaagagaatatggttaagagcttggtgtctgccggttccggcaaggtagataacttcactatgggggtgctctgcctggctatcctatttgaggaagtcatgcggggaaaattcggcaagaaacatatgattgccggggtgctgttcacatttgttctcctgcttagtggacagatcacctggagagacatggcacacactttgattatgataggcagcaatgcttctgataggatgggtatgggggtgacatatctggccttaatcgcaaccttcaagattcagccctttctcgccctgggattctttcttcgcaaactgacgtcccgagagaacctactcctgggcgtcggcttggctatggcgactaccctgcaattaccggaagacatcgagcagatggccaatgggattgcactcggactgatgacacttaagctgatcacccagttcgaaacttaccagttgtggacagctctcgtgtcactgacctgtagtaacacaatatttactctaaccgttgcctggcggacggccacactgatccttgctggtgtgagcctcctgcctttgtgccaatcgtcctctatgcgtaagaccgattggctgccaatgactgtcgcagccatgggcgtaccccctttacccctcttcatttttagcctgaaagacaccccaaagagaaggtcatggcctcttaatgagggggtgatggcggttggactggtgagtatcttggcttcctctctcctgcgcaacgatgtccccatggccggcccgctagtagccggtgggctgcttattgcctgttatgtaatcacaggaactagcgctgacctcaccgtggagaaagcagccgacgtcacgtgggaagaggaagcggagcagacaggcgtttcccataacctgatgataaccgtggatgacgatggcactatgcggattaaggacgatgaaacagagaatatcttgaccgtgttactgaaaactgctctcctgatcgtctcagggattttcccatacagcatacctgccacacttctggtgtggcacacctggcagaagcagacgcaaagaagtggagttttgtgggacgtaccctctccacccgagactcagaaagcagaactagaggaaggtgtgtacaggatcaagcagcagggcatttttgggaagacccaagtcggagtgggcgttcagaaagagggtgtgttccatacaatgtggcacgtcacccgaggggccgtgctgacacacaacggaaagcgcctcgagcctaattgggcttccgtgaagaaagatctgatcagctatggcggcgggtggcggctttcggcccagtggcaaaaaggagaagaggtccaggtgattgcagttgaaccaggtaaaaaccccaagaattttcagactatgcctggcatcttccagaccacgacaggggagataggagctatcgccttagacttcaaaccgggcacttcaggttctccaattatcaacagagaagggaaggtggtcggactgtacggcaatggcgtggttaccaaaaacgggggatatgtgagtggtattgcgcaaacaaatgccgagcccgatggccctaccccagagctcgaagaggaaatgtttaagaaaaggaacttgactatcatggacctgcatcccgggtccggaaagacccgtaagtacctccctgcaatagtccgcgaggctattaaacggagactgaggacacttatcctggccccgacgcgagtggtagctgcagaaatggaggaggccttgaagggcctacccatccggtatcagactaccgccacaaaaagcgaacacaccggtcgcgagattgtggatctgatgtgccatgctactttcacaatgagactcttatctccagttagggtccctaattacaacctgatcataatggacgaagcgcactttaccgatcccgcaagcattgccgctcgggggtatatctccacgcgagtgggaatgggcgaggccgcagccattttcatgactgctacaccacctggcaccgcggaagcctttccccagtcaaatgcaccaatccaggacgaggagagagacataccggaacgcagttggaacagcgggaatgagtggattaccgatttcgtgggaaagactgtctggtttgtaccttctatcaaagctggtaacgacatcgccaactgtcttaggaagaatggcaagaaagtgattcaactgtcccgtaagacattcgataccgaataccagaaaacacggctcaacgactgggattttgttgtgactacggacatctcagagatgggggcaaatttcaaggccgatagagtcattgaccccaggcgctgcttgaaaccagtgatactgaccgatggacccgagcgagttatcctcgctggccctatgccagtgacagccgcgagtgcagcccagagacggggtagggtcgggcgcaacccccagaaggaaaatgaccaatacatttttactggccagcctctgaacaatgatgaggaccatgctcactggaccgaagccaagatgcttctagacaacatcaatacaccggagggaatcattccagctctgttcgaacccgagcgtgagaaaagcgcagccatagatggcgaatatagattgaagggggagtcccggaaaaccttcgtggaattaatgaggcgcggagacctgcctgtatggctcgctcacaaggtggcctctgagggtatcaaatacactgatcgaaagtggtgctttgacggcgaaagaaacaatcagattctggaggagaacatggatgttgaaatctggacgaaagagggggaacggaagaaacttaggccccgctggctggacgcaagaacctattcggatccactcgcgttgaaagagttcaaggactttgccgctggaaggaaaagcattgccctggatctagtcacagaaatcggccgggtgccttcacatctggcacaccgtactcgcaatgctctcgacaaccttgtgatgctgcatacctccgagcacggtgggcgagcctacagacacgcagtcgaggaattacccgagacaatggaaaccttgctgctcctgggccttatgatactgctcactggaggcgccatgttgttcctgatcagtgggaagggaattggtaaaacatctatcggcttaatttgtgttatcgtgagctccgggatgctatggatggctgatgtaccactgcagtggatagcgtcagccattgtgctcgagtttttcatgatggtccttctgatccctgagccggaaaagcaaaggacgccccaggacaatcagttggcatatgtggttattggaatcctgaccctcgctgccatagtggccgcaaacgagatgggcctgcttgaaactacaaagcgggatctcggtatgtctaaagagccaggggtcgtaagccctaccagttacctggacgtggacttgcatcccgcttccgcctggaccctgtatgcggttgctacaactgtgatcacgccaatgttacgccacaccattgaaaatagcacagccaacgtctctctagcagccatcgctaaccaagcagtggtcctgatgggcctcgataagggatggcctatttcaaaaatggaccttggcgtgcccctgttggccctggggtgctactcccaggttaatccgctcactctgaccgcggctgtgcttttactggtaacacattacgccatcataggaccaggcctccaggcaaaggccaccagagaggctcagaaaaggactgccgcaggtattatgaagaaccctacggtggatgggatcatgacaatcgacttggatcccgtcatttatgacagtaagtttgagaaacaactgggacaggttatgctactggtgctctgtgctgtccagcttctgttgatgcggaccagctgggccctgtgcgaagcgctcactctggccaccggcccaatcacaactttatgggagggttcgcccggcaagttctggaataccacaatagcagtgtctatggctaacatttttcgagggtcctaccttgccggagcaggcctggctttcagcatcatgaaatcagtagggacgggaagacgcggcaccggtagtcagggggaaactctcggagagaagtggaaaaagaagctaaatcaactgtctaggaaagaatttgatttgtataagaaatccggcattacagaggtggaccggaccgaggccaaggaaggtctgaaacgtggcgagactacacaccatgccgttagcagagggtcagcgaagctccagtggttcgtggaaaggaacatggtcatccctgagggacgcgtgatagatcttggctgtgggcggggaggctggagttactattgcgctggtctgaaaaaggtcaccgaagtgcgagggtacacgaagggaggcccgggccacgaggagcccgttccaatgagcacctatgggtggaatatcgtaaaattgatgtccggaaaggacgtgttttacctgcctcccgaaaaatgtgatacactcttatgcgacattggtgagtctagcccttccccaactgtcgaagagtcaagaaccatcagggtgctgaagatggttgagccctggcttaaaaacaatcagttctgtattaaggtgctgaacccttacatgccaacagtcatcgaacacctagagcgcctccagcggaagtatggcgggatgctggtgagaaatcccttgtctcgtaacagtactcatgaaatgtactggatttcgaatggaaccggcaacatcgtaagctccgtgaatatggtttctaggctgctccttaaccggttcacaatgacccaccgccgaccgactatagagaaagatgtcgacctgggtgcagggacgagacatgtgaacgccgaacctgagacaccaaatatggacgtgattggagagaggatcaagcggatcaaagaggaacactcaagcacctggcactatgatgacgaaaacccctacaagacttgggcttatcatggctcctacgaggtcaaagccaccggcagtgcatctagcatgattaatggggttgtgaagttactgacaaagccttgggatgtagtgccaatggtcacgcaaatggccatgaccgacactacaccctttggacagcagcgcgtgttcaaagaaaaggttgataccagaactccgaggcctatgcccggtacacgaaaagtgatggagataaccgctgagtggttgtggcggacactcggccgtaacaagaaaccaagactgtgcactcgcgaagagtttaccaagaaggtcaggacgaatgcggccatgggggcagtgttcaccgaagagaaccaatgggactcagctcgggccgcagtagaagatgaggagttttggaagctggttgacagagaacgcgagcttcacaagctgggaaaatgtggctcctgcgtgtataatatgatgggtaagagggagaaaaagctcggggagttcggaaaagccaagggcagtcgagctatctggtacatgtggctgggcgcccggtacttggagtttgaagcgctggggttcctcaacgaggatcattggtttagcagagaaaattcttattccggagtcgagggtgaaggccttcacaagctggggtacattttaagggacatctcaaaaattcctggaggcgcaatgtatgccgatgacacagctggttgggacactcgcatcaccgaggatgacctgcataacgaggaaaagataacacagcagatggatcccgagcacaaacagttggccaatgcaatcttcaagctcacttaccaaaacaaagtggtgaaggtccagcgtccaacccccaaggggacggttatggacattatcagccggaaagatcagagaggatcgggccaggtgggcacatatgggctgaatacctttactaacatggaagctcagctagtaaggcagatggagggagaaggtgtgctttctaaggccgacctggagaatcctcacctcctggagaaaaagattacacagtggttggaaaccaaaggcgtcgagcgcttaaagcgaatggctatcagtggggatgactgcgtggttaagccaatagatgaccggttcgccaacgcactgctcgcgcttaacgatatgggaaaagtgagaaaggacattccgcagtggcaaccctccaaaggctggcatgattggcagcaggtccctttttgtagccaccatttccacgaactgatcatgaaggacggtaggaagctagtggtaccatgccgcccccaggacgagctgatcgggagagcccggatttcacaaggagctggctggtccctcaaggaaactgcctgtttgggcaaggcatacgctcagatgtggtctctgatgtatttccacaggcgtgatcttcgactggccagcaatgcaatatgcagtgccgttcctgtgcattgggtcccaacctcccgcacaacgtggagcatccacgcgcatcaccagtggatgaccactgaggacatgctcacagtgtggaacagagtttggattgaggataatccctggatggaagacaaaacccctgtgactacatgggaggatgtcccgtacttagggaagcgggaagaccaatggtgtggatctctgatcggtttgacctcaagggctacgtgggcccagaacattctgacagcaatccaacaggtgcgcagtctcataggcgatgaggagtttcttgactacatgccatccatgaaaagattccggaaggaagaggaaagcgagggggccatctggtga

SEQ ID NO: 15108 - RNA, 9873 nt, synthetic construct
  misc_feature 1..9873: note = derived and/or modified CDS sequence (opt3) from DENV-3__KT726340__SS-prME
  source 1..9873: mol_type = other RNA
accagcctgtgcctcatgatgatccttccagccgctctggcattccacttgacttccagagacggcgaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtgatcaccaaaaacgggggatatgtttctggtattgcacaaacaaatgctgaaccagacggccccacgcctgagttagaagaggaaatgttcaagaaaagaaacctgactatcatggatctccacccagggagtggaaagaccaggaaatacttgcccgccatagtgcgtgaggctattaagcgccggctgagaacactcatcctggcacctaccagggtcgtggccgccgagatggaagaggctcttaagggcctgccgatccgatatcagactacagcgaccaaatccgaacatacgggtcgggagattgtagacttgatgtgccacgcaacttttacaatgcgcctactgagccccgtgagagttccaaattacaacctcatcataatggatgaagcccatttcaccgaccctgcttctattgccgcaagggggtacatcagcacccgggtcggaatgggcgaggccgctgcgatttttatgactgccacacccccaggcaccgcagatgctttccctcagtccaatgcccccatccaggacgaggaacgagacataccagagagatcatggaacagtgggaatgaatggattacagattttgcaggaaagactgtgtggttcgtgccgagcatcaaagccggtaacgacatcgctaactgtttacgcaagaatggcaaaaaggtcattcaactgtctaggaagacgtttgataccgagtatcagaaaacaaaacttaacgactgggatttcgtagtgactaccgacatctccgagatgggggccaattttaaagcggatcgtgttattgaccctcggagatgcctgaagcccgtgatactcacagatggaccagaaagggtcatcttggcaggccccatgcctgtgaccgccgcttcagccgctcagcgccgaggtagagttgggcggaacccacagaaagagaatgaccaatacattttcactggccagcccctgaacaatgatgaagaccacgcacattggacggaggccaagatgctcctggacaacatcaatacccctgaaggaatcattccggctcttttcgagccagagagggaaaagagtgccgcaatagatggcgagtatcgcctaaaaggggaaagccgtaagacatttgtggagctgatgagacggggagacttgcccgtctggttagcgcacaaagtggcctccgaaggtatcaagtacactgataggaaatggtgcttcgacggccagcgcaacaatcagattctggaggagaacatggatgtagaaatctggaccaaggagggggagaagaagaagctccgacctagatggctggacgctcggacatattctgatccccttgccctgaaagagtttaaggacttcgcagctggaaggaaatcgattgccctcgatttggtgaccgaaatcggccgcgttccaagccacctggcacatagaactaggaatgccctagacaacctggtcatgctccacacatcagagcatggtgggaaggcttaccggcacgcggtggaggaacttcctgagacgatggaaaccctgttattgctgggcctcatgatactgcttactggaggcgccatgctgtttctcatctccgggaaaggaattggtaagacaagtatcggcttgatttgtgtgatcgcatctagcgggatgctgtggatggctgagatacccttacaatggattgcctccgccatcgtcctagagttctttatgatggttctgctcattccagaacctgagaagcagcgtaccccgcaggataatcaacttgcatatgtggtaatcggaatactgaccttggctgccatcattgcggctaacgaaatgggcctgctcgagacaactaaacgcgacctgggtatgtcaaaggaacccggggtggtctctccaacgagctaccttgatgtggacctccaccctgccagtgcatggaccctgtacgccgttgctacaactgtgatcacccccatgttgcgacatacaattgaaaattccaccgcaaacgtcagcctggccgcgatcgctaaccaggccgtagtgttaatgggcctagacaaaggatggccaatatctaagatggatctgggcgttcctctccttgcactggggtgctattcacaggtgaatcccttgactctgacggccgctgtcctcctgcttattacacactacgccatcatcggaccgggcttacaggcaaaagctaccagagaggcccaaaagaggactgcggccggtattatgaagaacccaaccgtggacgggatcatgacaatagatctggaccctgtcatttatgattccaaattcgagaagcagctcggacaggtgatgttgctggttctatgtgcagtgcagctgctccttatgcggacaagttgggctctgtgcgaggccttgaccctggcaacaggccccatcacgaccctctgggaaggtagcccaggcaaattttggaatactacaattgctgtatcgatggccaacatcttccgcgggtcttacctggccggagcgggcttagctttttccataatgaaaagcgtggggaccggaaaaagaggcactggttcacaaggggagacacttggagaaaagtggaagaaaaagctgaatcagctcagtaggaaagagttcgacctatataagaaatctggcatcaccgaggtcgatcggacggaagcaaaggagggtctgaaacgaggcgaaattacccatcacgccgtttccagagggagcgctaagttgcagtggtttgtggagcgcaacatggtcatccccgaaggaagggtgattgacctgggctgtgggcggggaggctggtcatactattgcgccggtctcaagaaagtaacagaggtgcgtgggtacactaagggaggccctggccatgaggaaccggttcccatgagtacctacgggtggaatatcgtgaaacttatgagcggaaaggatgtcttctatctgccacctgagaaatgtgacacattgctgtgcgatattggtgaatcctctcccagccctactgtggaggagtccagaaccatcagggtcctcaagatggtggaaccatggttaaagaacaatcagttctgtataaaagttctgaacccctacatgcctacagtagtggagcaccttgaacgcctgcaacggaagcacggcgggatgctagtccgaaatccactctcaagaaactctacccatgagatgtattggattagtaatggaactggcaacatcgtggcatcggttaatatggtgagcaggctgttgctgaaccgctttacgatgacacaccggagacccaccatcgaaaaagacgtcgatctcggtgccgggactcgtcatgtgaacgctgagccggagacccctaatatggacgtaattggagaaaggataaagcggatcaaagaggaacacaactccacatggcactacgacgatgagaatccatataagacgtgggcgtaccatggctcttatgaagtgaaggccaccggctcagcaagctccatgattaacggggttgtcaaacttctgactaagccctgggacgtggtgcctatggtcacacagatggctatgaccgatactacaccattcggacagcaacgcgtttttaaagagaaggtggacacccgaacacccagaagtatgccgggtactaggcgggtaatgggcatcaccgccgagtggttatggcgcacgctggggagaaataaaaagcctaggttgtgcacccgagaagagttcacaaagaaagtgcggactaacgcagccatgggagctgtctttaccgaagagaatcagtgggattctgccaaggcggcagtggaagacgaggatttctggaaactcgttgaccgtgagagagaactgcacaagctaggcaaatgtggtagctgcgtgtacaacatgatggggaagcgcgagaagaaacttggagaatttggcaaagccaaaggctcaagggctatttggtacatgtggctgggggcccggtatctcgagttcgaggcactgggatttttgaatgaagatcattggttctccagagagaacagttacagcggtgtcgaaggcgaggggctgcacaagctcggatatatccttcgcgacatatctaaaatccccggcggtgctatgtacgccgatgacacagctgggtgggacactaggattaccgaagatgacctgcataatgaggagaagatcacgcagcagatggatccagaacaccgacaattagccaacgcaatttttaaactgacatatcagaataaggtggtaaaggttcagcggcctacccccactggaacagtgatggacatcatatccagaaaagatcagaggggctcaggccaagtcgggacctacggattgaacactttcaccaatatggaggcgcagctcattcgccagatggaaggtgagggcgtgctgagcaaggccgacctagaaaacccacgtcttcccgagaaaaagatcacacagtggctggagacgaaaggggtggaacggctcaagagaatggctatctcgggagatgactgcgtcgttaagcctattgatgacaggtttgccaacgcactgttggctttaaatgatatgggcaaagtgcgcaaggacataccacaatggcagccgtctaaaggttggcacgattggcagcaggtacccttctgtagtcatcacttccatgagctgatcatgaaggacgggcgaaaactcgtggtcccttgccggccacaagacgaacttattggaagggccaggatctcccagggcgcaggctggagcctgcgcgagaccgcctgtctagggaaggcgtatgctcagatgtggtcactgatgtactttcacagacgggatctcaggttggcctccaacgcaatttgctctgccgtgcccgttcactgggtgcctactagccgtacaacctggagtatccatgctcaccatcaatggatgactacagaagacatgctgaccgtctggaatcgagtgtggatagaggataacccatggatggaggacaagacgcccatcacaacctgggaaaatgtaccttaccttggaaaacgcgaggatcagtggtgtggttccctgattggcctcactagcagagccacctgggcacagaacatcccgacagctattcagcaagttcggtctttaatcgggaatgaagagttcctggactatatgccatcaatgaagaggtttcgcaaagaggaagagagtgaaggagccatttggtga

SEQ ID NO: 15109 - RNA, 9873 nt, synthetic construct
  misc_feature 1..9873: note = derived and/or modified CDS sequence (opt3) from DENV-3__KT726345__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggtgttctttaccttcgttctactgctctccggacagattacgtggcgggatatggctcatactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatggcggtcgctgccatgggcgtaccccctctgcccttgtttattttctctctgaaggatactttaaaacgtagaagctggccactcaatgagggggtgatggcagttggactggtgtcaatccttgccagttccctgttgaggaacgacgtccctatggctggccccctcgtggcaggtgggctgctaattgcctgttatgtaatcaccggaacgtctgcggatctgacagtggaaaaggctgccgacataatttgggaggaagaggcagaacagaccggcgtcagccacaaccttatgatcactgttgacgatgacggcacaatgcgcatcaaagatgacgagaccgagaatattctcactgtgctgttgaagacagccttactgatagtgtccgggatctttccatactcaattccggctaccctcctggtctggcatacgtggcagaaacagactcaacggagcggagtgctttgggatgttcctagtcccccagaaacccagaaggccgagctggaagagggtgtatacagaatcaaacagcagggcattttcgggaagacacaagtgggagtcggcgtgcagaaggagggtgtttttcacaccatgtggcacgtgacaaggggggcagtcttgactcataacggaaaacgactagaacccaattgggcttctgtgaagaaagacctgatctcctatggcggcgggtggcgcctcagcgcccagtggcaaaagggagaggaagtacaggtcatagcggtggagcctggtaaaaacccaaagaatttccagaccatgcccggcacgttccagacaactaccggggaaatcggagccattgcactggattttaagcctggcacatcgggttcaccgatcattaaccgggaggggaaagttgtgggactttacggcaatggcgtcgtgaccaagaacgggggatatgtttctggtatcgctcaaactaatgccgagccagacggccccacccctgaattagaggaagagatgttcaaaaagagaaacctgacaataatggatctccacccagggagtggaaaaacgaggaagtacttgcccgctattgtgcgtgaagcaatcaagcgccggctgagaactctcatcctggcccctaccagggtcgtggccgctgagatggaggaagcgcttaaaggcctgccgattcgatatcagacaaccgcaactaagtccgagcatacaggtcgggaaatcgtagacttgatgtgccacgccacctttacgatgcgcctactgagccccgtgagagttccaaattacaacctcataattatggatgaggctcatttcactgaccctgcctctatcgcagccagggggtatattagcacacgggtcggaatgggcgaagctgcggccatctttatgaccgcaacccccccaggcactgctgatgccttccctcagtccaatgcacccatacaggacgaggagcgagacattccagaaagatcatggaacagtgggaatgagtggatcacagattttgccggaaaaaccgtgtggttcgtgccgagcatcaaggctggtaacgacattgccaactgtttacgcaaaaatggcaagaaggtcatccaactgtctaggaaaacatttgatactgaataccagaagacgaaacttaacgactgggatttcgtagtgaccacagacatttccgagatgggggcgaattttaaggcagatcgtgttatagaccctcggagatgcctgaaacccgtgatcctcactgatggaccagagagggtcattttggccggccccatgcctgtgaccgctgcctcagctgcacagcgccgaggtagagttgggcggaacccacagaaggaaaatgaccaatacatcttcacaggccagcccctgaacaatgatgaggaccacgcccactggaccgaagctaagatgctcctggacaacatcaatactcctgagggaattataccggcccttttcgaaccagagagggagaaaagtgcagcgatcgatggcgaatatcgcctaaagggggagagccgtaaaacgtttgtggaactgatgagacggggagacttgcccgtctggttagcccataaggtggcttccgagggtattaaatacaccgataggaagtggtgcttcgacggccagcgcaacaatcagatcctggaagagaacatggatgtagagatttggacaaaagaaggggagaagaagaaactccgacctagatggctggacgcccggacttattctgatccccttgcactgaaggaatttaaagacttcgctgccggaaggaagtcgatcgcactcgatttggtgaccgagataggccgcgttccaagccacctggcccatagaacaaggaatgctctagacaacctggtcatgctccacacctcagaacacggtgggcgggcgtaccgtcatgccgtggaggagcttcctgaaactatggagacactgttattgctgggcctcatgatcctgcttacgggaggcgcaatgctgtttctcatttccgggaaaggaatcggtaagaccagtattggcttgatctgtgtgatagcttctagcgggatgctgtggatggccgaaattcccttacaatggatcgcctccgcaattgtcctagagttctttatgatggttctgctcatcccagagcctgaaaagcagcgcactccgcaggataatcaacttgcttatgtggtaataggaatcctgacattggccgcgattatcgctgccaacgagatgggcctgctcgaaaccaccaaacgagacctgggtatgtcaaaggagcccggggtggtctctccaacaagctaccttgatgtggacctccaccctgcaagtgcctggactctgtatgctgttgcaacgaccgtgattacacccatgttgagacatactatcgaaaattccaccgccaacgtcagcctggcggctatagccaaccaggcagtagtgttaatgggcctagacaaaggatggccaatttctaagatggatctgggcgttcctctccttgccctggggtgctactcacaggtgaatcccttgacactgaccgctgccgtcctcctgcttatcactcactacgcaatcattggaccgggcttacaggctaaagccacgagggaggcgcaaaagcggacagccgcaggtatcatgaagaacccaaccgtggacgggataatgactattgatctggaccctgtcatctatgattccaaattcgagaagcagctcggacaggtgatgttgctggttctatgtgctgtgcagctgctccttatgcgcaccagttgggccctgtgcgaagcattgacactggctactggccccattaccacactctgggagggtagcccaggcaaattttggaatacgaccatcgccgtatcgatggccaacatattcagagggtcttacctggcgggagctggcttagcattttccatcatgaagagcgtggggactggaaaaaggggcacaggttcacaaggggaaacccttggagagaagtggaagaaaaagctgaatcagctcagtcggaaagaattcgacctatataagaaatctggcattactgaggtcgatcgaacagaggccaaggaaggtctgaaaagaggcgagatcacccatcacgctgtttcccgcgggagcgccaagttgcagtggtttgtggaaaggaacatggtcattcccgagggacgggtgatcgacctgggctgtgggcgtggaggctggtcatactattgcgcaggtctcaagaaagtaacggaagtgagagggtacaccaagggaggccctggccacgaggagccggttcccatgagtacatatgggtggaatattgtgaaacttatgagcggaaaggatgtcttctacctgccacctgaaaaatgtgacactttgctgtgcgatatcggtgagtcctctcccagccctaccgtggaagagtccaggacaatacgcgtcctcaagatggtggagccatggttaaagaacaatcagttctgtattaaagttctgaacccctacatgcctactgtaatcgaacatcttgagcggctgcaacgaaagcacggcgggatgctagtgagaaatccactctcaaggaactctacccatgaaatgtattggatcagtaatggaacaggcaacattgtcgcctcggtgaatatggttagccgcctgttgctgaaccggtttaccatgactcacagacgtcccacgatagagaaagacgtggatctcggtgctgggacaaggcacgtcaacgcggaaccggagacccctaatatggacgtgatcggagagcggattaagcgcatcaaagaagagcataactccacttggcactacgacgatgaaaatccatataagacctgggcctaccatggctcttatgaggtaaaggcaacaggctcagctagctccatgattaacggggtggttaaacttctgacgaagccctgggacgtcgtgcctatggtgacccagatggccatgactgatacaaccccattcggacagcaacgagtctttaaagaaaaggttgacactagaacacccaggagtatgccgggtacccggcgcgtgatgggcatcacagcagagtggttatggagaactctggggaggaataaaaagcctcgattgtgcacccgggaggaattcacgaagaaagtacgtaccaacgccgctatgggagccgtgtttacagaggaaaatcagtgggattctgcgaaggcagccgtcgaggacgaagatttctggaaactcgtggacagagagcgcgagctgcacaagctaggcaaatgtggtagctgcgtttacaacatgatggggaagagggaaaaaaagcttggagagtttggcaaggctaaaggctcacgggccatatggtatatgtggctgggggcaagatacctcgaattcgaggctctgggatttttgaatgaggatcattggttctcccgcgaaaacagttacagcggtgtggagggcgaagggctgcacaagctcggatatatccttagggacatttctaaaatccccggcggtgccatgtacgctgatgacactgccgggtgggacacccgaattacagaggatgacctgcacaatgaagagaagatcactcagcagatggatccagagcatcggcaattagcaaacgcgatatttaaactgacctatcagaataaggtcgtgaaggtacagagacctacgcccacaggaaccgttatggacattatctccaggaaagatcagcgcggctcaggccaagtggggacttacggattgaacacattcaccaatatggaagcccagctcatccgtcagatggagggtgaaggcgtcctgagcaaggctgacctagagaacccacaccttcccgaaaaaaagattactcagtggctggagaccaaaggggtggagcggctcaagagaatggccatatcgggagatgactgcgtggtcaagcctatcgatgacaggtttgcaaacgctctgttggccttaaatgatatgggcaaagttcgcaaggacattccacaatggcagccgtctaaaggttggcatgattggcagcaggtgcccttctgtagtcaccacttccatgaactgatcatgaaggacgggcgaaaactcgtagtgccttgccggccacaagacgagcttattggaagagcaaggatctcccagggcgccggctggagcctgcgcgaaacagcgtgtctagggaaggcttatgcccagatgtggtcactgatgtactttcacagacgggatctcaggttggcatccaacgccatatgctctgctgtccccgtgcattgggttcctacgagccgtaccacttggagtatccacgcccatcaccaatggatgacaaccgaggacatgctgactgtgtggaatcgagtctggattgaagataacccatggatggaggacaagacacccgtgaccacgtgggagaatgtaccttatcttggaaaacgcgaagatcagtggtgtggttccctgatcggcctcacaagcagagcaacctgggctcagaacattccgactgccatccagcaagttcggtctttaattgggaatgaggaattcctggactacatgccatcaatgaagaggtttcgcaaagaggaggaaagtgagggagcgatatggtga

SEQ ID NO: 15110 - RNA, 9873 nt, synthetic construct
  misc_feature 1..9873: note = derived and/or modified CDS sequence (opt3) from DENV-3__KT726349__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggtgttctttaccttcgttctactgctctccggacagattacgtggcgggatatggctcatactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatggcggtcgctgccatgggcgtaccccctctgcccttgtttattttctctctgaaggatactttaaaacgtagaagctggccactcaatgagggggtgatggcagttggactggtgtcaatccttgccagttccctgttgaggaacgacgtccctatggctggccccctcgtggcaggtgggctgctaattgcctgttatgtaatcaccggaacgtctgcggatctgacagtggaaaaggctgccgacataacctgggaggaagaggcagaacagactggcgtcagccacaaccttatgattacagttgacgatgacggcaccatgcgcatcaaagatgacgagactgagtccatcctcacagtgctgttgaagaccgccttactgattgtgtcagggatatttccatacagcatcccggctacgctcctggtctggcatacttggcagaaacagacccaacggagtggagtgctttgggatgttccttctcccccagaaacacagaaggccgagctggaagagggtgtatacagaattaaacagcagggcatcttcgggaagacccaagtgggagtcggcgtgcagaaggagggtgtttttcacacaatgtggcacgtgactaggggggcagtcttgacccataatggaaaacgactagaacccaactgggcttccgtgaagaaagacctgattagctatggcggcgggtggcgcctctcggcccagtggcaaaagggagaggaagtacaggtcatcgcggtggagcctggtaaaaatccaaagaacttccagacgatgcccggcacattccagactaccacaggggaaataggagccatcgcactggattttaagcctggcacctcaggttctccgattatcaatcgggaggggaaagttgtgggactttacggcaacggcgtcgtgactaagaatgggggatatgttagtggtattgctcaaaccaacgccgagccagacggccccacacctgaattagaggaagagatgttcaaaaagagaaatctgacgatcatggatctccacccagggtccggaaaaactaggaagtacttgcccgctatagtgcgtgaagcaattaagcgccggctgagaaccctcatcctggcccctacaagggtcgtggccgctgagatggaggaagcgcttaaaggcctgccgatccgatatcagaccactgcaacaaagagcgagcataccggtcgggaaattgtagacttgatgtgccacgccacgtttactatgcgcctactgtctcccgtgagagttccaaactacaatctcatcataatggatgaggctcatttcacagaccctgccagcattgcagccagggggtatatctccacccgggtcggaatgggcgaagctgcggccatttttatgaccgcaactcccccaggcacagctgatgccttccctcagtcaaacgcacccatccaggacgaggagcgagacataccagaaagaagttggaatagcgggaacgagtggattaccgattttgccggaaaaacagtgtggttcgtgccgtctatcaaggctggtaatgacatcgccaactgtttacgcaaaaacggcaagaaggtcattcaactgtccaggaaaacttttgatacggaataccagaagaccaaacttaatgactgggatttcgtagtgacaactgacatctcagagatgggggcgaactttaaggcagatcgtgttattgaccctcggagatgcctgaaacccgtgatactcaccgatggaccagagagggtcatcttggccggccccatgcctgtgacagctgccagtgctgcacagcgccgaggtagagttgggcggaatccacagaaggaaaacgaccaatacattttcaccggccagcccctgaataacgatgaggaccacgcccactggactgaagctaagatgctcctggacaatatcaacacgcctgagggaatcattccggcccttttcgaaccagagagggagaaaagcgcagcgatagatggcgaatatcgcctaaagggggagtcccgtaaaacctttgtggaactgatgagacggggagacttgcccgtctggttagcccataaggtggcttctgagggtatcaaatacacagataggaagtggtgcttcgacggccagcgcaataaccagattctggaagagaatatggatgtagagatctggactaaagaaggggagaagaagaaactccgacctagatggctggacgcccggacctattcggatccccttgcactgaaggaatttaaagacttcgctgccggaaggaagagcattgcactcgatttggtgacagagatcggccgcgttccatcacacctggcccatagaaccaggaacgctctagacaatctggtcatgctccacacttccgaacacggtgggcgggcgtaccgtcatgccgtggaggagcttcctgaaacaatggagacgctgttattgctgggcctcatgatactgcttaccggaggcgcaatgctgtttctcatcagtgggaaaggaattggtaagacttctatcggcttgatttgtgtgatcgctagctccgggatgctgtggatggccgaaatacccttacaatggattgcctcagcaatcgtcctagagttctttatgatggttctgctcattccagagcctgaaaagcagcgcacaccgcaggataaccaacttgcttatgtggtaatcggaatactgaccttggccgcgatcattgctgccaatgagatgggcctgctcgaaaccacaaaacgagacctgggtatgtctaaggagcccggggtggtcagcccaactagttaccttgatgtggacctccaccctgcatccgcctggacgctgtatgctgttgcaaccacagtgatcactcccatgttgagacataccattgaaaacagcacagccaatgtctctctggcggctatcgccaaccaggcagtagtgttaatgggcctagacaaaggatggccaatatcaaagatggatctgggcgttcctctccttgccctggggtgctactcccaggtgaaccccttgaccctgactgctgccgtcctcctgcttattacgcactacgcaatcatcggaccgggcttacaggctaaagccacaagggaggcgcaaaagcggaccgccgcaggtattatgaagaatccaactgtggacgggatcatgaccatagatctggaccctgtcatttatgatagtaaattcgagaagcagctcggacaggtgatgttgctggttctatgtgctgtgcagctgctccttatgcgcacaagctgggccctgtgcgaagcattgactctggctaccggccccatcacaacgctctgggagggttcgccaggcaaattttggaacaccactattgccgtatctatggccaatatcttcagagggtcctacctggcgggagctggcttagcatttagcataatgaagtcagtggggacaggaaaaaggggcaccggtagtcaaggggaaactcttggagagaagtggaagaaaaagctgaaccagctctctcggaaagaattcgacctatataagaaatccggcatcacagaggtcgatcgaaccgaggccaaggaaggtctgaaaagaggcgagattacgcatcacgctgttagccgcgggtcagccaagttgcagtggtttgtggaaaggaatatggtcatccccgagggacgggtgattgacctgggctgtgggcgtggaggctggagttactattgcgcaggtctcaagaaagtaaccgaagtgagagggtacacaaagggaggccctggccacgaggagccggttcccatgagcacttatgggtggaacatcgtgaaacttatgtccggaaaggatgtcttctacctgccacctgaaaaatgtgacaccttgctgtgcgatattggtgagtctagcccctcccctacagtggaagagtcaaggactatccgcgtcctcaagatggtggagccatggttaaagaataaccagttctgtataaaagttctgaatccctacatgcctaccgtaattgaacatcttgagcggctgcaacgaaagcacggcgggatgctagtgagaaacccactctctaggaatagtacacatgaaatgtattggatctcgaacggaaccggcaatatcgtcgccagcgtgaacatggtttcccgcctgttgctgaatcggtttactatgacgcacagacgtcccacaattgagaaagacgtggatctcggtgctgggaccaggcacgtcaacgcggaaccggagactcctaacatggacgtgataggagagcggatcaagcgcattaaagaagagcataattctacctggcactacgacgatgaaaacccatataagacatgggcctaccatggctcatatgaggtaaaggcaacgggcagcgcttccagtatgatcaatggggtggttaaacttctgaccaagccctgggacgtcgtgcctatggtgactcagatggccatgacagataccactccattcggacagcaacgagtctttaaagaaaaggttgacacaagaacccccaggtctatgccgggtacacggcgcgtgatgggcattactgcagagtggttatggagaaccctggggaggaacaaaaagcctcgattgtgcacgcgggaggaattcaccaagaaagtacgtacaaatgccgctatgggagccgtgtttactgaggaaaaccagtgggatagcgcgaaggcagccgtcgaggacgaagatttctggaaactcgtggacagagagcgcgagctgcacaagctaggcaaatgtggttcatgcgtttacaatatgatggggaagagggaaaaaaagcttggagagtttggcaaggctaaaggctcccgggccatctggtatatgtggctgggggcaagatacctcgaattcgaggctctgggatttttgaacgaggatcattggttcagtcgcgaaaatagctactctggtgtggagggcgaagggctgcacaagctcggatatatacttagggacatctccaaaattcccggcggtgccatgtacgctgatgacaccgccgggtgggacacacgaatcactgaggatgacctgcacaacgaagagaagattacccagcagatggatccagagcatcggcaattagcaaatgcgatctttaaactgacgtatcagaacaaggtcgtgaaggtacagagacctacacccaccggaactgttatggacataatttcaaggaaagatcagcgcggcagcggccaagtggggacatacggattgaataccttcactaacatggaagcccagctcatccgtcagatggagggtgaaggcgtcctgtcgaaggctgacctagagaatccacaccttcccgaaaaaaagatcacccagtggctggagacaaaaggggtggagcggctcaagagaatggccatttctggagatgactgcgtggtcaagcctatagatgacaggtttgcaaacgctctgttggccttaaacgatatgggcaaagttcgcaaggacatcccacaatggcagccgagtaaaggttggcatgattggcagcaggtgcccttctgttcccaccacttccatgaactgattatgaaggacgggcgaaaactcgtagtgccttgccggccacaagacgagcttatcggaagagcaaggattagccagggcgccggctggtcactgcgcgaaacggcgtgtctagggaaggcttatgcccagatgtggtccctgatgtactttcacagacgggatctcaggttggcatctaatgccatctgcagcgctgtccccgtgcattgggttcctaccagtcgtactacatggtccatacacgcccatcaccaatggatgaccactgaggacatgctgacagtgtggaaccgagtctggatcgaagataatccatggatggaggacaagacccccgtgacgacatgggagaacgtaccttatcttggaaaacgcgaagatcagtggtgtggtagcctgattggcctcacctctagagcaacttgggctcagaatatcccgaccgccattcagcaagttcggtcattaatcgggaacgaggaattcctggactacatgccaagtatgaagaggtttcgcaaagaggaggaatccgagggagcgatttggtga

SEQ ID NO: 15111 - RNA, 9873 nt, synthetic construct
  misc_feature 1..9873: note = derived and/or modified CDS sequence (opt3) from DENV-3__KT726347__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactggcgatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgttccctgtaaaatccctttctccaccgaggacggccaaggtaaggcgcataacgggcgtcttataacagcaaatccagtggtaactaaaaaggaggaacccgtcaacattgaggccgaaccgcctttcggcgagtcaaatatcgtgatcggaattggcgataacgctttgaaaatcaattggtataagaaggggagcagtattggaaaaatgtttgaagccaccgcacgcggtgccagaaggatggctatactgggcgacacagcctgggatttcgggtctgttggaggcgtgctcaactccctgggtaagatggtccaccagatctttgggagcgcatacactgcgcttttctcgggcgtgtcttgggtaatgaaaattggaatcggcgtgctgttgacctggatcgggctcaattccaagaacacgtcaatgagttttagctgcattgctataggaatcattacactgtatttaggcgccgttgtccaggcagacatgggttgtgtgatcaattggaaagggaaggagctgaagtgcggatccggcattttcgtgaccaacgaggtccatacttggacagaacagtacaaatttcaagccgattctcccaagcggctagctaccgccatcgcaggtgcttgggagaatggcgtttgtgggatacgaagcactacccgcatggaaaacctcctgtggaaacagatcgccaatgagcttaactatattttgtgggaaaataacatcaagctgacagtggtggtaggagacattatcggcgtcctcgagcaggggaaaagaacgctgaccccacagcctatggagttaaagtactcatggaaaacttggggaaaggcgaagatagtgacagccgaaacccaaaacagttccttcattatcgatggccccaatacaccagagtgccccagcgcttctagggcatggaacgtttgggaagtggaggactatggttttggggtcttcactaccaatatttggctgaaacttcgggaagtgtacacgcagttgtgtgaccaccgcctcatgtcagccgctgttaaggatgagagagccgtgcacgcagacatgggatactggatcgagagtcagaaaaacggcagctggaagctggaaaaagcgtccctaatagaggtaaagacatgcacctggcctaagtctcatactctgtggtcgaatggtgtcctcgaaagcgatatgatcattccaaaatccctggccggcccgatctcacagcacaaccataggcccgggtatcacacccaaacagctggaccttggcaccttggcaagttggagctggactttaattactgcgaggggactaccgtggtgattacagaaaactgtggaacgcgtggcccaagtttacggaccactacagtctctggtaaactcatccatgagtggtgctgtcgaagctgcaccctgccccctcttagatatatgggggaagatggatgttggtacggcatggagataaggccaatttccgaaaaggaggagaatatggttaaatcactggtgagcgccggttctggcaaggtagacaacttcactatgggggtgttgtgcctcgcaatcctgtttgaagaggtcatgcgcggaaagttcggcaaaaagcacatgatcgctggggtgttctttacattcgttctactgctctccggacagattacctggcgggatatggcccatacgctgatcatgattggcagtaatgcaagcgacagaatgggtatgggggtgacttatcttgccttgatagctacctttaaaatccagcccttcctggcgttaggatttttcctcaggaagctgacatctcgcgaaaaccttctgctaggcgtcggcctcgccatggcaaccactctgcaattgccggaggatattgaacagatggctaatgggatcgccctgggattaatggccctcaaactgattacacagtttgagacctaccagctttggacagctctgatctccttgacttgttcaaacaccatattcacgctcacagtggcatggcgaaccgccactctgatcctagcgggtgttagtctgcttcctgtgtgccaaagctcgtccatgcggaagaccgactggctcccaatggctgtcgccgcaatgggcgtaccccctctgcccttgtttattttctctctgaaggatacattaaaacgtagaagctggccactcaatgagggggtgatggccgttggactggtgtcaatccttgctagttccctgttgaggaacgacgtccctatggcaggccccctcgtggccggtgggctgctaattgcgtgttatgtaatcactggaacctctgctgatctgacggtggaaaaggccgcagacataacatgggaggaagaggccgaacagaccggcgtcagccacaaccttatgattactgttgacgatgacggcacaatgcgcatcaaagatgacgagaccgagaatatcctcactgtgctgttgaagacagctttactgattgtgtccgggatatttccatactcaatcccggccaccctcctggtctggcatacgtggcagaaacagactcaacggagcggagtgctttgggatgttcctagtcccccagaaacccagaaggcagagctggaagagggtgtatacagaattaaacagcagggcatcttcgggaagacacaagtgggagtcggcgtgcagaaggagggtgtttttcacaccatgtggcacgtgacaaggggggctgtcttgactcataacggaaaacgactagaacccaattgggcctctgtgaagaaagacctgatttcctatggcggcgggtggcgcctcagcgcgcagtggcaaaagggagaggaagtacaggtcatcgccgtggagcctggtaaaaacccaaagaatttccagaccatgcccggcacgttccagacaactaccggggaaataggagcaatcgctctggattttaagcctggcacatcgggttcaccgattatcaaccgggaggggaaagttgtgggactttacggcaatggcgtcgtgaccaagaacgggggatatgtttctggtattgcccaaactaatgctgagccagacggccccacccctgaattagaggaagagatgttcaaaaagagaaacctgacaatcatggatctccacccagggagtggaaaaacgaggaagtacttgcccgcaatagtgcgtgaagccattaagcgccggctgagaactctcatcctggcccctaccagggtcgtggctgcggagatggaggaagcacttaaaggcctgccgatccgatatcagacaaccgccactaagtccgagcatacaggtcgggaaattgtagacttgatgtgccacgctacctttacgatgcgcctactgagccccgtgagagttccaaattacaacctcatcataatggatgaggcccatttcactgaccctgcatctattgccgctagggggtatatcagcacacgggtcggaatgggcgaagcggccgcaatttttatgaccgctacccccccaggcactgccgatgcattccctcagtccaatgcccccatccaggacgaggagcgagacataccagaaagatcatggaacagtgggaatgagtggattacagattttgctggaaaaaccgtgtggttcgtgccgagcatcaaggccggtaacgacatcgcgaactgtttacgcaaaaatggcaagaaggtcattcaactgtctaggaaaacatttgatactgaataccagaagacgaaacttaacgactgggatttcgtagtgaccacagacatctccgagatgggggcaaattttaaggccgatcgtgttattgaccctcggagatgcctgaaacccgtgatactcactgatggaccagagagggtcatcttggctggccccatgcctgtgaccgccgcttcagcagcccagcgccgaggtagagttgggcggaacccacagaaggaaaatgaccaatacattttcacaggccagcccctgaacaatgatgaggaccacgctcactggaccgaagccaagatgctcctggacaacatcaatactcctgagggaatcattccggcacttttcgaaccagagagggagaaaagtgcggccatagatggcgaatatcgcctaaagggggagagccgtaaaacgtttgtggaactgatgagacggggagacttgcccgtctggttagctcataaggtggcctccgagggtatcaaatacaccgataggaagtggtgcttcgacggccagcgcaacaatcagattctggaagagaacatggatgtagagatctggacaaaagaaggggagaagaagaaactccgacctagatggctggacgcacggacttattctgatccccttgctctgaaggaatttaaagacttcgccgcaggaaggaagtcgattgccctcgatttggtgaccgagatcggccgcgttccaagccacctggctcatagaacaaggaatgcgctagacaacctggtcatgctccacacctcagaacacggtgggcgggcctaccgtcatgcagtggaggagcttcctgaaactatggagacactgttattgctgggcctcatgatactgcttacgggaggcgctatgctgtttctcatctccgggaaaggaattggtaagaccagtatcggcttgatttgtgtgatcgcctctagcgggatgctgtggatggccgaaatacccttacaatggattgcatccgctatcgtcctagagttctttatgatggttctgctcattccagagcctgaaaagcagcgcactccgcaggataatcaacttgcctatgtggtaatcggaatactgacattggcggctatcattgccgcaaacgagatgggcctgctcgaaaccaccaaacgagacctgggtatgtcaaaggagcccggggtggtctctccaacaagctaccttgatgtggacctccaccctgccagtgcttggactctgtatgcagttgccacgaccgtgatcacacccatgttgagacatactattgaaaattccaccgcgaacgtcagcctggctgccatcgcaaaccaggccgtagtgttaatgggcctagacaaaggatggccaatatctaagatggatctgggcgttcctctccttgctctggggtgctactcacaggtgaatcccttgacactgaccgccgcagtcctcctgcttattactcactacgctatcatcggaccgggcttacaggccaaagcgacgagggaggcccaaaagcggacagcagctggtattatgaagaacccaaccgtggacgggatcatgactatagatctggaccctgtcatttatgattccaaattcgagaagcagctcggacaggtgatgttgctggttctatgtgccgtgcagctgctccttatgcgcaccagttgggcactgtgcgaagctttgacactggccactggccccatcaccacactctgggagggtagcccaggcaaattttggaatacgaccattgccgtatcgatggcgaacatcttcagagggtcttacctggctggagcaggcttagccttttccataatgaagagcgtggggactggaaaaaggggcacaggttcacaaggggaaacccttggagagaagtggaagaaaaagctgaatcagctcagtcggaaagaattcgacctatataagaaatctggcatcactgaggtcgatcgaacagaggctaaggaaggtctgaaaagaggcgagattacccatcacgccgtttcccgcgggagcgcaaagttgcagtggtttgtggaaaggaacatggtcatccccgagggacgggtgattgacctgggctgtgggcgtggaggctggtcatactattgcgccggtctcaagaaagtaacggaagtgagagggtacaccaagggaggccctggccacgaggagccggttcccatgagtacatatgggtggaatatcgtgaaacttatgagcggaaaggatgtcttctacctgccacctgaaaaatgtgacactttgctgtgcgatattggtgagtcctctcccagccctaccgtggaagagtccaggacaatccgcgtcctcaagatggtggagccatggttaaagaacaatcagttctgtataaaagttctgaacccctacatgcctactgtaattgaacatcttgagcggctgcaacgaaagcacggcgggatgctagtgagaaatccactctcaaggaactctacccatgaaatgtattggatcagtaatggaacaggcaacatcgtcgcttcggtgaatatggttagccgcctgttgctgaaccggtttaccatgactcacagacgtcccacgattgagaaagacgtggatctcggtgcggggacaaggcacgtcaacgccgaaccggagacccctaatatggacgtgataggagagcggatcaagcgcattaaagaagagcataactccacttggcactacgacgatgaaaatccatataagacctgggcataccatggctcttatgaggtaaaggctacaggctcagccagctccatgatcaacggggtggttaaacttctgacgaagccctgggacgtcgtgcctatggtgacccagatggcaatgactgatacaaccccattcggacagcaacgagtctttaaagaaaaggttgacactagaacacccaggagtatgccgggtacccggcgcgtgatgggcattacagccgagtggttatggagaactctggggaggaataaaaagcctcgattgtgcacccgggaggaattcacgaagaaagtacgtaccaacgctgccatgggagcggtgtttacagaggaaaatcagtgggattctgcaaaggccgctgtcgaggacgaagatttctggaaactcgtggacagagagcgcgagctgcacaagctaggcaaatgtggtagctgcgtttacaacatgatggggaagagggaaaaaaagcttggagagtttggcaaggccaaaggctcacgggcaatctggtatatgtggctgggggctagatacctcgaattcgaggccctgggatttttgaatgaggatcattggttctcccgcgaaaacagttacagcggtgtggagggcgaagggctgcacaagctcggatatatacttagggacatctctaaaattcccggcggtgctatgtacgccgatgacactgcagggtgggacacccgaatcacagaggatgacctgcacaatgaagagaagattactcagcagatggatccagagcatcggcaattagcgaacgccatctttaaactgacctatcagaataaggtcgtgaaggtacagagacctacgcccacaggaaccgttatggacataatttccaggaaagatcagcgcggctcaggccaagtggggacttacggattgaacacattcaccaatatggaagctcagctcatccgtcagatggagggtgaaggcgtcctgagcaaggccgacctagagaacccacaccttcccgaaaaaaagatcactcagtggctggagaccaaaggggtggagcggctcaagagaatggcaatttcgggagatgactgcgtggtcaagcctatagatgacaggtttgctaacgccctgttggcattaaatgatatgggcaaagttcgcaaggacatcccacaatggcagccgtctaaaggttggcatgattggcagcaggtgcccttctgtagtcaccacttccatgaactgattatgaaggacgggcgaaaactcgtagtgccttgccggccacaagacgagcttatcggaagagccaggatttcccagggcgcgggctggagcctgcgcgaaacagcttgtctagggaaggcctatgcacagatgtggtcactgatgtactttcacagacgggatctcaggttggcctccaacgctatctgctctgccgtccccgtgcattgggttcctacgagccgtaccacttggagtatacacgcacatcaccaatggatgacaaccgaggacatgctgactgtgtggaatcgagtctggatcgaagataacccatggatggaggacaagacacccgtgaccacgtgggagaatgtaccttatcttggaaaacgcgaagatcagtggtgtggttccctgattggcctcacaagcagagctacctgggcccagaacatcccgactgcgattcagcaagttcggtctttaatcgggaatgaggaattcctggactacatgccatcaatgaagaggtttcgcaaagaggaggaaagtgagggagctatttggtga

SEQ ID NO: 15112 - RNA, 9873 nt, synthetic construct
  misc_feature 1..9873: note = derived and/or modified CDS sequence (opt3) from DENV-3__KT726352__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggtgttctttaccttcgttctactgctctccggacagattacgtggcgggatatggctcatactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatggcggtcgctgccatgggcgtaccccctctgcccttgtttattttctctctgaaggatactttaaaacgtagaagctggccactcaatgagggggtgatggcagttggactggtgtcaatccttgccagttccctgttgaggaacgacgtccctatggctggccccctcgtggcaggtgggctgctaattgcctgttatgtaatcaccggaacgtctgcggatctgacagtggaaaaggctgccgacataacctgggaggaagaggcagaacagactggcgtcagccacaaccttatgattacagttgacgatgacggcaccatgcgcatcaaagatgacgagactgagaatatcctcacagtgctgttgaagaccgccttactgattgtgtccgggatatttccatactcaatcccggctacgctcctggtctggcatacttggcagaaacagacccaacggagcggagtgctttgggatgttcctagtcccccagaaacacagaaggccgagctggaagagggtgtatacagaattaaacagcagggcatcttcgggaagacccaagtgggagtcggcgtgcagaaggagggtgtttttcacacaatgtggcacgtgactaggggggcagtcttgacccataacggaaaacgactagaacccaattgggcttctgtgaagaaagacctgatttcctatggcggcgggtggcgcctcagcgcccagtggcaaaagggagaggaagtacaggtcatcgcggtggagcctggtaaaaacccaaagaatttccagacgatgcccggcacattccagactaccacaggggaaataggagccatcgcactggattttaagcctggcacctcgggttcaccgattatcaaccgggaggggaaagttgtgggactttacggcaatggcgtcgtgactaagaacgggggatatgtttctggtattgctcaaaccaatgccgagccagacggccccacacctgaattagaggaagagatgttcaaaaagagaaacctgacgatcatggatctccacccagggagtggaaaaactaggaagtacttgcccgctatagtgcgtgaagcaattaagcgccggctgagaaccctcatcctggcccctacaagggtcgtggccgctgagatggaggaagcgcttaaaggcctgccgatccgatatcagaccactgcaacaaagtccgagcataccggtcgggaaattgtagacttgatgtgccacgccacgtttactatgcgcctactgagccccgtgagagttccaaattacaacctcatcataatggatgaggctcatttcacagaccctgcctctattgcagccagggggtatatcagcacccgggtcggaatgggcgaagctgcggccatttttatgaccgcaactcccccaggcacagctgatgccttccctcagtccaatgcacccatccaggacgaggagcgagacataccagaaagatcatggaacagtgggaatgagtggattaccgattttgccggaaaaacagtgtggttcgtgccgagcatcaaggctggtaacgacatcgccaactgtttacgcaaaaatggcaagaaggtcattcaactgtctaggaaaacttttgatacggaataccagaagaccaaacttaacgactgggatttcgtagtgacaactgacatctccgagatgggggcgaattttaaggcagatcgtgttattgaccctcggagatgcctgaaacccgtgatactcaccgatggaccagagagggtcatcttggccggccccatgcctgtgacagctgcctcagctgcacagcgccgaggtagagttgggcggaacccacagaaggaaaatgaccaatacattttcaccggccagcccctgaacaatgatgaggaccacgcccactggactgaagctaagatgctcctggacaacatcaatacgcctgagggaatcattccggcccttttcgaaccagagagggagaaaagtgcagcgatagatggcgaatatcgcctaaagggggagagccgtaaaacctttgtggaactgatgagacggggagacttgcccgtctggttagcccataaggtggcttccgagggtatcaaatacacagataggaagtggtgcttcgacggccagcgcaacaatcagattctggaagagaacatggatgtagagatctggactaaagaaggggagaagaagaaactccgacctagatggctggacgcccggacctattctgatccccttgcactgaaggaatttaaagacttcgctgccggaaggaagtcgattgcactcgatttggtgacagagatcggccgcgttccaagccacctggcccatagaaccaggaatgctctagacaacctggtcatgctccacacttcagaacacggtgggcgggcgtaccgtcatgccgtggaggagcttcctgaaacaatggagacgctgttattgctgggcctcatgatactgcttaccggaggcgcaatgctgtttctcatctccgggaaaggaattggtaagactagtatcggcttgatttgtgtgatcgcttctagcgggatgctgtggatggccgaaatacccttacaatggattgcctccgcaatcgtcctagagttctttatgatggttctgctcattccagagcctgaaaagcagcgcacaccgcaggataatcaacttgcttatgtggtaatcggaatactgaccttggccgcgatcattgctgccaacgagatgggcctgctcgaaaccacaaaacgagacctgggtatgtcaaaggagcccggggtggtctctccaactagctaccttgatgtggacctccaccctgcaagtgcctggacgctgtatgctgttgcaaccacagtgatcactcccatgttgagacataccattgaaaattccacagccaacgtcagcctggcggctatcgccaaccaggcagtagtgttaatgggcctagacaaaggatggccaatatctaagatggatctgggcgttcctctccttgccctggggtgctactcacaggtgaatcccttgaccctgactgctgccgtcctcctgcttattacgcactacgcaatcatcggaccgggcttacaggctaaagccacaagggaggcgcaaaagcggaccgccgcaggtattatgaagaacccaactgtggacgggatcatgaccatagatctggaccctgtcatttatgattccaaattcgagaagcagctcggacaggtgatgttgctggttctatgtgctgtgcagctgctccttatgcgcacaagttgggccctgtgcgaagcattgactctggctaccggccccatcacaacgctctgggagggtagcccaggcaaattttggaataccactattgccgtatcgatggccaacatcttcagagggtcttacctggcgggagctggcttagcattttccataatgaagagcgtggggacaggaaaaaggggcaccggttcacaaggggaaactcttggagagaagtggaagaaaaagctgaatcagctcagtcggaaagaattcgacctatataagaaatctggcatcacagaggtcgatcgaaccgaggccaaggaaggtctgaaaagaggcgagattacgcatcacgctgtttcccgcgggagcgccaagttgcagtggtttgtggaaaggaacatggtcatccccgagggacgggtgattgacctgggctgtgggcgtggaggctggtcatactattgcgcaggtctcaagaaagtaaccgaagtgagagggtacacaaagggaggccctggccacgaggagccggttcccatgagtacttatgggtggaatatcgtgaaacttatgagcggaaaggatgtcttctacctgccacctgaaaaatgtgacaccttgctgtgcgatattggtgagtcctctcccagccctacagtggaagagtccaggactatccgcgtcctcaagatggtggagccatggttaaagaacaatcagttctgtataaaagttctgaacccctacatgcctaccgtaattgaacatcttgagcggctgcaacgaaagcacggcgggatgctagtgagaaatccactctcaaggaactctacacatgaaatgtattggatcagtaatggaaccggcaacatcgtcgcctcggtgaatatggttagccgcctgttgctgaaccggtttactatgacgcacagacgtcccgctattgagaaagacgtggatctcggtgcggggacaaggcacgtcaacgccgaaccggagacccctaatatggacgtgataggagagcggatcaagcgcattaaagaagagcataactccacttggcactacgacgatgaaaatccatataagacctgggcataccatggctcttatgaggtaaaggctacaggctcagccagctccatgatcaacggggtggttaaacttctgacgaagccctgggacgtcgtgcctatggtgacccagatggcaatgactgatacaaccccattcggacagcaacgagtctttaaagaaaaggttgacactagaacacccaggagtatgccgggtacccggcgcgtgatgggcattacagccgagtggttatggagaactctggggaggaataaaaagcctcgattgtgcacccgggaggaattcacgaagaaagtacgtaccaacgctgccatgggagcggtgtttacagaggaaaatcagtgggattctgcaaaggccgctgtcgaggacgaagatttctggaaactcgtggacagagagcgcgagctgcacaagctaggcaaatgtggtagctgcgtttacaacatgatggggaagagggaaaaaaagcttggagagtttggcaaggccaaaggctcacgggcaatctggtatatgtggctgggggctagatacctcgaattcgaggccctgggatttttgaatgaggatcattggttctcccgcgaaaacagttacagcggtgtggagggcgaagggctgcacaagctcggatatatacttagggacatctctaaaattcccggcggtgctatgtacgccgatgacactgcagggtgggacacccgaatcacagaggatgacctgcacaatgaagagaagattactcagcagatggatccagagcatcggcaattagcgaacgccatctttaaactgacctatcagaataaggtcgtgaaggtacagagacctacgcccacaggaaccgttatggacataatttccaggaaagatcagcgcggctcaggccaagtggggacttacggattgaacacattcaccaatatggaagctcagctcatccgtcagatggagggtgaaggcgtcctgagcaaggccgacctagagaacccacaccttcccgaaaaaaagatcactcagtggctggagaccaaaggggtggagcggctcaagagaatggcaatttcgggagatgactgcgtggtcaagcctatagatgacaggtttgctaacgccctgttggcattaaatgatatgggcaaagttcgcaaggacatcccacaatggcagccgtctaaaggttggcatgattggcagcaggtgcccttctgtagtcaccacttccatgaactgattatgaaggacgggcgaaaactcgtagtgccttgccggccacaagacgagcttatcggaagagccaggatttcccagggcgcgggctggagcctgcgcgaaacagcttgtctagggaaggcctatgcacagatgtggtcactgatgtactttcacagacgggatctcaggttggcctccaacgctatctgctctgccgtccccgtgcattgggttcctacgagccgtaccacttggagtatacacgcacatcaccaatggatgacaaccgaggacatgctgactgtgtggaatcgagtctggatcgaagataacccatggatggaggacaagacacccgtgaccacgtgggagaatgtaccttatcttggaaaacgcgaagatcagtggtgtggttccctgattggcctcacaagcagagctacctgggcccagaacatcccgactgcgattcagcaagttcggtctttaatcgggaatgaggaattcctggactacatgccatcaatgaagaggtttcgcaaagaggaggaaagtgagggagctatttggtga

SEQ ID NO: 15113 - RNA, 9873 nt, synthetic construct
  misc_feature 1..9873: note = derived and/or modified CDS sequence (opt3) from DENV-3__KT726356__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggtgttctttaccttcgttctactgctctccggacagattacgtggcgggatatggctcatactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatggcggtcgctgccatgggcgtaccccctctgcccttgtttattttctctctgaaggatactttaaaacgtagaagctggccactcaatgagggggtgatggcagttggactggtgtcaatccttgccagttccctgttgaggaacgacgtccctatggctggccccctcctggcaggtgggctactgattgcctgttatgtgatcaccggaacgtctgcggatcttacagtagaaaaggctgccgacataacctgggaggaagaggcagaacagactggcgtgagccacaacctcatgattacagtcgacgatgacggcaccatgcgcatcaaagatgacgagactgagaatatcctgacagttttgttaaagaccgccctgctcattgtgtccgggatatttccatactcaatcccggctacgctgcttgtgtggcatacttggcagaaacagacccaacggagcggagtcctgtgggatgtgcctagtcccccagaaacacagaaggccgagttggaagagggtgtttacagaattaaacagcagggcatcttcgggaagacccaagtaggagtgggcgtccagaaggagggtgtgtttcacacaatgtggcacgttactaggggggcagtgctaacccataacggaaaacgactggaacccaattgggcttctgtcaagaaagacctcatttcctatggcggcgggtggcgcctgagcgcccagtggcaaaagggagaggaagtgcaggtaatcgcggtcgagcctggtaaaaacccaaagaatttccagacgatgcccggcacattccagactaccacaggggaaataggagccatcgcacttgattttaagcctggcacctcgggttcaccgattatcaaccgggaggggaaagtggttggattatacggcaatggcgtggtcactaagaacgggggatatgtgtctggtattgctcaaaccaatgccgagccagacggccccacacctgaactggaggaagagatgttcaaaaagagaaacctcacgatcatggatttgcacccagggagtggaaaaactaggaagtacctgcccgctatagttcgtgaagcaattaagcgccggctcagaaccctgatccttgcccctacaagggtggtcgccgctgagatggaggaagcgctgaaaggcttgccgatccgatatcagaccactgcaacaaagtccgagcataccggtcgggaaattgtggacctaatgtgccacgccacgtttactatgcgcctgctcagccccgtaagagtgccaaattacaacttaatcataatggatgaggctcatttcacagaccctgcctctattgcagccagggggtatatcagcacccgggttggaatgggcgaagctgcggccatttttatgaccgcaactcccccaggcacagctgatgccttccctcagtccaatgcacccatccaggacgaggagcgagacataccagaaagatcatggaacagtgggaatgagtggattaccgattttgccggaaaaacagtctggttcgtgccgagcatcaaggctggtaacgacatcgccaactgtctgcgcaaaaatggcaagaaggtgattcaactttctaggaaaacttttgatacggaataccagaagaccaaactgaacgactgggatttcgtcgtaacaactgacatctccgagatgggggcgaattttaaggcagatcgtgtgattgaccctcggagatgcctcaaacccgttatattgaccgatggaccagagagggtgatcctggccggccccatgcctgtcacagctgcctcagctgcacagcgccgaggtagagtggggcggaacccacagaaggaaaatgaccaatacattttcaccggccagcccctcaacaatgatgaggaccacgcccactggactgaagctaagatgctgcttgacaacatcaatacgcctgagggaatcattccggccctattcgaaccagagagggagaaaagtgcagcgatagatggcgaatatcgcctgaagggggagagccgtaaaacctttgttgaattgatgagacggggagacttacccgtgtggctggcccataaggtcgcttccgagggtatcaaatacacagataggaagtggtgcttcgacggccagcgcaacaatcagattctcgaagagaacatggatgtggagatctggactaaagaaggggagaagaagaaactgcgacctagatggcttgacgcccggacctattctgatcccctggcactcaaggaatttaaagacttcgctgccggaaggaagtcgattgcattggatctggtaacagagatcggccgcgtgccaagccacctagcccatagaaccaggaatgctctggacaacctcgttatgcttcacacttcagaacacggtgggcgggcgtaccgtcatgccgtcgaggagctgcctgaaacaatggagacgttattgctgctcggcctgatgatacttctgaccggaggcgcaatgctctttttgatctccgggaaaggaattggtaagactagtatcggcctgatttgtgtgatcgcttctagcgggatgttatggatggccgaaatacccctacaatggattgcctccgcaatcgtgctggagttctttatgatggtcctccttattccagagcctgaaaagcagcgcacaccgcaggataatcaactggcttatgttgtgatcggaatattgaccctggccgcgatcattgctgccaacgagatgggcctcctggaaaccacaaaacgagaccttggtatgtcaaaggagcccggggtagtgtctccaactagctacctcgatgtcgacctgcaccctgcaagtgcctggacgttgtatgctgtggcaaccacagttatcactcccatgctgagacataccattgaaaattccacagccaacgtgagcttagcggctatcgccaaccaggcagtcgtactaatgggcctggacaaaggatggccaatatctaagatggatctcggcgtgcctcttctggccttggggtgctactcacaggttaatcccctgaccctcactgctgccgtgctgcttttaattacgcactacgcaatcatcggaccgggcctgcaggctaaagccacaagggaggcgcaaaagcggaccgccgcaggtattatgaagaacccaactgtcgacgggatcatgaccatagatctcgaccctgtgatttatgattccaaattcgagaagcagttgggacaggtcatgctgctagtgctgtgtgctgttcagctccttctgatgcgcacaagttgggccttgtgcgaagcactgactctcgctaccggccccatcacaacgctgtgggagggtagcccaggcaaattttggaataccactattgccgtgtcgatggccaacatcttcagagggtcttacttagcgggagctggccttgcattttccataatgaagagcgtagggacaggaaaaaggggcaccggttcacaaggggaaactctgggagagaagtggaagaaaaagctcaatcagctaagtcggaaagaattcgacctgtataagaaatctggcatcacagaggtggatcgaaccgaggccaaggaaggtttgaaaagaggcgagattacgcatcacgctgtctcccgcgggagcgccaagctgcagtggtttgttgaaaggaacatggtgatccccgagggacgggtcattgacctcggctgtgggcgtggaggctggtcatactattgcgcaggtcttaagaaagtgaccgaagtaagagggtacacaaagggaggccctggccacgaggagccggtgcccatgagtacttatgggtggaatatcgttaaactgatgagcggaaaggatgtgttctacttgccacctgaaaaatgtgacaccctgctctgcgatattggtgagtcctctcccagccctacagtcgaagagtccaggactatccgcgtgttaaagatggtcgagccatggctgaagaacaatcagttctgtataaaagtgcttaacccctacatgcctaccgttattgaacatctggagcggctacaacgaaagcacggcgggatgctcgtaagaaatccactgtcaaggaactctacacatgaaatgtattggatcagtaatggaaccggcaacatcgtggcctcggtcaatatggtgagccgcttgctgctcaaccggtttactatgacgtacagacgtcccacaattgagaaagacgttgatcttggtgctgggaccaggcacgtgaacgcggaaccggagactcctaatatggacgtcataggagagcggatcaagcgcattaaagaagagcacaactccacctggcattatgacgatgaaaatccatacaagacatgggcctatcacggctcttacgaggtgaaggcaacgggctcagctagctccatgatcaacggggtagtgaaactgttaaccaagccctgggacgttgtccctatggtgactcagatggccatgacagataccactccattcggacagcaacgagtgtttaaagaaaaggtcgacacaagaacccccaggagtatgccgggtacacggcgcgttatgggcattactgcagagtggctgtggagaaccttggggaggaataaaaagcctcgactctgcacgcgggaggaattcaccaagaaagtgcgtacaaacgccgctatgggagccgtatttactgaggaaaatcagtgggattctgcgaaggcagccgtggaggacgaagatttctggaaactggtcgacagagagcgcgagctacataagcttggcaaatgtggtagctgcgtgtataacatgatggggaagagggaaaaaaagctgggagagtttggcaaggctaaaggctcacgggccatctggtacatgtggctcggggcaagatacctggaattcgaggctttgggatttctgaatgaggatcactggttctcccgcgaaaacagttatagcggtgttgagggcgaagggctccataagcttggatacatactgagggacatctctaaaattcccggcggtgccatgtatgctgatgacaccgccgggtgggacacacgaatcactgaggatgacttacacaatgaagagaagattacccagcagatggatccagagcaccggcaactggcaaacgcgatctttaaattgacgtaccagaataaggtggtcaaggtgcagagacctacacccaccggaactgtaatggacataatttccaggaaagatcagcgcggctcaggccaagttgggacatatggactcaacaccttcactaatatggaagcccagctgatccgtcagatggagggtgaaggcgtgctaagcaaggctgaccttgagaacccacatctgcccgaaaaaaagatcacccagtggctcgagacaaaaggggtcgagcggctgaagagaatggccatttcgggagatgactgcgtggtgaagcctatagatgacaggtttgcaaacgctttgttagccctgaatgatatgggcaaagtccgcaaggacatcccacaatggcagccgtctaaaggttggcacgattggcagcaggttcccttctgtagtcatcacttccacgaactcattatgaaggacgggcgaaaacttgtggtaccttgccggccacaagacgagctgatcggaagagcaaggatttcccagggcgccggctggagcctacgcgaaacggcgtgtctggggaaggcttacgcccagatgtggtcactcatgtattttcatagacgggatttgaggctggcatccaacgccatctgctctgctgtgcccgtccactgggtgcctaccagccgtactacatggagtatacatgcccaccatcaatggatgaccactgaggacatgcttacagtttggaatcgagtgtggatcgaagataacccatggatggaggacaagacccccgtcacgacatgggagaatgtgccttacctgggaaaacgcgaagatcagtggtgtggttccctcattggcttaaccagcagagcaacttgggctcagaacatcccgaccgccattcagcaagtacggtctctgatcgggaatgaggaattcttggactacatgccatcaatgaagaggtttcgcaaagaggaggaaagtgagggagcgatttggtga

SEQ ID NO: 15114 - RNA, 9873 nt, synthetic construct
  misc_feature 1..9873: note = derived and/or modified CDS sequence (opt3) from DENV-3__KT726342__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggtgttctttaccttcgttctactgctctccggacagattacgtggcgggatatggctcatactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatggcggtcgctgccatgggcgtaccccctctgcccttgtttattttctctctgaaggatactttaaaacgtagaagctggccactcaatgagggggtgatggcagttggactggtgtcaatccttgccagttccctgttgaggaacgacgtccctatggctggccccctcgtggcaggtgggctgctaattgcctgttatgtaatcaccggaacgtctgcggatctgacagtggaaaaggctgccgacataacctgggaggaagaggcagaacagactggcgtcagccacaaccttatgattacagttgacgatgacggcaccatgcgcatcaaagatgacgagactgagaatatcctcacagtgctgttgaagaccgccttactgattgtgtccgggatatttccatactcaatcccggctacgctcctggtctggcatacttggcagaaacagacccaacggagcggagtgctttgggatgttcctagtcccccagaaacacagaaggccgagctggaagagggtgtatacagaattaaacagcagggcatcttcgggaagacccaagtgggagtcggcgtgcagaaggagggtgtttttcacacaatgtggcacgtgactaggggggcagtcttgacccataacggaaaacgactagaacccaattgggcttctgtgaagaaagacctgatttcctatggcggcgggtggcgcctcagcgcccagtggcaaaagggagaggaagtacaggtcatcgcggtggagcctggtaaaaacccaaagaatttccagacgatgcccggcacattccagactaccacaggggaaataggagccatcgcactggattttaagcctggcacctcgggttcaccgattatcaaccgggaggggaaagttgtgggactttacggcaatggcgtcgtgactaagaacgggggatatgtttctggtattgctcaaaccaatgccgagccagacggccccacacctgaattagaggaagagatgttcaaaaagagaaacctgacgatcatggatctccacccagggagtggaaaaactaggaagtacttgcccgctatagtgcgtgaagcaattaagcgccggctgagaaccctcatcctggcccctacaagggtcgtggccgctgagatggaggaagcgcttaaaggcctgccgatccgatatcagaccactgcaacaaagtccgagcataccggtcgggaaattgtagacttgatgtgccacgccacgtttactatgcgcctactgagccccgtgagagttccaaattacaacctcatcataatggatgaggctcatttcacagaccctgcctctattgcagccagggggtatatcagcacccgggtcggaatgggcgaagctgcggccatttttatgaccgcaactcccccaggcacagctgatgccttccctcagtccaatgcacccatccaggacgaggagcgagacataccagaaagatcatggaacagtgggaatgagtggattaccgattttgccggaaaaacagtgtggttcgtgccgagcatcaaggctggtaacgacatcgccaactgtttacgcaaaaatggcaagaaggtcattcaactgtctaggaaaacttttgatacggaataccagaagaccaaacttaacgactgggatttcgtagtgacaactgacatctccgagatgggggcgaattttaaggcagatcgtgttattgaccctcggagatgcctgaaacccgtgatactcaccgatggaccagagagggtcatcttggccggccccatgcctgtgacagctgcctcagctgcacagcgccgaggtagagttgggcggaacccacagaaggaaaatgaccaatacattttcaccggccagcccctgaacaatgatgaggaccacgcccactggactgaagctaagatgctcctggacaacatcaatacgcctgagggaatcattccggcccttttcgaaccagagagggagaaaagtgcagcgatagatggcgaatatcgcctaaagggggagagccgtaaaacctttgtggaactgatgagacggggagacttgcccgtctggttagcccataaggtggcttccgagggtatcaaatacacagataggaagtggtgcttcgacggccagcgcaacaatcagattctggaagagaacatggatgtagagatctggactaaagaaggggagaagaagaaactccgacctagatggctggacgcccggacctattctgatccccttgcactgaaggaatttaaagacttcgctgccggaaggaagtcgattgcactcgatttggtgacagagatcggccgcgttccaagccacctggcccatagaaccaggaatgctctagacaacctggtcatgctccacacttcagaacacggtgggcgggcgtaccgtcatgccgtggaggagcttcctgaaacaatggagacgctgttattgctgggcctcatgatactgcttaccggaggcgcaatgctgtttctcatctccgggaaaggaattggtaagactagtatcggcttgatttgtgtgatcgcttctagcgggatgctgtggatggccgaaatacccttacaatggattgcctccgcaatcgtcctagagttctttatgatggttctgctcattccagagcctgaaaagcagcgcacaccgcaggataatcaacttgcttatgtggtaatcggaatactgaccttggccgcgatcattgctgccaacgagatgggcctgctcgaaaccacaaaacgagacctgggtatgtcaaaggagcccggggtggtctctccaactagctaccttgatgtggacctccaccctgcaagtgcctggacgctgtatgctgttgcaaccacagtgatcactcccatgttgagacataccattgaaaattccacagccaacgtcagcctggcggctatcgccaaccaggcagtagtgttaatgggcctagacaaaggatggccaatatctaagatggatctgggcgttcctctccttgccctggggtgctactcacaggtgaatcccttgaccctgactgctgccgtcctcctgcttattacgcactacgcaatcatcggaccgggcttacaggctaaagccacaagggaggcgcaaaagcggaccgccgcaggtattatgaagaacccaactgtggacgggatcatgaccatagatctggaccctgtcatttatgattccaaattcgagaagcagctcggacaggtgatgttgctggttctatgtgctgtgcagctgctccttatgcgcacaagttgggccctgtgcgaagcattgactctggctaccggccccatcacaacgctctgggagggtagcccaggcaaattttggaataccactattgccgtatcgatggccaacatcttcagagggtcttacctggcgggagctggcttagcattttccataatgaagagcgtggggacaggaaaaaggggcaccggttcacaaggggaaactcttggagagaagtggaagaaaaagctgaatcagctcagtcggaaagaattcgacctatataagaaatctggcatcacagaggtcgatcgaaccgaggccaaggaaggtctgaaaagaggcgagattacgcatcacgctgtttcccgcgggagcgccaagttgcagtggtttgtggaaaggaacatggtcatccccgagggacgggtgattgacctgggctgtgggcgtggaggctggtcatactattgcgcaggtctcaagaaagtaaccgaagtgagagggtacacaaagggaggccctggccacgaggagccggttcccatgagtacttatgggtggaatatcgtgaaacttatgagcggaaaggatgtcttctacctgccacctgaaaaatgtgacaccttgctgtgcgatattggtgagtcctctcccagccctacagtggaagagtccaggactatccgcgtcctcaagatggtggagccatggttaaagaacaatcagttctgtataaaagttctgaacccctacatgcctaccgtaattgaacatcttgagcggctgcaacgaaagcacggcgggatgctagtgagaaatccactctcaaggaactctacacatgaaatgtattggatcagtaatggaaccggcaacatcgtcgcctcggtgaatatggttagccgcctgttgctgaaccggtttactatgacgcacagacgtcccacaattgagaaagacgtggatctcggtgctgggaccaggcacgtcaacgcggaaccggagactcctaatatggacgtgataggagagcggatcaagcgcattaaagaagagcataactccacctggcactacgacgatgaaaatccatataagacatgggcctaccatggctcttatgaggtaaaggcaacgggctcagctagctccatgatcaacggggtggttaaacttctgaccaagccctgggacgtcgtgcctatggtgactcagatggccatgacagataccactccattcggacagcaacgagtctttaaagaaaaggttgacacaagaacccccaggagtatgccgggtacacggcgcgtgatgggcattactgcagagtggttatggagaaccctggggaggaataaaaagcctcgattgtgcacgcgggaggaattcaccaagaaagtacgtacaaacgccgctatgggagccgtgtttactgaggaaaatcagtgggattctgcgaaggcagccgtcgaggacgaagatttctggaaactcgtggacagagagcgcgagctgcacaagctaggcaaatgtggtagctgcgtttacaacatgatggggaagagggaaaaaaagcttggagagtttggcaaggctaaaggctcacgggccatctggtatatgtggctgggggcaagatacctcgaattcgaggctctgggatttttgaatgaggatcattggttctcccgcgaaaacagttacagcggtgtggagggcgaagggctgcacaagctcggatatatacttagggacatctctaaaattcccggcggtgccatgtacgctgatgacaccgccgggtgggacacacgaatcactgaggatgacctgcacaatgaagagaagattacccagcagatggatccagagcatcggcaattagcaaacgcgatctttaaactgacgtatcagaataaggtcgtgaaggtacagagacctacacccaccggaactgttatggacataatttccaggaaagatcagcgcggctcaggccaagtggggacatacggattgaacaccttcactaatatggaagcccagctcatccgtcagatggagggtgaaggcgtcctgagcaaggctgacctagagaacccacaccttcccgaaaaaaagatcacccagtggctggagacaaaaggggtggagcggctcaagagaatggccatttcgggagatgactgcgtggtcaagcctatagatgacaggtttgcaaacgctctgttggccttaaatgatatgggcaaagttcgcaaggacatcccacaatggcagccgtctaaaggttggcatgattggcagcaggtgcccttctgtagtcaccacttccatgaactgattatgaaggacgggcgaaaactcgtagtgccttgccggccacaagacgagcttatcggaagagcaaggatttcccagggcgccggctggagcctgcgcgaaacggcgtgtctagggaaggcttatgcccagatgtggtcactgatgtactttcacagacgggatctcaggttggcatccaacgccatctgctctgctgtccccgtgcattgggttcctaccagccgtactacatggagtatacacgcccatcaccaatggatgaccactgaggacatgctgacagtgtggaatcgagtctggatcgaagataacccatggatggaggacaagacccccgtgacgacatgggagaatgtaccttatcttggaaaacgcgaagatcagtggtgtggttccctgattggcctcaccagcagagcaacttgggctcagaacatcccgaccgccattcagcaagttcggtctttaatcgggaatgaggaattcctggactacatgccatcaatgaagaggtttcgcaaagaggaggaaagtgagggagcgatttggtga

SEQ ID NO: 15115 - RNA, 9873 nt, synthetic construct
  misc_feature 1..9873: note = derived and/or modified CDS sequence (opt3) from DENV-3__KT726343__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgcttctagggcatggaacgtgtgggaagttgaggactatggttttggggtgttcaccacgaatatttggctgaaacttcgggaagtctacacacagttgtgtgaccaccgcctcatgtcagccgctgtgaaggatgagagagccgttcacgcagacatgggatactggatcgagagtcagaaaaacggcagctggaagctggaaaaagcgtccctaatagaggtgaagacctgcacttggcctaagtctcataccctgtggtcgaatggtgtactcgaaagcgatatgatcattccaaaatccctggccggcccgatctcacagcacaaccataggcccgggtatcacacacaaactgctggaccttggcaccttggcaagttggagctggactttaattactgcgaggggaccacagtcgtgattacggaaaactgtggaacccgtggcccaagtttacggactacaaccgtgtctggtaaactcatccatgagtggtgctgtcgaagctgcactctgccccctcttagatatatgggggaagatggatgttggtacggcatggagataaggccaatttccgaaaaggaggagaatatggtcaaatcactggttagcgccggttctggcaaggtggacaacttcacaatgggggtattgtgcctcgcaatcctgtttgaagaggtgatgcgcggaaagttcggcaaaaagcacatgatcgctggggtcttctttaccttcgtgctactgctctccggacagattacgtggcgggatatggcccatactctgatcatgattggcagtaatgcaagcgacagaatgggtatgggggttacctatcttgccttgatagctacatttaaaatccagcccttcctggcgttaggatttttcctcaggaagctgacctctcgcgaaaaccttctgctaggcgtgggcctcgccatggcaactacactgcaattgccggaggatattgaacagatggctaatgggatcgccctgggattaatggccctcaaactgattacccagtttgagacataccagctttggactgctctgatctccttgacctgttcaaacacgatattcacactcaccgtcgcatggcgaactgccaccctgatcctagcgggtgtgagtctgcttcctgtttgccaaagctcgtccatgcggaagacagactggctcccaatggctgtggccgcaatgggcgtcccccctctgcccttgtttattttctctctgaaggatactttaaaacgtagaagctggccactcaatgagggggtaatggccgtgggactggtttcaatccttgctagttccctgttgaggaacgacgtgcctatggcaggccccctcgtcgccggtgggctgctaattgcgtgttatgtgatcaccggaacgtctgctgatctgacagtagaaaaggccgcagacataacctgggaggaagaggccgaacagactggcgtgagccacaaccttatgattacagtcgacgatgacggcaccatgcgcatcaaagatgacgagactgagaatatcctcacagttctgttgaagaccgctttactgattgtgtccgggatatttccatactcaatcccggccacgctcctggtgtggcatacttggcagaaacagacccaacggagcggagtcctttgggatgtgcctagtcccccagaaacacagaaggcagagctggaagagggtgtttacagaattaaacagcagggcatcttcgggaagacccaagtaggagtgggcgtccagaaggagggtgtgtttcacacaatgtggcacgttactaggggggctgtgttgacccataacggaaaacgactagaacccaattgggcctctgtcaagaaagacctgatttcctatggcggcgggtggcgcctcagcgcgcagtggcaaaagggagaggaagtgcaggtaatcgccgtcgagcctggtaaaaacccaaagaatttccagacgatgcccggcacattccagactaccacaggggaaataggagcaatcgctctggattttaagcctggcacctcgggttcaccgattatcaaccgggaggggaaagtggttggactttacggcaatggcgtggtcactaagaacgggggatatgtgtctggtattgcccaaaccaatgctgagccagacggccccacacctgaattagaggaagagatgttcaaaaagagaaacctgacgatcatggatctccacccagggagtggaaaaactaggaagtacttgcccgcaatagttcgtgaagccattaagcgccggctgagaaccctcatcctggcccctacaagggtggtcgctgcggagatggaggaagcacttaaaggcctgccgatccgatatcagaccactgccacaaagtccgagcataccggtcgggaaattgtggacttgatgtgccacgctacgtttactatgcgcctactgagccccgtaagagtgccaaattacaacctcatcataatggatgaggcccatttcacagaccctgcatctattgccgctagggggtatatcagcacccgggttggaatgggcgaagcggccgcaatttttatgaccgctactcccccaggcacagccgatgcattccctcagtccaatgcccccatccaggacgaggagcgagacataccagaaagatcatggaacagtgggaatgagtggattaccgattttgctggaaaaacagtctggttcgtgccgagcatcaaggccggtaacgacatcgcgaactgtttacgcaaaaatggcaagaaggtgattcaactgtctaggaaaacttttgatacggaataccagaagaccaaacttaacgactgggatttcgtcgtaacaactgacatctccgagatgggggcaaattttaaggccgatcgtgtgattgaccctcggagatgcctgaaacccgttatactcaccgatggaccagagagggtgatcttggctggccccatgcctgtcacagccgcttcagcagcccagcgccgaggtagagtggggcggaacccacagaaggaaaatgaccaatacattttcaccggccagcccctgaacaatgatgaggaccacgctcactggactgaagccaagatgctcctggacaacatcaatacgcctgagggaatcattccggcacttttcgaaccagagagggagaaaagtgcggccatagatggcgaatatcgcctaaagggggagagccgtaaaacctttgttgaactgatgagacggggagacttgcccgtgtggttagctcataaggtcgcctccgagggtatcaaatacacagataggaagtggtgcttcgacggccagcgcaacaatcagattctggaagagaacatggatgtggagatctggactaaagaaggggagaagaagaaactccgacctagatggctggacgcacggacctattctgatccccttgctctgaaggaatttaaagacttcgccgcaggaaggaagtcgattgccctcgatttggtaacagagatcggccgcgtgccaagccacctggctcatagaaccaggaatgcgctagacaacctggttatgctccacacttcagaacacggtgggcgggcctaccgtcatgcagtcgaggagcttcctgaaacaatggagacgctgttattgctgggcctcatgatactgcttaccggaggcgctatgctgtttctcatctccgggaaaggaattggtaagactagtatcggcttgatttgtgtgatcgcctctagcgggatgctgtggatggccgaaatacccttacaatggattgcatccgctatcgtgctagagttctttatgatggtcctgctcattccagagcctgaaaagcagcgcacaccgcaggataatcaacttgcctatgttgtgatcggaatactgaccttggcggctatcattgccgcaaacgagatgggcctgctcgaaaccacaaaacgagacctgggtatgtcaaaggagcccggggtagtgtctccaactagctaccttgatgtcgacctccaccctgccagtgcttggacgctgtatgcagtggccaccacagttatcactcccatgttgagacataccattgaaaattccacagcgaacgtgagcctggctgccatcgcaaaccaggccgtcgtattaatgggcctagacaaaggatggccaatatctaagatggatctgggcgtgcctctccttgctctggggtgctactcacaggttaatcccttgaccctgactgccgcagtgctcctgcttattacgcactacgctatcatcggaccgggcttacaggccaaagcgacaagggaggcccaaaagcggaccgcagctggtattatgaagaacccaactgtcgacgggatcatgaccatagatctggaccctgtgatttatgattccaaattcgagaagcagctcggacaggtcatgttgctggtgctatgtgccgttcagctgctccttatgcgcacaagttgggcactgtgcgaagctttgactctggccaccggccccatcacaacgctctgggagggtagcccaggcaaattttggaataccactattgccgtgtcgatggcgaacatcttcagagggtcttacctggctggagcaggcttagccttttccataatgaagagcgtagggacaggaaaaaggggcaccggttcacaaggggaaactcttggagagaagtggaagaaaaagctgaatcagctcagtcggaaagaattcgacctatataagaaatctggcatcacagaggtggatcgaaccgaggctaaggaaggtctgaaaagaggcgagattacgcatcacgccgtctcccgcgggagcgcaaagttgcagtggtttgttgaaaggaacatggtgatccccgagggacgggtcattgacctgggctgtgggcgtggaggctggtcatactattgcgccggtctcaagaaagtgaccgaagtaagagggtacacaaagggaggccctggccacgaggagccggtgcccatgagtacttatgggtggaatatcgttaaacttatgagcggaaaggatgtgttctacctgccacctgaaaaatgtgacaccttgctgtgcgatattggtgagtcctctcccagccctacagtcgaagagtccaggactatccgcgtgctcaagatggtcgagccatggttaaagaacaatcagttctgtataaaagtgctgaacccctacatgcctaccgttattgaacatcttgagcggctgcaacgaaagcacggcgggatgctagtaagaaatccactctcaaggaactctacacatgaaatgtattggatcagtaatggaaccggcaacatcgtggcttcggtcaatatggtgagccgcctgttgctgaaccggtttactatgacgcacagacgtcccacaattgagaaagacgttgatctcggtgcggggaccaggcacgtgaacgccgaaccggagactcctaatatggacgtcataggagagcggatcaagcgcattaaagaagagcataactccacctggcactacgacgatgaaaatccatataagacatgggcataccatggctcttatgaggtgaaggctacgggctcagccagctccatgatcaacggggtagtgaaacttctgaccaagccctgggacgttgtccctatggtgactcagatggcaatgacagataccactccattcggacagcaacgagtgtttaaagaaaaggtcgacacaagaacccccaggagtatgccgggtacacggcgcgttatgggcattactgccgagtggttatggagaaccctggggaggaataaaaagcctcgattgtgcacgcgggaggaattcaccaagaaagtgcgtacaaacgctgccatgggagcggtatttactgaggaaaatcagtgggattctgcaaaggccgctgtggaggacgaagatttctggaaactcgtcgacagagagcgcgagctgcacaagctaggcaaatgtggtagctgcgtgtacaacatgatggggaagagggaaaaaaagcttggagagtttggcaaggccaaaggctcacgggcaatctggtatatgtggctgggggctagatacctcgaattcgaggccctgggatttttgaatgaggatcattggttctcccgcgaaaacagttacagcggtgttgagggcgaagggctgcacaagctcggatatatacttagggacatctctaaaattcccggcggtgctatgtacgccgatgacaccgcagggtgggacacacgaatcactgaggatgacctgcacaatgaagagaagattacccagcagatggatccagagcatcggcaattagcgaacgccatctttaaactgacgtatcagaataaggtggtcaaggtgcagagacctacacccaccggaactgtaatggacataatttccaggaaagatcagcgcggctcaggccaagttgggacatacggattgaacaccttcactaatatggaagctcagctcatccgtcagatggagggtgaaggcgtgctgagcaaggccgacctagagaacccacaccttcccgaaaaaaagatcacccagtggctggagacaaaaggggtcgagcggctcaagagaatggcaatttcgggagatgactgcgtggtgaagcctatagatgacaggtttgctaacgccctgttggcattaaatgatatgggcaaagtccgcaaggacatcccacaatggcagccgtctaaaggttggcatgattggcagcaggttcccttctgtagtcaccacttccatgaactgattatgaaggacgggcgaaaactcgtggtaccttgccggccacaagacgagcttatcggaagagccaggatttcccagggcgcgggctggagcctgcgcgaaacggcttgtctagggaaggcctatgcacagatgtggtcactgatgtactttcacagacgggatctcaggttggcctccaacgctatctgctctgccgtgcccgtccattgggtgcctaccagccgtactacatggagtatacacgcacatcaccaatggatgaccactgaggacatgctgacagtttggaatcgagtgtggatcgaagataacccatggatggaggacaagacccccgtcacgacatgggagaatgtgccttatcttggaaaacgcgaagatcagtggtgtggttccctgattggcctcaccagcagagctacttgggcccagaacatcccgaccgcgattcagcaagtacggtctttaatcgggaatgaggaattcctggactacatgccatcaatgaagaggtttcgcaaagaggaggaaagtgagggagctatttggtga

SEQ ID NO: 15116 - RNA, 9873 nt, synthetic construct
  misc_feature 1..9873: note = derived and/or modified CDS sequence (opt3) from DENV-3__KT726351__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggtgttctttaccttcgttctactgctctccggacagattacgtggcgggatatggctcatactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatggcggtcgctgccatgggcgtaccccctctgcccttgtttattttctctctgaaggatactttaaaacgtagaagctggccactcaatgagggggtgatggcagttggactggtgtcaatccttgccagttccctgttgaggaacgacgtccctatggctggccccctcgtggcaggtgggctgctaattgcctgttatgtaatcaccggaacgtctgcggatctgacagtggaaaaggctgccgacataacctgggaggaagaggcagaacagactggcgtcagccacaaccttatgattacagttgacgatgacggcaccatgcgcatcaaagatgacgagactgagaatatcctcacagtgctgttgaagaccgccttactgattgtgtccgggatatttccatactcaatcccggctacgctcctggtctggcatacttggcagaaacagacccaacggagcggagtgctttgggatgttcctagtcccccagaaacacagaaggccgagctggaagagggtgtatacagaattaaacagcagggcatcttcgggaagacccaagtgggagtcggcgtgcagaaggagggtgtttttcacacaatgtggcacgtgactaggggggcagtcttgacccataacggaaaacgactagaacccaattgggcttctgtgaagaaagacctgatttcctatggcggcgggtggcgcctcagcgcccagtggcaaaagggagaggaagtacaggtcatcgcggtggagcctggtaaaaacccaaagaatttccagacgatgcccggcacattccagactaccacaggggaaataggagccatcgcactggattttaagcctggcacctcgggttcaccgattatcaaccgggaggggaaagttgtgggactttacggcaatggcgtcgtgactaagaacgggggatatgtttctggtattgctcaaaccaatgccgagccagacggccccacacctgaattagaggaagagatgttcaaaaagagaaacctgacgatcatggatctccacccagggagtggaaaaactaggaagtacttgcccgctatagtgcgtgaagcaattaagcgccggctgagaaccctcatcctggcccctacaagggtcgtggccgctgagatggaggaagcgcttaaaggcctgccgatccgatatcagaccactgcaacaaagtccgagcataccggtcgggaaattgtagacttgatgtgccacgccacgtttactatgcgcctactgagccccgtgagagttccaaattacaacctcatcataatggatgaggctcatttcacagaccctgcctctattgcagccagggggtatatcagcacccgggtcggaatgggcgaagctgcggccatttttatgaccgcaactcccccaggcacagctgatgccttccctcagtccaatgcacccatccaggacgaggagcgagacataccagaaagatcatggaacagtgggaatgagtggattaccgattttgccggaaaaacagtgtggttcgtgccgagcatcaaggctggtaacgacatcgccaactgtttacgcaaaaatggcaagaaggtcattcaactgtctaggaaaacttttgatacggaataccagaagaccaaacttaacgactgggatttcgtagtgacaactgacatctccgagatgggggcgaattttaaggcagatcgtgttattgaccctcggagatgcctgaaacccgtgatactcaccgatggaccagagagggtcatcttggccggccccatgcctgtgacagctgcctcagctgcacagcgccgaggtagagttgggcggaacccacagaaggaaaatgaccaatacattttcaccggccagcccctgaacaatgatgaggaccacgcccactggactgaagctaagatgctcctggacaacatcaatacgcctgagggaatcattccggcccttttcgaaccagagagggagaaaagtgcagcgatagatggcgaatatcgcctaaagggggagagccgtaaaacctttgtggaactgatgagacggggagacttgcccgtctggttagcccataaggtggcttccgagggtatcaaatacacagataggaagtggtgcttcgacggccagcgcaacaatcagattctggaagagaacatggatgtagagatctggactaaagaaggggagaagaagaaactccgacctagatggctggacgcccggacctattctgatccccttgcactgaaggaatttaaagacttcgctgccggaaggaagtcgattgcactcgatttggtgacagagatcggccgcgttccaagccacctggcccatagaaccaggaatgctctagacaacctggtcatgctccacacttcagaacacggtgggcgggcgtaccgtcatgccgtggaggagcttcctgaaacaatggagacgctgttattgctgggcctcatgatactgcttaccggaggcgcaatgctgtttctcatctccgggaaaggaattggtaagactagtatcggcttgatttgtgtgatcgcttctagcgggatgctgtggatggccgaaatacccttacaatggattgcctccgcaatcgtcctagagttctttatgatggttctgctcattccagagcctgaaaagcagcgcacaccgcaggataatcaacttgcttatgtggtaatcggaatactgaccttggccgcgatcattgctgccaacgagatgggcctgctcgaaaccacaaaacgagacctgggtatgtcaaaggagcccggggtggtctctccaactagctaccttgatgtggacctccaccctgcaagtgcctggacgctgtatgctgttgcaaccacagtgatcactcccatgttgagacataccattgaaaattccacagccaacgtcagcctggcggctatcgccaaccaggcagtagtgttaatgggcctagacaaaggatggccaatatctaagatggatctgggcgttcctctccttgccctggggtgctactcacaggtgaatcccttgaccctgactgctgccgtcctcctgcttattacgcactacgcaatcatcggaccgggcttacaggctaaagccacaagggaggcgcaaaagcggaccgccgcaggtattatgaagaacccaactgtggacgggatcatgaccatagatctggaccctgtcatttatgattccaaattcgagaagcagctcggacaggtgatgttgctggttctatgtgctgtgcagctgctccttatgcgcacaagttgggccctgtgcgaagcattgactctggctaccggccccatcacaacgctctgggagggtagcccaggcaaattttggaataccactattgccgtatcgatggccaacatcttcagagggtcttacctggcgggagctggcttagcattttccataatgaagagcgtggggacaggaaaaaggggcaccggttcacaaggggaaactcttggagagaagtggaagaaaaagctgaatcagctcagtcggaaagaattcgacctatataagaaatctggcatcacagaggtcgatcgaaccgaggccaaggaaggtctgaaaagaggcgagattacgcatcacgctgtttcccgcgggagcgccaagttgcagtggtttgtggaaaggaacatggtcatccccgagggacgggtgattgacctgggctgtgggcgtggaggctggtcatactattgcgcaggtctcaagaaagtaaccgaagtgagagggtacacaaagggaggccctggccacgaggagccggttcccatgagtacttatgggtggaatatcgtgaaacttatgagcggaaaggatgtcttctacctgccacctgaaaaatgtgacaccttgctgtgcgatattggtgagtcctctcccagccctacagtggaagagtccaggactatccgcgtcctcaagatggtggagccatggttaaagaacaatcagttctgtataaaagttctgaacccctacatgcctaccgtaattgaacatcttgagcggctgcaacgaaagcacggcgggatgctagtgagaaatccactctcaaggaactctacacatgaaatgtattggatcagtaatggaaccggcaacatcgtcgcctcggtgaatatggttagccgcctgttgctgaaccggtttactatgacgcacagacgtcccacaattgagaaagacgtggatctcggtgctgggaccaggcacgtcaacgcggaaccggagactcctaatatggacgtgataggagagcggatcaagcgcattaaagaagagcataactccacctggcactacgacgatgaaaatccatataagacatgggcctaccatggctcttatgaggtaaaggcaacgggctcagctagctccatgatcaacggggtggttaaacttctgaccaagccctgggacgtcgtgcctatggtgactcagatggccatgacagataccactccattcggacagcaacgagtctttaaagaaaaggttgacacaagaacccccaggagtatgccgggtacacggaaagtgatgggcattactgcagagtggttatggcgcaccctggggagaaataagaagcctaggttgtgcacgcgagaggaattcaccaaaaaggtacggacaaacgccgctatgggagccgtgtttactgaggaaaatcagtgggattctgcgaaagcagccgtcgaggacgaagatttctggaagctcgtggaccgtgagagagagctgcacaaactaggcaagtgtggtagctgcgtttacaacatgatggggaaacgcgaaaagaagcttggagagtttggcaaagctaagggctcaagggccatctggtatatgtggctgggggcacggtacctcgaattcgaggctctgggatttttgaatgaggatcattggttctccagagaaaacagttacagcggtgtggagggcgaagggctgcacaaactcggatatatacttcgcgacatctctaagattcccggcggtgccatgtacgctgatgacaccgccgggtgggacacaaggatcactgaggatgacctgcacaatgaagagaaaattacccagcagatggatccagagcatcgacaattagcaaacgcgatctttaagctgacgtatcagaataaggtcgtgaaagtacagcggcctacacccaccggaactgttatggacataatttccagaaaggatcagaggggctcaggccaagtggggacatacggattgaacaccttcactaatatggaagcccagctcatccgccagatggagggtgaaggcgtcctgagcaaagctgacctagagaacccacaccttcccgaaaagaaaatcacccagtggctggagacaaagggggtggagcgtctcaagcggatggccatttcgggagatgactgcgtggtcaaacctatagatgacagatttgcaaacgctctgttggccttaaatgatatgggcaaggttaggaaagacatcccacaatggcagccgtctaagggttggcatgattggcagcaggtgcccttctgtagtcaccacttccatgaactgattatgaaagacgggcgcaagctcgtagtgccttgccgaccacaagacgagcttatcggacgggcaagaatttcccagggcgccggctggagcctgagggaaacggcgtgtctagggaaggcttatgcccagatgtggtcactgatgtactttcaccgcagagatctccggttggcatccaacgccatctgctctgctgtccccgtgcattgggttcctaccagcaggactacatggagtatacacgcccatcaccaatggatgaccactgaggacatgctgacagtgtggaatcgtgtctggatcgaagataacccatggatggaggacaaaacccccgtgacgacatgggagaatgtaccttatcttggaaagcgagaagatcagtggtgtggttccctgattggcctcaccagccgcgcaacttgggctcagaacatcccgaccgccattcagcaagttagatctttaatcgggaatgaggaattcctggactacatgccatcaatgaaacggtttaggaaggaggaggaaagtgagggagcgatttggtga

SEQ ID NO: 15117 - RNA, 9873 nt, synthetic construct
  misc_feature 1..9873: note = derived and/or modified CDS sequence (opt3) from DENV-3__KT726360__SS-prME
  source 1..9873: mol_type = other RNA
accagcctgtgcctcatgatgatccttcccgcagctctggcattccacttgacttccagagacggcgagcctaggatgattgtggggaagaacgaacggggaaagtctttactgtttaagactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggtgttctttaccttcgttctactgctctccggacagattacgtggcgggatatggctcatactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatggcggtcgctgccatgggcgtaccccctctgcccttgtttattttctctctgaaggatactttaaaacgtagaagctggccactcaatgagggggtgatggcagttggactggtgtcaatccttgccagttccctgttgaggaacgacgtccctatggctggccccctcgtggccggtgggctgctaattgcctgttatgtaatcaccggaacgtctgcggatctgacagtggaaaaggctgccgacataacctgggaggaagaggcagaacagactggcgtcagccacaaccttatgattacagttgacgatgacggcaccatgcgcatcaaagatgacgagactgagaatatcctcacagtgctgttgaagaccgccttactgattgtgtccgggatatttccatactcaatcccggctacgctcctggtctggcatacttggcagaaacagacccaacggagcggagtgctttgggatgttcctagtcccccagaaacacagaaggccgagctggaagagggtgtatacagaattaaacagcagggcatcttcgggaagacccaagtgggagtcggcgtgcagaaggagggtgtttttcacacaatgtggcacgtgactagaggggcagtcttgacccataacggaaaacgactagaacccaattgggcttctgtgaagaaagacctgatttcctatggcggcgggtggcgcctcagcgcccagtggcaaaagggagaggaagtacaggtcatcgcggtggagcctggtaaaaacccaaagaatttccagacgatgcccggcacattccagactaccacaggggaaataggagccatcgcactggattttaagcctggcacctcgggttcaccgattatcaaccgggaggggaaagttgtgggactttacggcaatggcgtcgtgactaagaacgggggatatgtttctggtattgctcaaaccaatgccgagccagacggccccacacctgaattagaggaagagatgttcaaaaagagaaacctgacgatcatggatctccacccagggagtggaaaaactaggaagtacttgcccgctatagtgcgtgaagcaattaagcgccggctgagaaccctcatcctggcccctacaagggtcgtggccgctgagatggaggaagcgcttaaaggcctgccgatccgatatcagaccactgcaacaaagtccgagcataccggtcgggaaattgtagacttgatgtgccacgccacgtttactatgcgcctactgagccccgtgagagttccaaattacaacctcatcataatggatgaggctcatttcacagaccctgcctctattgcagccagggggtatatcagcacccgggtcggaatgggcgaagctgcggccatttttatgaccgcaactcccccaggcacagctgatgccttccctcagtccaatgcacccatccaggacgaggagcgagacataccagaaagatcatggaacagtgggaatgagtggattaccgattttgccggaaaaacagtgtggttcgtgccgagcatcaaggctggtaacgacatcgccaactgtttacgcaaaaatggcaagaaggtcattcaactgtctaggaaaacttttgatacggaataccagaagaccaaacttaacgactgggatttcgtagtgacaactgacatctccgagatgggggcgaattttaaggcagatcgtgttattgaccctcggagatgcctgaaacccgtgatactcaccgatggaccagagagggtcatcttggccggccccatgcctgtgacagctgcctcagctgcacagcgccgaggtagagttgggcggaacccacagaaggaaaatgaccaatacattttcaccggccagcccctgaacaatgatgaggaccacgcccactggactgaagctaagatgctcctggacaacatcaatacgcctgagggaatcattccggcccttttcgaaccagagagggagaaaagtgcagcgatagatggcgaatatcgcctaaagggggagagccgtaaaacctttgtggaactgatgagacggggagacttgcccgtctggttagcccataaggtggcttccgagggtatcaaatacacagataggaagtggtgcttcgacggccagcgcaacaatcagattctggaagagaacatggatgtagagatctggactaaagaaggggagaagaagaaactccgacctagatggctggacgcccggacctattctgatccccttgcactgaaggaatttaaagacttcgctgccggaaggaagtcgattgcactcgatttggtgacagagatcggccgcgttccaagccacctggcccatagaaccaggaatgctctagacaacctggtcatgctccacacttcagaacacggtgggcgggcgtaccgtcatgccgtggaggagcttcctgaaacaatggagacgctgttattgctgggcctcatgatactgcttaccggaggcgcaatgctgtttctcatctccgggaaaggaattggtaagacaagtatcggcttgatttgtgtgatcgcttctagcgggatgctgtggatggccgaaatacccttacaatggattgcctccgcaatcgtcctagagttctttatgatggttctgctcattccagagcctgaaaagcagcgcacaccgcaggataatcaacttgcttatgtggtaatcggaatactgaccttggccgcgatcattgctgccaacgagatgggcctgctcgaaaccacaaaacgagacctgggtatgtcaaaggatcccggggtggtctctccaactagctaccttgacgtggacctccaccctgcaagtgcctggacgctgtatgctgttgcaaccacagtgatcactcccatgttgagacataccattgaaaattccacagccaacgtcagcctggcggctatcgccaaccaggcagtagtgttaatgggcctagataaaggatggccaatatctaagatggacctgggcgttcctctccttgccctggggtgctactcacaggtgaatcccttgaccctgactgctgccgtcctcctgcttattacgcactacgcaatcatcggaccgggcttacaggctaaagccacaagggaagcgcaaaagcggaccgccgcaggtattatgaagaacccaactgtggatgggatcatgaccatagacctggatcctgtcatttatgactccaaattcgagaagcagctcggacaggtgatgttgctggttctatgtgctgtgcagctgctccttatgcgcacaagttgggccctgtgcgaggcattgactctggctaccggccccatcacaacgctctgggaaggtagcccaggcaaattttggaataccactattgccgtatcgatggccaacatcttcagagggtcttacctggcgggagctggcttagcattttccataatgaaaagcgtggggacaggaaaaaggggcaccggttcacaaggggagactcttggagaaaagtggaagaaaaagctgaatcagctcagtcggaaagagttcgatctatataagaaatctggcatcacagaagtcgaccgaaccgaggccaaggagggtctgaaaagaggcgaaattacgcatcacgctgtttcccgcgggagcgccaagttgcagtggtttgtggagaggaacatggtcatccccgaaggacgggtgattgatctgggctgtgggcgtggaggctggtcatactattgcgcaggtctcaagaaagtaaccgaggtgagagggtacacaaagggaggccctggccacgaggagccggttcccatgagtacttatgggtggaatatcgtgaaacttatgagcggaaaggacgtcttctacctgccacctgagaaatgtgataccttgctgtgcgacattggtgaatcctctcccagccctacagtggaggaatccaggactatccgcgtcctcaagatggtggagccatggttaaagaacaatcagttctgtataaaagttctgaacccctacatgcctaccgtaattgagcatcttgaacggctgcaacgaaagcacggcgggatgctagtgagaaatccactctcaaggaactctacacatgagatgtattggatcagtaatggaaccggcaacatcgtcgcctcggtgaatatggttagccgcctgttgctgaaccggtttactatgacgcacagacgtcccacaattgaaaaagatgtggacctcggtgctgggaccaggcacgtcaacgcggagccggaaactcctaatatggacgtgataggagagcggatcaagcgcattaaagaggaacataactccacctggcactacgatgacgagaatccatataagacatgggcctaccatggctcttatgaagtaaaggcaacgggctcagctagctccatgatcaacggggtggttaaacttctgaccaagccctgggatgtcgtgcctatggtgactcagatggccatgacagacaccactccattcggacagcaacgagtctttaaagagaaggttgatacaagaacccccaggagtatgccgggtacacggcgcgtgatgggcattactgcagaatggttatggagaaccctggggaggaataaaaagcctcgattgtgcacgcgggaggagttcaccaagaaagtacgtacaaacgccgctatgggagccgtgtttactgaagagaatcagtgggactctgcgaaggcagccgtcgaagatgaggacttctggaaactcgtggatagagaacgcgagctgcacaagctaggcaaatgtggtagctgcgtttacaacatgatggggaagagggagaagaaacttggagaatttggcaaagctaaaggctcacgggccatctggtatatgtggctgggggcaagatacctcgagttcgaagctctgggatttttgaatgaggaccattggttctcccgcgagaacagttacagcggtgtggaaggcgaggggctgcacaagctcggatatatacttagggatatctctaaaattcccggcggtgccatgtacgctgacgacaccgccgggtgggatacacgaatcactgaagacgatctgcacaatgaggaaaagattacccagcagatggacccagagcatcggcaattagcaaacgcgatctttaaactgacgtatcagaataaggtcgtgaaggtacagagacctacacccaccggaactgttatggatataatttccaggaaagaccagcgcggctcaggccaagtggggacatacggattgaacaccttcactaatatggaggcccagctcatccgtcagatggaaggtgagggcgtcctgagcaaggctgatctagaaaacccacaccttcccgagaaaaagatcacccagtggctggaaacaaaaggggtggagcggctcaagagaatggccatttcgggagacgattgcgtggtcaagcctatagacgataggtttgcaaacgctctgttggccttaaatgacatgggcaaagttcgcaaggatatcccacaatggcagccgtctaaaggttggcatgactggcaacaggtgcccttctgtagtcaccacttccatgagctgattatgaaggacgggcgaaaactcgtagtgccttgccggccacaagatgaacttatcggaagggcaaggatttcccagggcgccggctggagcctgcgcgagacggcgtgtctagggaaggcttatgcccagatgtggtcactgatgtactttcacagacgggacctcaggttggcatccaacgccatctgctctgctgtccccgtgcattgggttcctaccagccgtactacatggagtatacacgcccatcaccaatggatgaccactgaagatatgctgacagtgtggaatcgagtctggatcgaggacaacccatggatggaagataagacccccgtgacgacatgggagaatgtaccttatcttggaaaacgcgaggaccagtggtgtggttccctgattggcctcaccagcagagcaacttgggctcagaacatcccgaccgccattcagcaagttcggtctttaatcgggaatgaagagttcctggattacatgccatcaatgaagaggtttcgcaaagaagaggagagtgaaggagcgatttggtga

SEQ ID NO: 15118 - RNA, 9873 nt, synthetic construct
  misc_feature 1..9873: note = derived and/or modified CDS sequence (opt3) from DENV-3__KF041259__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattaacgaagttgagccggaagacatcgattgctggtgtaatctgactagtacctgggtgacatatgggacctgcaaccaggctggagagcaccgccgagacaagcgtagcgtagcccttgcaccccatgtgggcatgggtctggatactagaacacaaacctggatgtccgccgagggggcttggaggcaggtcgaaaaagtggagacgtgggcattgcggcaccctggattcactattctcgccctgtttctggctcattacatcggcacctctctcacacagaaggttgtgatattcatcttactgatgcttgtcactccatcgatgaccatgcgctgtgtgggcgtagggaatagagactttgttgaaggattgtcaggtgccacatgggtggatgtcgtgctggagcacggcgggtgcgtgaccacgatggcgaagaacaaacccactctagacattgagctccagaagacagaagcaacccaactggccactcttaggaaactgtgtatcgagggaaagattacaaatatcaccacggatagccggtgccctacccagggcgaagctgtcttgccagaggaacaggaccagaactatgtttgtaaacacacatacgtggatcgcggttgggggaatggatgcggcctcttcggcaaggggagtctggtaacttgcgccaagtttcaatgtttagagcccatagagggaaaagtggtccagtatgaaaacctgaagtacaccgtgattatcacagttcatactggtgaccagcaccaggtgggcaatgagacccaaggggtcacagcagaaattacccctcaggcttccactacggaggccatcctcccagaatatggaacacttggcctggagtgctctccgcgaaccggtttggacttcaacgagatgatcctactgactatgaaaaataaggcgtggatggtgcatagacagtggtttttcgatctccccctgccttggaccagcggggccacaaccgaaactccaacatggaacaggaaagagcttctggtaacgtttaagaatgcacacgctaaaaagcaagaagttgtggtcttgggctcccaggagggagccatgcacaccgctctcactggcgccacagaaattcagaactcagggggaaccagtatattcgcaggtcatctgaagtgtcggttaaaaatggacaagctggagctaaaaggcatgagctacgccatgtgcacaaacacttttgtgctcaagaaagaggtctctgaaacccagcacgggacgatcctgattaaggtggagtacaagggagaagatgctccctgtaaaatccctttctccaccgaggacggccaaggtaaggcgcataatgggcgtcttataacagcaaacccagttgtgactaaaaaggaggaacccgtaaatattgaggccgaaccgcctttcggcgagtcaaacatcgtcatcggaattggcgataatgctttgaaaatcaactggtataagaaggggagcagtattggaaaaatgtttgaagccaccgcacgcggtgccagaaggatggctatactgggcgacacagcctgggatttcgggtctgtgggaggcgttctcaattccctgggtaagatggtgcaccagatctttgggagcgcatacactgcgcttttctcgggcgtctcttgggtgatgaaaattggaatcggcgtactgttgacctggatcgggctcaactccaagaatacgtcaatgagttttagctgcattgctataggaatcattacactgtatttaggcgccgtggttcaggcagacatgggttgtgtcatcaactggaaagggaaggagctgaagtgcggatccggcattttcgtgaccaatgaggtgcatacttggacagaacagtacaaatttcaagccgattctcccaagcggctagctaccgccatcgcaggtgcttgggagaacggcgtctgtgggatacgaagcactacccgcatggaaaatctcctgtggaaacagatcgccaacgagcttaattatattttgtgggaaaacaacatcaagctgacagttgtggtgggagacacgattggcgtactcgagcaggggaaaagaaccctgactccacagcctatggagttaaagtactcatggaaaacatggggaaaggcgaagatcgtcaccgccgaaacacaaaatagttccttcataattgatggccccaacactccagagtgccccagcgcttctagggcatggaatgtgtgggaagttgaggactatggttttggggtgttcaccacgaacatctggctgaaacttcgggaagtctacacacagatgtgtgaccaccgcttgatgtcagccgctgtgaaggatgagagagccgttcacgcagacatgggatactggattgagagtcagaaaaatggcagctggaagctcgaaaaagcgtccctgatcgaggtgaagacctgcacttggcctaagtctcataccctatggtcgaacggtgtactggaaagcgatatgataatcccaaaatccctcgccggcccgatttcacagcacaattataggcccgggtaccatacacaaactgctggaccttggcacctgggccgtcttgagttggactttaactattgcgaggggaccacagtcgtgatcacggaaaattgtggaacccggggcccaagtctgcgaactacaaccgtgtctggtaagttaattcacgagtggtgctgtagaagctgcactctcccccctctgaggtacatgggggaagatggatgttggtatggcatggagatccgcccaatatccgaaaaagaggagaacatggtcaagtcacttgttagcgccggttctggcaaagtggacaatttcacaatgggggtactgtgcttggcaattctctttgaagaggtgatgcggggaaagttcggcaagaaacatatgatcgctggggtcttctttaccttcgtgctgctactgtccggacagatcacgtggagagatatggcccacactctcattatgatcggcagtaacgcaagcgacaggatgggtatgggggttacctacctggcccttattgctacatttaagatacagcccttcttggcgctgggatttttcttacgcaaactcacctctcgagaaaatctgcttctgggcgtgggcctagccatggcaactacactccaactgccggaggatatcgaacagatggctaacgggattgccttgggactgatggccttaaagctcatcacccagtttgagacatatcagctgtggactgctcttatttccctgacctgttcaaatacgatcttcacattgaccgtcgcatggcggactgccaccctcatactggcgggtgtgagtctactgcctgtttgccaaagctcgtccatgcgtaaaacagactggcttccaatgactgtggctgccatgggcgtcccccctctccccctgtttatcttctctttgaaggataccctgaagagaaggagctggccattaaacgagggggtaatggcagtgggactcgtttcaattctggccagttcccttctgcgcaacgacgtgcctatggctggccccttggtcgcaggtgggctcctgatcgcctgttacgtgattacgggaacatctgcggatctaaccgtagaaaaagctgccgacgtgacttgggaggaagaggcagaacagacaggcgtcagccataatctgatgatcaccgttgacgatgacggcactatgcggataaaggatgacgagacagagaacattcttaccgtgctcctgaaaacggccttgttaatcgtgtccgggatctttccatactcaattccggctactctgctcgtctggcacacctggcagaagcagacacaaagaagcggagtgctgtgggatgttcctagtcccccagaaacccagaaagccgagcttgaagagggtgtatataggataaagcagcagggcatcctggggaaaacacaagtgggagtcggcgtgcagaaggagggtgttttccatactatgtggcacgtgacccgaggggcagtcttgacgcacaatggaaagcgcctagaacccaactgggcttctgtgaaaaaggacctgatttcctacggcggcgggtggcggctcagcgcccagtggcaaaaaggagaggaagtacaggtcatcgcggtggagcctggtaagaatccaaaaaactttcagacaatgcccggcactttccagaccacaaccggggaaattggagccatcgcactggatttcaagcctggcacttcgggttcaccgataatcaatagagaggggaaggttgtgggactttatggcaacggcgtcgtgaccaaaaatgggggatacgtttctggtattgctcaaacaaacgccgagccagacggccccacgcctgaattagaggaagagatgtttaagaaaaggaatctgactatcatggatctccatccagggagtggaaagacccgtaaatatttgcccgctattgtgcgcgaagcaatcaagcggagactgaggacactcatactggcccctacccgagtcgtggccgctgagatggaggaagcgcttaagggcctgccgattcggtaccagactacagcaaccaaatccgagcacacgggtcgcgaaatcgtagacttgatgtgccatgccactttcacaatgagactactgagccccgtgagggttccaaactataatctcatcattatggatgaggctcactttaccgaccctgcctctatcgcagcccgggggtacataagcacccgagtcggaatgggcgaagctgcggccattttcatgactgcaacacccccaggcaccgctgatgcctttcctcagtccaacgcacccatccaggacgaggagagagacattccagaacgctcatggaatagtgggaacgagtggatcacagatttcgccggaaagactgtgtggtttgtgccgagcataaaagctggtaacgacattgccaattgtttaaggaagaacggcaaaaaggtcatccaactgtctcgtaagacgttcgataccgaataccagaaaacaaagcttaatgactgggattttgtagtgactaccgacatctccgagatgggggcgaacttcaaagcagatcgggttattgaccctagaaggtgcctgaagcccgtgatcctcacagatggaccagagcgcgtcattttggccggccccatgcctgtgaccgctgcctcagctgcacagcgaagaggtcgggttgggaggaatccacagaaagaaaacgaccaatatatatttactggccagcccctgaataacgatgaggaccatgcccactggacggaagctaagatgctcctggacaatatcaacacccctgagggaattatcccggcccttttcgaaccagagcgcgagaagagtgcagcgatcgatggcgaataccgtctaaaaggggagagcagaaagacattcgtggaactgatgcggaggggagacttgcccgtctggttagcccacaaagtggcttccgagggtattaagtatactgatcgcaaatggtgctttgacggccagcgaaataaccagatactggaagagaatatggatgtagagatctggaccaaggaaggggagaaaagaaagctccggcctaggtggctggacgcccgcacatactctgatccccttgcactgaaggaattcaaagactttgctgccggaagaaagtcgattgcactcgatttggtgaccgagatcggcagggttccaagccatctggcccaccggactcgtaacgctctagacaatctggtcatgctccatacatcagaacacggtgggcgcgcgtatcgacacgccgtggaggagcttcctgaaacgatggagaccctgttattgctgggcctcatgattctgcttactggaggcgcaatgctgttcctcatctccgggaaaggaataggtaagacaagtatcggcttgatttgtgtgatcgcttctagcgggatgctgtggatggccgaaattcccttacaatggatcgcctccgcaatagtcctagagtttttcatgatggttctgctcattccagagcctgaaaaacagagaaccccgcaggataaccaacttgcttacgtggtaatcggaattctgaccttggccgcgatcatagctgccaatgagatgggcctgctcgaaacaactaagagggacctgggtatgtcaaaggagcccggggtggtctctccaacgagctatcttgatgtggacctccatcctgcaagtgcctggaccctgtacgctgttgcaacaactgtgatcacccccatgttgcggcacacaattgaaaactccaccgccaacgtcagcctggcggctatcgccaatcaggcagtagtgttaatgggcctagacaaaggatggccaatttctaagatggatctgggcgttcctctccttgccctggggtgctactcacaggtgaaccccttgactctgacggctgccgtcctcctgcttatcacacattatgcaataattggaccgggcttacaggctaaagccacccgcgaggcgcaaaagagaactgccgcaggtatcatgaaaaatccaaccgtggacgggatcattacaatcgatctggaccctgtcatatacgattccaagtttgagaagcagctcggacaggtgatgttgctggttctatgtgctgtgcagctgctccttatgaggactagttgggccctgtgcgaagcattgaccctggctacaggccccattacgaccctctgggagggtagcccaggcaaattctggaacactacaatcgccgtatcgatggccaatatttttcgggggtcttatctggcgggagctggcttagcattctccatcatgaagagcgtggggaccggaaaacgaggcactggttcacaaggggaaacacttggagagaagtggaaaaagaagctgaaccagctcagtagaaaagaatttgacctatacaagaaatctggcataaccgaggtcgatcgcacggaggccaaggaaggtctgaaaaggggcgagaccacacaccatgctgtttcccgggggagcgccaagttgcagtggttcgtggaacgtaatatggtcatccccgagggaagagtgattgacctgggctgtgggaggggaggctggtcatattactgcgcaggtctcaaaaaggtaactgaagtgcgcgggtataccaagggaggccctggccacgaggagccggttcccatgagtacatacgggtggaacatcgtgaaacttatgagcggaaaggatgtcttttacctgccacctgaaaaatgtgacactttgctgtgcgatattggtgagtcctctcccagccctaccgtggaagagtcccggacaatccgagtcctcaagatggtggagccatggttaaaaaataaccagttctgtattaaggttctgaatccctatatgcctgccgtaatcgaacaccttgagagactgcaaaggaagcatggcgggatgctagtgcgcaacccactctcacggaattctacccacgaaatgtactggataagtaacggaactggcaatattgtctcgagcgtgaacatggtttccagactgttgctgaaccgtttcaaaatgacgcataggcggcccacaatcgagaaggacgtggatctcggtgctgggacccgccacgtcaatgcggaaccggagactcctaacatggacgtgatcggagagcgaattaaaagaataaaggaagagcacaattctacctggcattatgacgatgaaaacccatacaaaacatgggcctatcacggctcatacgaggtaaaggcaacgggcagcgcttccagtatgatcaatggggtggttaagcttctgaccaaaccctgggacgtcgtgcctatggtgactcagatggccatgacagataccactccatttggacagcaaagggtcttcaaggaaaaagttgacacacggaccccccgcccgatgcctggtacaagaaaggtgatggagattactgcagagtggttatggaggaccctgggccgaaacaaacggccccgtttgtgcacgagagaagagtttaccaagaaggtacgcacaaatgccgctatgggggccgtgttcactgaagagaaccagtgggattctgcgaaagcagccgtcgaagacgaggagttttggaagctcgtggatagggaacgggagctgcataaactaggaaagtgtggcagctgcgtttataatatgatgggtaaaagagaaaagaaacttggggagttcggaaaggctaagggctcacgcgccatctggtacatgtggctgggcgcaaggtacctcgagtttgaagctctggggttcttgaacgaggaccactggttttcccgagaaaatagttatagcggagtggagggtgaaggcctgcataaactcgggtacattcttcgggatatctctaagataccaggaggcgccatgtatgctgacgataccgccggttgggacacaagaatcactgaggacgatctgcacaacgaggaaaaaattacccagcagatggaccctgagcacaggttactggcaaatgcgatcttcaagttgacgtaccaaaacaaagtcgtgaaggtacagcgccccacaccaaccgggactgttatggatattatctcccgtaaggaccagcggggatcaggccaggtgggcacatatgggctcaatacctttactaacatggaagcccaactggtcagacagatggagggagaaggtgtgctaagcaaagctgatcttgagaacccccatctgcctgagaagaaaataacccagtggctcgaaacaaagggcgtggagaggctgaaacgcatggccatttcgggggacgattgcgtcgttaagccaatcgacgatcgattcgcaaatgctttgttagccctgaacgacatgggaaaggtgcggaaagatatcccgcagtggcaaccctctaagggctggcacgactggcagcaggtacctttttgtagtcatcacttccacgaactcattatgaaagatggtagaaagcttgtggtcccatgcaggccccaggacgagctgatagggcgcgcaagaatctcccaaggagccggctggagcctacgggaaacggcgtgtctgggcaaagcttacgcccagatgtggtcactcatgtatttccataggcgtgacttgcgactggcatccaatgccatttgctctgctgtgcctgttcactgggtgccaaccagccgcactacatggagtatccatgcccaccatcagtggatgaccactgaggatatgcttacagtctggaacagagtgtggattgaggacaatccctggatggaagataagacccctgtaacgacatgggagaacgttccgtacctggggaagcgggaagaccaatggtgtggatccctcatcggtttaaccagcagggcaacttgggctcagaatataccaaccgccatccagcaggtgcgctctctgattggcaacgaggagtttttggattacatgccctcaatgaaaagattccggaaggaagaggaactggagggggcgatctggtga

SEQ ID NO: 15119 - RNA, 9873 nt, synthetic construct
  misc_feature 1..9873: note = derived and/or modified CDS sequence (opt3) from DENV-3__KF041258__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacaccattggcgtactcgagcaggggaaaagaactctgacaccacagcctatggagttaaagtactcatggaaaacctggggaaaggcgaagatcgtcacagccgaaactcaaaacagttccttcataattgatggccccaataccccagagtgccccagcgcttctagggcatggaacgtgtgggaagttgaggactatggttttggggtgttcacgacaaatatctggctgaaacttcgggaagtctacacccagatgtgtgaccaccgcttgatgtcagccgctgtgaaggatgagagagccgttcacgcagacatgggatactggattgagagtcagaaaaacggcagctggaagctcgaaaaagcgtccctgatcgaggtgaagacttgcacctggcctaagtctcatacactatggtcgaatggtgtactggaaagcgatatgataatcccaaaatccctcgccggcccgatttcacagcacaactataggcccgggtaccatactcaaaccgctggaccttggcacctgggcaagcttgagttggactttaattattgcgaggggacaacggtcgtgatcaccgaaaactgtggaactcgtggcccaagtctgcggacaaccactgtgtctggtaaattaattcacgagtggtgctgtcgaagctgcacactcccccctctgagatacatgggggaagatggatgttggtatggcatggagatcaggccaatatccgaaaaggaggagaatatggtcaaatcacttgttagcgccggttctggcaaggtggacaacttcaccatgggggtactgtgcttggcaattctctttgaagaggtgatgcgcggaaagttcggcaaaaagcatatgatcgctggggtcttctttacgttcgtgctgctactgtccggacagatcacttggcgggatatggcccacaccctcattatgatcggcagtaatgcaagcgacagaatgggtatgggggttacatacctggcccttattgctacctttaaaatacagcccttcttggcgctgggatttttcttaaggaagctcacttctcgcgaaaacctgcttctgggcgtgggcctagccatggcaacaaccctccaactgccggaggatatcgaacagatggctaatgggattgccttgggactgatggccttaaaactcatgacacagtttgagacttatcagctgtggaccgctcttatctccctgacgtgttcaaacacaattttcaccttgactgtcgcatggcgaaccgccacactcatcctggcgggtgtgagtctactgcctgtttgccaaagctcgtccatgcggaagactgactggcttccaatgaccgtggctgccatgggcgtcccccctctccccctgtttatattctctttgaaggatacgctgaaacgtagaagctggccattaaatgagggggtaatggcagtgggactcgtttcaatcctggccagttcccttctgaggaacgacgtgcctatggctggccccttggtcgcaggtgggctcctgattgcctgttacgtgatcacaggaacctctgcggatctaactgtagaaaaggctgccgacgtgacatgggaggaagaggcagaacagaccggcgtcagccataacctgatgattactgttgacgatgacggcacaatgcgcatcaaagatgacgagaccgagaatatacttacggtgctcctgaagactgccttgttaattgtgtccgggatctttccatactcaatcccggctaccctgctcgtctggcacacatggcagaaacagacccaacggagcggagtgctgtgggatgttcctagtcccccagaaacacagaaggccgagcttgaagagggtgtatatagaattaaacagcagggcatactggggaagactcaagtgggagtcggcgtgcagaaggagggtgttttccataccatgtggcacgtgacgaggggggcagtcttgacacacaacggaaaacgactagaacccaattgggcttctgtgaagaaagacctgatctcctacggcggcgggtggcgcctcagcgcccagtggcaaaagggagaggaagtacaggtcattgcggtggagcctggtaaaaacccaaagaattttcagactatgcccggcaccttccagacaaccactggggaaatcggagccattgcactggatttcaagcctggcacctcgggttcaccgatcataaaccgggaggggaaagttgtgggactttatggcaatggcgtcgtgacaaagaacgggggatacgtttctggtatcgctcaaacgaatgccgagccagacggccccactcctgaattagaggaagagatgtttaaaaagagaaacctgaccattatggatctccatccagggagtggaaaaacaaggaagtatttgcccgctatcgtgcgtgaagcaattaagcgccggctgagaaccctcatcctggcccctactagggtcgtggccgctgagatggaggaagcgcttaaaggcctgccgatacgataccagacaaccgcaacgaagtccgagcacactggtcgggaaattgtagacttgatgtgccatgccacattcaccatgcgcctactgagccccgtgagagttccaaattataacctcatcatcatggatgaggctcactttaccgaccctgcctctattgcagccagggggtacatcagcactcgggtcggaatgggcgaagctgcggccatattcatgacagcaacccccccaggcacagctgatgcctttcctcagtccaatgcacccattcaggacgaggagcgagacatcccagaaagatcatggaacagtgggaatgagtggattactgatttcgccggaaaaacggtgtggtttgtgccgagcatcaaggctggtaacgacatagccaactgtttacgcaaaaatggcaagaaggtcattcaactgtctaggaaaaccttcgatacagaataccagaagactaaacttaacgactgggattttgtagtgaccacagacatctccgagatgggggcgaatttcaaggcagatcgtgttatcgaccctcggagatgcctgaaacccgtgattctcaccgatggaccagagagggtcatcttggccggccccatgcctgtgactgctgcctcagctgcacagcgccgaggtagagttgggcggaacccacagaaggaaaatgaccaatatatttttacgggccagcccctgaacaatgatgaggaccatgcccactggaccgaagctaagatgctcctggacaacataaatacacctgagggaatcattccggcccttttcgaaccagagagggagaaaagtgcagcgatcgatggcgaataccgcctaaagggggagagccgtaaaactttcgtggaactgatgagacggggagacttgcccgtctggttagcccacaaggtggcttccgagggtatcaaatataccgataggaagtggtgctttgacggccagcgcaacaatcagattctggaagagaacatggatgtagagatatggacaaaagaaggggagaagcgaaagctcagacctcggtggctggacgccaggacctactctgatccccttgcactgaaagaattcaaggactttgctgccggacgcaaatcgatcgcactcgatttggtgactgagattggcagagttccaagccatctggcccacaggacacggaatgctctagacaacctggtcatgctccatacgtcagaacacggtgggcgtgcgtatcgccacgccgtggaggagcttcctgaaaccatggagactctgttattgctgggcctcatgatcctgcttacaggaggcgcaatgctgttcctcatttccgggaagggaatcggtaaaaccagtataggcttgatctgtgtgattgcttctagcgggatgctgtggatggccgaaatccccttacaatggattgcctccgcaatcgtcctagagtttttcatgatggttctgctcataccagagcctgaaaagcagcgaaccccgcaggataatcaacttgcttacgtggtaattggaatcctgacattggccgcgattatcgctgccaacgagatgggcctgctcgaaactacgaagagagacctgggtatgtcaaaagagcccggggtggtctctccaaccagctatcttgatgtggacctccatcctgcaagtgcctggacactgtacgctgttgcaactaccgtgataacacccatgttgaggcacaccatcgaaaattccactgccaacgtcagcctggcggctattgccaaccaggcagtagtgttaatgggcctagacaagggatggccaatctctaaaatggatctgggcgttcctctccttgccctggggtgctactcacaggtgaatcccttgacgctgacagctgccgtcctcctgcttattacccattatgcaatcataggaccgggcttacaggctaaggccactcgggaggcgcaaaaacgcaccgccgcaggtattatgaagaacccaacagtggacgggatcatcactattgatctggaccctgtcatctacgattccaagtttgagaaacagctcggacaggtgatgttgctggttctatgtgctgtgcagctgctccttatgagaaccagttgggccctgtgcgaagcattgacactggctacgggccccataaccactctctgggagggtagcccaggcaagttctggaatacaaccattgccgtatcgatggccaacatctttagggggtcttatctggcgggagctggcttagcattctccattatgaaaagcgtggggactggaaagcggggcacaggttcacaaggggaaacccttggagagaaatggaagaagaaactgaatcagctcagtcgaaaggaatttgacctatacaaaaagtctggcatcacggaggtcgatagaaccgaggccaaagaaggtctgaagcgcggcgagacaactcaccatgctgtttccagggggagcgccaaattgcagtggttcgtggaacggaacatggtcatacccgagggacgtgtgatcgacctgggctgtgggagaggaggctggtcatattactgcgcaggtctcaagaaggtaaccgaagtgagggggtatacaaaaggaggccctggccacgaggagccggttcccatgagtacttacgggtggaatattgtgaagcttatgagcggaaaagatgtcttttacctgccacctgaaaagtgtgacaccttgctgtgcgatatcggtgagtcctctcccagccctacagtggaagagtcccgcaccattcgggtcctcaaaatggtggagccatggttaaagaacaatcagttctgtatcaaggttctgaacccctatatgcctgccgtaattgaacaccttgagcgactgcaaagaaaacatggcgggatgctagtgaggaatccactctcacgcaactctactcacgaaatgtactggatcagtaatggaacgggcaacatagtctcgagcgtgaatatggtttcccggctgttgctgaacagattcacaatgacccatcgtaggcccactattgagaaggacgtggatctcggtgctgggacccggcacgtcaacgcggaaccggagacacctaatatggacgtgatcggagagcgcatcaaacgaattaaggaagagcacaactctacgtggcattatgacgatgaaaatccatacaaaacctgggcctatcacggctcatacgaggtaaaggcaactggcagcgcttccagtatgataaacggggtggttaagcttctgacaaaaccctgggacgtcgtgcctatggtgacccagatggccatgactgatacaaccccatttggacagcaaagagtcttcaaggaaaaagttgacacaaggactccccggccgatgcctggtacccgcaaggtgatggagatcacggcagagtggttatggagaaccctgggcaggaataaacgaccccggttgtgcacacgtgaagagtttactaagaaggtaagaaccaacgccgctatgggggccgtgttcacagaagagaatcagtgggattctgcgaaagcagccgtcgaagacgaggagttttggaagctcgtggatcgcgaaagggagctgcataaactaggaaagtgtggcagctgcgtttataacatgatgggtaaacgggaaaagaaacttggggagttcggaaaggctaagggctcaagagccatttggtacatgtggctgggcgcacgctacctcgagtttgaagctctggggttcttgaatgaggaccactggttttccagggaaaacagttatagcggagtggagggtgaaggcctgcataaactcgggtacgtccttcgagatatctctaagattccaggaggcgccatgtatgctgacgatactgccggttgggacacccggatcacggaggacgatctgcacaatgaggaaaaaataacacagcagatggaccctgagcacagattactggcaaacgcgatcttcaagttgacctaccaaaataaagtggtaaaggttcagaggcccactccaacagggaccgtgatggatattatctcccgcaaggaccagcgtggatcaggccaggtcggcacttatgggctcaacacctttacaaatatggaagcccaactggtgcggcagatggagggagaaggtgtgctaagcaaagctgatcttgagaacccccatctgcctgagaagaaaattacgcagtggctcgaaaccaagggcgtcgagagactgaaaaggatggccatctcgggggacgattgcgttgtgaagccaatagacgatcgcttcgcaaacgctttgttagccctgaatgacatgggaaaggtacgaaaagatattccgcagtggcaaccctctaagggctggcacgactggcagcaggtgcctttttgtagtcatcacttccacgaactcatcatgaaagatggtcggaagcttgtcgtgccatgcagaccccaggacgagctgatcgggagggcacgcatttcccaaggagccggctggagcctaagagaaactgcgtgtctgggcaaagcttacgcccagatgtggtcactcatgtatttccatcggagggacttgcgtctggcatccaacgccatatgctctgctgttcctgtgcactgggtcccaacaagccgaaccacttggagtatccatgcccaccatcagtggatgacaaccgaggatatgcttacggtgtggaatcgcgtatggattgaggacaacccctggatggaagataagacacctgttaccacttgggagaatgtgccgtacctggggaagagagaagaccaatggtgtggatccctcatcggtttaaccagccgggcaacatgggctcagaacattccaactgccatccagcaggtcaggtctctgataggcaatgaggagtttttggattacatgccctcaatgaaacgcttcagaaaggaagaggaactggagggggcgatctggtga

SEQ ID NO: 15120 - RNA, 9873 nt, synthetic construct
  misc_feature 1..9873: note = derived and/or modified CDS sequence (opt3) from DENV-3__KF041257__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacaccattggcgtactcgagcaggggaaaagaactctgacaccacagcctatggagttaaagtactcatggaaaacctggggaaaggcgaagatcgtcacagccgaaactcaaaacagttccttcataattgatggccccaataccccagagtgccccagcgcttctagggcatggaacgtgtgggaagttgaggactatggttttggggtgttcacgacaaatatctggctgaaacttcgggaagtctacacccagatgtgtgaccaccgcttgatgtcagccgctgtgaaggatgagagagccgttcacgcagacatgggatactggattgagagtcagaaaaacggcagctggaagctcgaaaaagcgtccctgatcgaggtgaagacttgcacctggcctaagtctcatacactatggtcgaatggtgtactggaaagcgatatgataatcccaaaatccctcgccggcccgatttcacagcacaactataggcccgggtaccatactcaaaccgctggaccttggcacctgggcaagcttgagttggactttaattattgcgaggggacaacggtcgtgatcaccgaaaactgtggaactcgtggcccaagtctgcggacaaccactgtgtctggtaaattaattcacgagtggtgctgtcgaagctgcacactcccccctctgagatacatgggggaagatggatgttggtatggcatggagatcaggccaatatccgaaaaggaggagaatatggtcaaatcacttgttagcgccggttctggcaaggtggacaacttcaccatgggggtactgtgcttggcaattctctttgaagaggtgatgcgcggaaagttcggcaaaaagcatatgatcgctggggtcttctttacgttcgtgctgctactgtccggacagatcacttggcgggatatggcccacaccctcattatgatcggcagtaatgcaagcgacagaatgggtatgggggttacatacctggcccttattgctacctttaaaatacagcccttcttggcgctgggatttttcttaaggaagctcacttctcgcgaaaacctgcttctgggcgtgggcctagccatggcaacaaccctccaactgccggaggatatcgaacagatggctaatgggattgccttgggactgatggccttaaaactcatcacacagtttgagacttatcagctgtggaccgctcttatttccctgacgtgttcaaacacaatcttcaccttgactgtcgcatggcgaaccgccacactcatactggcgggtgtgagtctactgcctgtttgccaaagctcgtccatgcggaagactgactggcttccaatgaccgtggctgccatgggcgtcccccctctccccctgtttatcttctctttgaaggatacgctgaaacgtagaagctggccattaaatgagggggtaatggcagtgggactcgtttcaattctggccagttcccttctgaggaacgacgtgcctatggctggccccttggtcgcaggtgggctcctgatcgcctgttacgtgattacaggaacctctgcggatctaactgtagaaaaggctgccgacgtgacatgggaggaagaggcagaacagaccggcgtcagccataacctgatgatcactgttgacgatgacggcacaatgcgcataaaagatgacgagaccgagaatattcttacggtgctcctgaagactgccttgttaatcgtgtccgggatctttccatactcaattccggctaccctgctcgtctggcacacatggcagaaacagacccaacggagcggagtgctgtgggatgttcctagtcccccagaaacacagaaggccgagcttgaagagggtgtatatagaataaaacagcagggcatcctggggaagactcaagtgggagtcggcgtgcagaaggagggtgttttccataccatgtggcacgtgacgaggggggcagtcttgacacacaacggaaaacgactagaacccaattgggcttctgtgaagaaagacctgatttcctacggcggcgggtggcgcctcagcgcccagtggcaaaagggagaggaagtacaggtcatcgcggtggagcctggtaaaaacccaaagaattttcagactatgcccggcaccttccagacaaccactggggaaattggagccatcgcactggatttcaagcctggcacctcgggttcaccgataatcaaccgggaggggaaagttgtgggactttatggcaatggcgtcgtgacaaagaacgggggatacgtttctggtattgctcaaacgaatgccgagccagacggccccactcctgaattagaggaagagatgtttaaaaagagaaacctgaccatcatggatctccatccagggagtggaaaaacaaggaagtatttgcccgctattgtgcgtgaagcaatcaagcgccggctgagaaccctcatactggcccctactagggtcgtggccgctgagatggaggaagcgcttaaaggcctgccgattcgataccagacaaccgcaacgaagtccgagcacactggtcgggaaatcgtagacttgatgtgccatgccacattcaccatgcgcctactgagccccgtgagagttccaaattataacctcatcattatggatgaggctcactttaccgaccctgcctctatcgcagccagggggtacataagcactcgggtcggaatgggcgaagctgcggccattttcatgacagcaacccccccaggcacagctgatgcctttcctcagtccaatgcacccatccaggacgaggagcgagacattccagaaagatcatggaacagtgggaatgagtggatcactgatttcgccggaaaaacggtgtggtttgtgccgagcataaaggctggtaacgacattgccaactgtttacgcaaaaatggcaagaaggtcatccaactgtctaggaaaaccttcgatacagaataccagaagactaaacttaacgactgggattttgtagtgaccacagacatctccgagatgggggcgaatttcaaggcagatcgtgttattgaccctcggagatgcctgaaacccgtgatcctcaccgatggaccagagagggtcattttggccggccccatgcctgtgactgctgcctcagctgcacagcgccgaggtagagttgggcggaacccacagaaggaaaatgaccaatatatatttacgggccagcccctgaacaatgatgaggaccatgcccactggaccgaagctaagatgctcctggacaacatcaatacacctgagggaattatcccggcccttttcgaaccagagagggagaaaagtgcagcgatcgatggcgaataccgcctaaagggggagagccgtaaaactttcgtggaactgatgagacggggagacttgcccgtctggttagcccacaaggtggcttccgagggtattaaatataccgataggaagtggtgctttgacggccagcgcaacaatcagatactggaagagaacatggatgtagagatctggacaaaagaaggggagaagcgaaagctcagacctcggtggctggacgccaggacctactctgatccccttgcactgaaagaattcaaggactttgctgccggacgcaaatcgattgcactcgatttggtgactgagatcggcagagttccaagccatctggcccacaggacacggaatgctctagacaacctggtcatgctccatacgtcagaacacggtgggcgtgcgtatcgccacgccgtggaggagcttcctgaaaccatggagactctgttattgctgggcctcatgattctgcttacaggaggcgcaatgctgttcctcatctccgggaagggaataggtaaaaccagtatcggcttgatttgtgtgatcgcttctagcgggatgctgtggatggccgaaattcccttacaatggatcgcctccgcaatagtcctagagtttttcatgatggttctgctcattccagagcctgaaaagcagcgaaccccgcaggataatcaacttgcttacgtggtaatcggaattctgacattggccgcgatcatagctgccaacgagatgggcctgctcgaaactacgaagagagacctgggtatgtcaaaagagcccggggtggtctctccaaccagctatcttgatgtggacctccatcctgcaagtgcctggacactgtacgctgttgcaactaccgtgatcacacccatgttgaggcacaccattgaaaattccactgccaacgtcagcctggcggctatcgccaaccaggcagtagtgttaatgggcctagacaagggatggccaatttctaaaatggatctgggcgttcctctccttgccctggggtgctactcacaggtgaatcccttgacgctgacagctgccgtcctcctgcttatcacccattatgcaataattggaccgggcttacaggctaaggccactcgggaggcgcaaaaacgcaccgccgcaggtatcatgaagaacccaacagtggacgggatcattactatcgatctggaccctgtcatatacgattccaagtttgagaaacagctcggacaggtgatgttgctggttctatgtgctgtgcagctgctccttatgagaaccagttgggccctgtgcgaagcattgacactggctacgggccccattaccactctctgggagggtagcccaggcaagttctggaatacaaccatcgccgtatcgatggccaacatttttagggggtcttatctggcgggagctggcttagcattctccatcatgaaaagcgtggggactggaaagcggggcacaggttcacaaggggaaacccttcgagagaaatggaagaagaaactgaatcagctcagtagaaaggaatttgacctatacaaaaagtctggaataacggaggtcgatcgcaccgaggccaaagaaggcctgaagaggggtgagacaactcaccatgctgtttcccggggcagcgccaaattgcagtggttcgtggaacgtaacatggtcatccccgaggggagagtgattgacctgggatgtggcagggggggatggtcatattactgcgcaggcctcaagaaggtaaccgaagtgcgcggttatacaaaagggggacctggccacgaggagccggttcccatgagtacttacggctggaatatcgtgaagcttatgagcgggaaagatgtcttttacctgccacctgaaaagtgtgacaccttgctgtgcgatattggagagtcctctcccagccctacagtggaagagtcccggaccatccgagtcctcaaaatggtggagccatggttaaagaacaatcagttctgtattaaggttctgaacccctatatgcctgccgtaatcgaacaccttgagagactgcaaaggaaacatggtggcatgctagtgcgcaatccactctcacggaactctactcacgaaatgtactggataagtaatgggacgggaaacattgtctcgagcgtgaatatggtttccagactgttgctgaaccgtttcacaatgacccataggcggcccactatcgagaaggacgtggatctcggcgctggtacccgccacgtcaacgcggaaccggagacacctaatatggacgtgatcggggagcgaattaaaagaataaaggaagagcacaactctacgtggcattatgacgatgaaaatccatacaaaacctgggcctatcacggatcatacgaggtaaaggcaactggcagcgcttccagtatgatcaacggcgtggttaagcttctgacaaaaccctgggacgtcgtgcctatggtgacccagatggccatgactgatacaaccccatttgggcagcaaagggtcttcaaggaaaaagttgacacacggactccccgcccgatgcctggaaccagaaaggtgatggagattacggcagagtggttatggaggaccctgggtcgaaataaacggccccgtttgtgcacaagagaagagtttactaagaaggtacgcaccaacgccgctatgggcgccgtgttcacagaagagaatcagtgggattctgcgaaagcagccgtcgaagacgaggagttttggaagctcgtggatagggaacgggagctgcataaactagggaagtgtggaagctgcgtttataacatgatgggcaaaagagaaaagaaacttggtgagttcgggaaggctaagggatcacgcgccatctggtacatgtggctgggcgcaaggtacctcgagtttgaagctctgggcttcttgaatgaggaccactggttttcccgagaaaacagttatagcggggtggagggagaaggtctgcataaactcggctacattcttcgggatatctctaagataccagggggagccatgtatgctgacgatactgccggctgggacaccagaatcacggaggacgatctgcacaatgaggaaaaaattacacagcagatggaccctgagcacaggttactggcaaacgcgatcttcaagttgacctaccaaaataaagtcgtgaaggtacagcgccccactccaacaggtaccgttatggatattatctcccgtaaggaccagcgggggtcaggacaggtgggcacttatggcctcaacacctttacaaatatggaagcccaactggtcagacagatggagggggaaggagtgctaagcaaagctgatcttgagaacccccatctgcctgagaagaaaataacgcagtggctcgaaaccaagggtgtggagaggctgaaacgcatggccatttcgggcgacgattgcgtcgttaagccaatcgacgatcgattcgcaaacgctttgttagccctgaatgacatggggaaggtgcggaaagatatcccgcagtggcaaccctctaagggatggcacgactggcagcaggtacctttttgtagtcatcacttccacgaactcattatgaaagatggcagaaagcttgtggtcccatgcaggccccaggacgagctgataggtcgcgcaagaatctcccaaggggccggatggagcctacgggaaactgcgtgtctgggcaaagcttacgcccagatgtggtcactcatgtatttccataggcgtgacttgcgactggcatccaacgccatttgctctgctgtgcctgttcactgggtgccaacaagccgcaccacttggagtatccatgcccaccatcagtggatgacaaccgaggatatgcttacggtctggaatagagtgtggattgaggacaacccctggatggaagataagacacctgtaaccacttgggagaatgttccgtacctgggcaagcgggaagaccaatggtgtgggtccctcatcggattaaccagcagggcaacatgggctcagaacataccaactgccatccagcaggtgcgctctctgattggtaatgaggagtttttggattacatgccctcaatgaaaagattccggaaggaagaggaactggagggcgcgatctggtga

SEQ ID NO: 15121 - RNA, 9873 nt, synthetic construct
  misc_feature 1..9873: note = derived and/or modified CDS sequence (opt3) from DENV-3__KF041255__SS-prME
  source 1..9873: mol_type = other RNA
accagcctgtgcctcatgatgatccttcccgccgctctggcattccacttgacatccagaaacggcgagcctaggatgattgtggggaagaatgaacggggaaaatctttactgtttaagactgcctcaggtataaacatgtgtacgctaatcgcgatggacctcggcgagatgtgcgatgacaccgtcacatacaaatgtccacatattactgaagttgagccggaagatatcgactgctggtgtaatctgaccagtacatgggtgacctatgggacttgcaaccaggctggagagcaccgccgagataagcgtagcgtagcccttgcaccccatgtgggcatgggtctggacacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaatagagattttgttgaaggattgtcaggtgccacctgggtggacgtcgtgctggagcacggcgggtgcgtgacgactatggcgaagaacaaacccacactagatattgagctccagaagaccgaagcaactcaactggccacacttaggaaactgtgtatcgagggaaagattaccaatatcacgaccgacagccggtgccctacacagggcgaagctgtcttgccagaggaacaggatcagaactatgtttgtaaacacacttacgtggaccgcggttgggggaatggatgcggcctcttcggcaaggggagtctggtaacctgcgccaagtttcaatgtttagagcccatagagggaaaagtggtccagtatgaaaacctgaagtacacagtgattatcactgttcataccggtgatcagcaccaggtgggcaatgagacacaaggggtcaccgcagaaattactcctcaggcttccacgacagaggccatcctcccagaatatggaacccttggcctggagtgctctccgcgaactggtttggacttcaacgagatgatcctactgaccatgaaaaataaggcgtggatggtgcatagacagtggtttttcgacctccccctgccttggacaagcggggccaccactgaaacaccaacgtggaacaggaaagagcttctggtaacctttaagaatgcacacgctaaaaagcaagaagttgtggtcttgggctcccaggagggagccatgcacactgctctcacaggcgccaccgaaattcagaactcagggggaacaagtatattcgcaggtcatctgaagtgtcggttaaaaatggataagctggagctaaaaggcatgagctacgccatgtgcactaacacctttgtgctcaagaaagaggtctctgaaacgcagcacgggaccatcctgattaaggtggagtacaagggagaagacgctccctgtaaaatccctttctccacagaggatggccaaggtaaggcgcataatgggcgtcttataactgcaaacccagttgtgaccaaaaaggaggaacccgtaaatattgaggccgaaccgcctttcggcgagtcaaacatcgtcatcggaattggcgacaatgctttgaaaatcaactggtataagaaggggagcagtattggaaaaatgtttgaagccacagcacgcggtgccagaaggatggctatactgggcgatactgcctgggacttcgggtctgtgggaggcgttctcaattccctgggtaagatggtgcaccagatctttgggagcgcatacaccgcgcttttctcgggcgtctcttgggtgatgaaaattggaatcggcgtactgttgacgtggatcgggctcaactccaagaatacatcaatgagttttagctgcattgctataggaatcattaccctgtatttaggcgccgtggttcaggcagatatgggttgtgtcatcaactggaaagggaaggagctgaagtgcggatccggcattttcgtgactaatgaggtgcatacatggaccgaacagtacaaatttcaagccgactctcccaagcggctagctactgccatcgcaggtgcttgggagaacggcgtctgtgggatacgaagcaccacacgcatggaaaatctcctgtggaaacagatcgccaacgagcttaattatattttgtgggaaaacaacatcaagctgacggttgtggtgggagataccattggcgtactcgagcaggggaaaagaactctgacaccacagcctatggagttaaagtactcatggaaaacctggggaaaggcgaagatcgtcacagccgaaactcaaaatagttccttcataattgacggccccaacaccccagagtgccccagcgcttctagggcatggaatgtgtgggaagttgaggattatggttttggggtgttcacgacaaacatctggctgaaacttcgggaagtctacacccagatgtgtgaccaccgcttgatgtcagccgctgtgaaggacgagagagccgttcacgcagatatgggatactggattgagagtcagaaaaatggcagctggaagctcgaaaaagcgtccctgatcgaggtgaagacttgcacctggcctaagtctcatacactatggtcgaacggtgtactggaaagcgacatgataatcccaaaatccctcgccggcccgatttcacagcacaattataggcccgggtaccatactcaaaccgctggaccttggcacctgggcaagcttgagttggattttaactattgcgaggggacaacggtcgtgatcaccgaaaattgtggaactcgtggcccaagtctgcggacaaccactgtgtctggtaaattaattcacgagtggtgctgtcgaagctgcacactcccccctctgagatacatgggggaagacggatgttggtatggcatggagatcaggccaatatccgaaaaggaggagaacatggtcaaatcacttgttagcgccggttctggcaaggtggataatttcaccatgggggtactgtgcttggcaattctctttgaagaggtgatgcgcggaaagttcggcaaaaagcatatgatcgctggggtcttctttacgttcgtgctgctactgtccggacagatcacttggcgggacatggcccacaccctcattatgatcggcagtaacgcaagcgatagaatgggtatgggggttacatacctggcccttattgctacctttaaaatacagcccttcttggcgctgggatttttcttaaggaagctcacttctcgcgaaaatctgcttctgggcgtgggcctagccatggcaacaaccctccaactgccggaggacatcgaacagatggctaacgggattgccttgggactgatggccttaaaactcatcacacagtttgagacttatcagctgtggaccgctcttatttccctgacgtgttcaaatacaatcttcaccttgactgtcgcatggcgaaccgccacactcatactggcgggtgtgagtctactgcctgtttgccaaagctcgtccatgcggaagactgattggcttccaatgaccgtggctgccatgggcgtcccccctctccccctgtttatcttctctttgaaggacacgctgaaacgtagaagctggccattaaacgagggggtaatggcagtgggactcgtttcaattctggccagttcccttctgaggaacgatgtgcctatggctggccccttggtcgcaggtgggctcctgatcgcctgttacgtgattacaggaacctctgcggacctaactgtagaaaaggctgccgatgtgacatgggaggaagaggcagaacagaccggcgtcagccataatctgatgatcactgttgacgacgatggcacaatgcgcataaaagacgatgagaccgagaacattcttacggtgctcctgaagactgccttgttaatcgtgtccgggatctttccatactcaattccggctaccctgctcgtctggcacacatggcagaaacagacccaacggagcggagtgctgtgggacgttcctagtcccccagaaacacagaaggccgagcttgaagagggtgtatatagaataaaacagcagggcatcctggggaagactcaagtgggagtcggcgtgcagaaggagggtgttttccataccatgtggcacgtgacgaggggggcagtcttgacacacaatggaaaacgactagaacccaactgggcttctgtgaagaaagatctgatttcctacggcggcgggtggcgcctcagcgcccagtggcaaaagggagaggaagtacaggtcatcgcggtggagcctggtaaaaatccaaagaactttcagactatgcccggcaccttccagacaaccactggggaaattggagccatcgcactggacttcaagcctggcacctcgggttcaccgataatcaatcgggaggggaaagttgtgggactttatggcaacggcgtcgtgacaaagaatgggggatacgtttctggtattgctcaaacgaacgccgagccagatggccccactcctgaattagaggaagagatgtttaaaaagagaaatctgaccatcatggacctccatccagggagtggaaaaacaaggaagtatttgcccgctattgtgcgtgaagcaatcaagcgccggctgagaaccctcatactggcccctactagggtcgtggccgctgagatggaggaagcgcttaaaggcctgccgattcgataccagacaaccgcaacgaagtccgagcacactggtcgggaaatcgtagatttgatgtgccatgccacattcaccatgcgcctactgagccccgtgagagttccaaactataatctcatcattatggacgaggctcactttaccgatcctgcctctatcgcagccagggggtacataagcactcgggtcggaatgggcgaagctgcggccattttcatgacagcaacccccccaggcacagctgacgcctttcctcagtccaacgcacccatccaggatgaggagcgagacattccagaaagatcatggaatagtgggaacgagtggatcactgacttcgccggaaaaacggtgtggtttgtgccgagcataaaggctggtaacgatattgccaattgtttacgcaaaaacggcaagaaggtcatccaactgtctaggaaaaccttcgacacagaataccagaagactaaacttaatgattgggactttgtagtgaccacagatatctccgagatgggggcgaacttcaaggcagaccgtgttattgatcctcggagatgcctgaaacccgtgatcctcaccgacggaccagagagggtcattttggccggccccatgcctgtgactgctgcctcagctgcacagcgccgaggtagagttgggcggaatccacagaaggaaaacgatcaatatatatttacgggccagcccctgaataacgacgaggatcatgcccactggaccgaagctaagatgctcctggacaatatcaacacacctgagggaattatcccggcccttttcgaaccagagagggagaaaagtgcagcgatcgacggcgaataccgcctaaagggggagagccgtaaaactttcgtggaactgatgagacggggagatttgcccgtctggttagcccacaaggtggcttccgagggtattaaatataccgacaggaagtggtgctttgatggccagcgcaataaccagatactggaagagaatatggacgtagagatctggacaaaagaaggggagaagcgaaagctcagacctcggtggctggatgccaggacctactctgacccccttgcactgaaagaattcaaggattttgctgccggacgcaaatcgattgcactcgacttggtgactgagatcggcagagttccaagccatctggcccacaggacacggaacgctctagataatctggtcatgctccatacgtcagaacacggtgggcgtgcgtatcgccacgccgtggaggagcttcctgaaaccatggagactctgttattgctgggcctcatgattctgcttacaggaggcgcaatgctgttcctcatctccgggaagggaataggtaaaaccagtatcggcttgatttgtgtgatcgcttctagcgggatgctgtggatggccgaaattcccttacaatggatcgcctccgcaatagtcctagagtttttcatgatggttctgctcattccagagcctgaaaagcagcgaaccccgcaggacaaccaacttgcttacgtggtaatcggaattctgacattggccgcgatcatagctgccaatgagatgggcctgctcgaaactacgaagagagatctgggtatgtcaaaagagcccggggtggtctctccaaccagctatcttgacgtggatctccatcctgcaagtgcctggacactgtacgctgttgcaactaccgtgatcacacccatgttgaggcacaccattgaaaactccactgccaacgtcagcctggcggctatcgccaatcaggcagtagtgttaatgggcctagacaagggatggccaatttctaaaatggacctgggcgttcctctccttgccctggggtgctactcacaggtgaaccccttgacgctgacagctgccgtcctcctgcttatcacccattatgcaataattggaccgggcttacaggctaaggccactcgggaggcgcaaaaacgcaccgccgcaggtatcatgaagaatccaacagtggatgggatcattactatcgacctggatcctgtcatatacgactccaagtttgagaaacagctcggacaggtgatgttgctggttctatgtgctgtgcagctgctccttatgagaaccagttgggccctgtgcgaagcattgacactggctacgggccccattaccactctctgggagggtagcccaggcaagttctggaacacaaccatcgccgtatcgatggccaatatttttagggggtcttatctggcgggagctggcttagcattctccatcatgaaaagcgtggggactggaaagcggggcacaggttcacaaggggaaacccttggagagaaatggaagaagaaactgaaccagctcagtcgaaaggaatttgatctatacaaaaagtctggcataacggaggtcgacagaaccgaggccaaagaaggtctgaagcgcggcgagacaactcaccatgctgtttccagggggagcgccaaattgcagtggttcgtggaacggaatatggtcatccccgagggacgtgtgattgatctgggctgtgggagaggaggctggtcatattactgcgcaggtctcaagaaggtaaccgaagtgagggggtatacaaaaggaggccctggccacgaggagccggttcccatgagtacttacgggtggaacatcgtgaagcttatgagcggaaaagacgtcttttacctgccacctgaaaagtgtgataccttgctgtgcgacattggtgagtcctctcccagccctacagtggaagagtcccgcaccatccgggtcctcaaaatggtggagccatggttaaagaataaccagttctgtattaaggttctgaatccctatatgcctgccgtaatcgaacaccttgagcgactgcaaagaaaacatggcgggatgctagtgaggaacccactctcacgcaattctactcacgaaatgtactggataagtaacggaacgggcaatattgtctcgagcgtgaacatggtttcccggctgttgctgaacagattcaagatgacacatcgtaggcccaccatcgagaaagatgtggacctcggtgctgggactcggcacgtcaatgcggaaccggagacccctaacatggatgtgatcggagagcgcattaagcgaataaaagaagagcacaattctacatggcattatgacgacgaaaacccatacaagacgtgggcctatcacggctcatacgaggtaaaggcaaccggcagcgcttccagtatgatcaatggggtggttaaacttctgactaagccctgggatgtcgtgcctatggtgacacagatggccatgaccgacactacaccatttggacagcaaagagtcttcaaagaaaaggttgataccaggacaccccggccgatgcctggtactcgcaaagtgatggagattaccgcagagtggttatggagaacgctgggcaggaacaagcgaccccggttgtgcacccgtgaagagtttacaaagaaagtaagaactaatgccgctatgggggccgtgttcaccgaagagaaccagtgggactctgcgaaggcagccgtcgaagatgaggagttttggaaactcgtggaccgcgaaagggagctgcataagctaggaaaatgtggcagctgcgtttataatatgatgggtaagcgggaaaaaaagcttggggagttcggaaaggctaaaggctcaagagccatctggtacatgtggctgggcgcacgctacctcgagtttgaagctctggggttcttgaacgaggatcactggttttccagggaaaatagttatagcggagtggagggtgaaggcctgcataagctcgggtacattcttcgagacatctctaaaataccaggaggcgccatgtatgctgatgacacagccggttgggatactcggatcaccgaggacgacctgcacaacgaggaaaagattacgcagcagatggatcctgagcacagattactggcaaatgcgatcttcaaattgacataccaaaacaaggtcgtgaaggtacagaggcccaccccaactgggacagttatggacattatctcccgcaaagatcagcgtggatcaggccaggtgggcacctatgggctcaatacttttaccaacatggaagcccaactggtccggcagatggagggagaaggtgtgctaagcaaggctgaccttgagaacccccatctgcctgagaaaaagataacacagtggctcgaaacgaaaggcgtggagagactgaagaggatggccatttcgggggatgactgcgtcgttaagccaatcgatgaccgcttcgcaaatgctttgttagccctgaacgatatgggaaaagtgcgaaaggacatcccgcagtggcaaccctctaaaggctggcacgattggcagcaggtacctttttgtagtcatcacttccacgaactcattatgaaggacggtcggaaacttgtggtcccatgcagaccccaggatgagctgatagggagggcacgcatctcccaaggagccggctggagcctaagagaaaccgcgtgtctgggcaaggcttacgcccagatgtggtcactcatgtatttccatcggagggacttgcgtctggcatccaatgccatttgctctgctgtgcctgttcactgggtgccaactagccgaacaacctggagtatccatgcccaccatcagtggatgactacagaggacatgcttaccgtctggaaccgcgtgtggattgaggataatccctggatggaagacaagacgcctgtaacaacctgggagaacgttccgtacctggggaaaagagaagatcaatggtgtggatccctcatcggtttaactagccgggcaacctgggctcagaatataccaacagccatccagcaggtgaggtctctgattggcaacgaggagtttttggactacatgccctcaatgaagcgcttcagaaaagaagaggaactggagggggcgatctggtga

SEQ ID NO: 15122 - RNA, 9873 nt, synthetic construct
  misc_feature 1..9873: note = derived and/or modified CDS sequence (opt3) from DENV-3__KF041256__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacaccattggcgtactcgagcaggggaaaagaactctgacaccacagcctatggagttaaagtactcatggaaaacctggggaaaggcgaagatcgtcacagccgaaactcaaaacagttccttcataattgatggccccaataccccagagtgccccagcgcttctagggcatggaacgtgtgggaagttgaggactatggttttggggtgttcacgacaaatatctggctgaaacttcgggaagtctacacccagatgtgtgaccaccgcttgatgtcagccgctgtgaaggatgagagagccgttcacgcagacatgggatactggattgagagtcagaaaaacggcagctggaagctcgaaaaagcgtccctgatcgaggtgaagacttgcacctggcctaagtctcatacactatggtcgaatggtgtactggaaagcgatatgataatcccaaaatccctcgccggcccgatttcacagcacaactataggcccgggtaccatactcaaaccgctggaccttggcacctgggcaagcttgagttggactttaattattgcgaggggacaacggtcgtgatcaccgaaaactgtggaactcgtggcccaagtctgcggacaaccactgtgtctggtaaattaattcacgagtggtgctgtcgaagctgcacactcccccctctgagatacatgggggaagatggatgttggtatggcatggagatcaggccaatatccgaaaaggaggagaatatggtcaaatcacttgttagcgccggttctggcaaggtggacaacttcaccatgggggtactgtgcttggcaattctctttgaagaggtgatgcgcggaaagttcggcaaaaagcatatgatcgctggggtcttctttacgttcgtgctgctactgtccggacagatcacttggcgggatatggcccacaccctcattatgatcggcagtaatgcaagcgacagaatgggtatgggggttacatacctggcccttattgctacctttaaaatacagcccttcttggcgctgggatttttcttaaggaagctcacttctcgcgaaaacctgcttctgggcgtgggcctagccatggcaacaaccctccaactgccggaggatatcgaacagatggctaatgggattgccttgggactgatggccttaaaactcatcacacagtttgagacttatcagctgtggaccgctcttatttccctgacgtgttcaaacacaatcttcaccttgactgtcgcatggcgaaccgccacactcatactggcgggtgtgagtctactgcctgtttgccaaagctcgtccatgcggaagactgactggcttccaatgaccgtggctgccatgggcgtcccccctctccccctgtttatcttctctttgaaggatacgctgaaacgtagaagctggccattaaatgagggggtaatggcagtgggactcgtttcaattctggccagttcccttctgaggaacgacgtgcctatggctggccccttggtcgcaggtgggctcctgatcgcctgttacgtgattacaggaacctctgcggatctaactgtagaaaaggctgccgacgtgacatgggaggaagaggcagaacagaccggcgtcagccataacctgatgatcactgttgacgatgacggcacaatgcgcataaaagatgacgagaccgagaatattcttacggtgctcctgaagactgccttgttaatcgtgtccgggatctttccatactcaattccggctaccctgctcgtctggcacacatggcagaaacagacccaacggagcggagtgctgtgggatgttcctagtcccccagaaacacagaaggccgagcttgaagagggtgtatatagaataaaacagcagggcatcctggggaagactcaagtgggagtcggcgtgcagaaggagggtgttttccataccatgtggcacgtgacgaggggggcagtcttgacacacaacggaaaacgactagaacccaattgggcttctgtgaagaaagacctgatttcctacggcggcgggtggcgcctcagcgcccagtggcaaaagggagaggaagtacaggtcatcgcggtggagcctggtaaaaacccaaagaattttcagactatgcccggcaccttccagacaaccactggggaaattggagccatcgcactggatttcaagcctggcacctcgggttcaccgataatcaaccgggaggggaaagttgtgggactttatggcaatggcgtcgtgacaaagaacgggggatacgtttctggtattgctcaaacgaatgccgagccagacggccccactcctgaattagaggaagagatgtttaaaaagagaaacctgaccatcatggatctccatccagggagtggaaaaacaaggaagtatttgcccgctattgtgcgtgaagcaatcaagcgccggctgagaaccctcatactggcccctactagggtcgtggccgctgagatggaggaagcgcttaaaggcctgccgattcgataccagacaaccgcaacgaagtccgagcacactggtcgggaaatcgtagacttgatgtgccatgccacactaaccatgcgcctgctcagccccgtgagagttccaaattataacttaatcattatggatgaggctcacttcaccgaccctgcctctatcgcagccagggggtacataagcactcgggtcggaatgggcgaagctgcggccatttttatgacagcaacccccccaggcacagctgatgccttccctcagtccaatgcacccatccaggacgaggagcgagacattccagaaagatcatggaacagtgggaatgagtggatcactgattttgccggaaaaacggtgtggttcgtgccgagcataaaggctggtaacgacattgccaactgtctgcgcaaaaatggcaagaaggtcatccaactttctaggaaaacctttgatacagaataccagaagactaaactgaacgactgggatttcgtagtgaccacagacatctccgagatgggggcgaattttaaggcagatcgtgttattgaccctcggagatgcctcaaacccgtgatcttgaccgatggaccagagagggtcattctggccggccccatgcctgtgactgctgcctcagctgcacagcgccgaggtagagttgggcggaacccacagaaggaaaatgaccaatatatattcacgggccagcccctcaacaatgatgaggaccatgcccactggaccgaagctaagatgctgcttgacaacatcaatacacctgagggaattatcccggccctatttgaaccagagagggagaaaagtgcagcgatcgatggcgaataccgcctgaagggggagagccgtaaaactttcgtggaattgatgagacggggagacttacccgtctggctggcccacaaggtggcttccgagggtattaaatataccgataggaagtggtgcttcgacggccagcgcaacaatcagatactcgaagagaacatggatgtagagatctggacaaaagaaggggagaagcgaaagctgagacctcggtggcttgacgccaggacctactctgatcccctggcactcaaagaatttaaggacttcgctgccggacgcaaatcgattgcattggatctggtgactgagatcggcagagttccaagccatctagcccacaggacacggaatgctctggacaacctcgtcatgcttcatacgtcagaacacggtgggcgtgcgtatcgccacgccgtggaggagctgcctgaaaccatggagactttattgctgctcggcctgatgattcttctgacaggaggcgcaatgctctttttgatctccgggaagggaataggtaaaaccagtatcggcctgatttgtgtgatcgcttctagcgggatgttatggatggccgaaattcccctacaatggatcgcctccgcaatagtcctggagttctttatgatggttctccttattccagagcctgaaaagcagcgaaccccgcaggataatcaactggcttacgtggtaatcggaattttgacactggccgcgatcatagctgccaacgagatgggcctcctggaaactacgaagagagaccttggtatgtcaaaagagcccggggtggtctctccaaccagctatctcgatgtggacctgcatcctgcaagtgcctggacattgtacgctgttgcaactaccgtgatcacacccatgctgaggcacaccattgaaaattccactgccaacgtcagcttagcggctatcgccaaccaggcagtagtgctaatgggcctggacaagggatggccaatttctaaaatggatctcggcgttcctcttctggccttggggtgctactcacaggtgaatcccctgacgctcacagctgccgtcctgcttttaatcacccattatgcaataattggaccgggcctgcaggctaaggccactcgggaggcgcaaaaacgcaccgccgcaggtatcatgaagaacccaacagtggacgggatcattactatcgatctcgaccctgtcatatacgattccaagttcgagaaacagttgggacaggtgatgctgctagttctgtgtgctgtgcagctccttctgatgagaaccagttgggccttgtgcgaagcactgacactcgctacgggccccattaccactctgtgggagggtagcccaggcaagttttggaatacaaccatcgccgtatcgatggccaacattttcagggggtcttatttagcgggagctggccttgcattttccatcatgaaaagcgtggggactggaaagcggggcacaggttcacaaggggaaaccctgggagagaaatggaagaagaaactcaatcagctaagtcgaaaggaattcgacctgtacaaaaagtctggcataacggaggtcgatagaaccgaggccaaagaaggtttgaagcgcggcgagacaactcaccatgctgtttccagggggagcgccaaactgcagtggtttgtggaacggaacatggtcatccccgagggacgtgtgattgacctcggctgtgggagaggaggctggtcatattactgcgcaggtcttaagaaggtaaccgaagtgagggggtatacaaaaggaggccctggccacgagaagccggttcccatgagtacttacgggtggaatatcgtgaaactgatgagcggaaaggatgtcttctacttgccacctgagaaatgtgacaccctgctctgcgatattggtgaatcctctcccagccctacagtggaggaatcccgcaccatccgggtcttaaagatggtggagccatggctgaagaacaatcagttttgtattaaagttcttaacccctatatgcctgccgtaatcgagcacctggaacgactacaaagaaagcatggcgggatgctcgtgaggaatccactgtcacgcaactctactcacgagatgtactggataagtaatggaacgggcaacattgtctcgagcgtgaatatggtttcccggttgctgctcaacagattcaaaatgacacatcgtaggcccaccatcgaaaaggacgtggatcttggtgctgggactcggcacgtcaacgcggagccggaaacccctaatatggacgtgatcggagagcgcattaaacgaataaaggaggaacacaactctacatggcattatgacgatgagaatccatacaagacgtgggcctatcacggctcatacgaagtaaaagcaaccggcagcgcttccagtatgatcaacggggtggttaagctgttaactaaaccctgggacgtcgtgcctatggtgacacagatggccatgaccgatactacaccattcggacagcaaagagtctttaaggagaaagttgacaccaggacaccccggccgatgcctggtactcgcaaggtgatggaaattaccgcagagtggctgtggagaacgttgggcaggaataagcgaccccggctctgcacccgtgaggaattcacaaaaaaggtaagaactaacgccgctatgggggccgtgtttaccgaggaaaatcagtgggattctgcgaaagcagccgtcgaggacgaagagttctggaagctggtggatcgcgagagggaactacataaacttggaaagtgtggcagctgcgtttataacatgatgggtaaacgggagaagaagctgggggaatttggaaaagctaagggctcaagagccatctggtacatgtggctcggcgcacgctacctggagttcgaggctttggggtttctgaatgaagaccactggttctccagggagaacagttatagcggagtggaaggtgagggcctccataaacttgggtacattctgcgagatatctctaagataccaggaggcgccatgtatgctgacgatacagccggttgggacactcggatcaccgaagacgatttacacaatgaggagaaaattacgcagcagatggaccctgaacacagactgttggcaaacgcgatctttaagctcacataccaaaataaggtcgtgaaagtacagaggcccaccccaactgggacagttatggatattatctcccgcaaggaccagcgtggatcaggccaggtgggcacctatgggctgaacactttcaccaatatggaggcccaactagtccggcagatggaaggagagggtgtgcttagcaaagctgatctggaaaacccccatctccctgagaagaaaataacacagtggctggagacgaagggcgtggaaagattgaagaggatggccatttcgggggacgattgcgtcgttaaaccaatcgacgatcgctttgcaaacgctttactggccctcaatgacatgggaaaggtgcgaaaagatatcccgcagtggcaaccctctaagggctggcacgactggcagcaggtacctttctgtagtcatcactttcacgagcttattatgaaagatggtcggaagctggtggtcccatgcagaccccaggacgaactaatagggagggcacgcatctcccaaggagccggctggagcctgagagagaccgcgtgtctcggcaaggcttacgcccagatgtggtcattgatgtatttccatcggagggacctgcgtcttgcatccaacgccatttgctctgctgtgcctatccactgggttccaactagccgaacaacctggagtattcatgcccaccatcagtggatgactacagaagatatgctgaccgtgtggaatcgcgtctggatcgaggacaacccctggatggaggataaaacgcctgtgacaacctgggaaaatgtaccgtacctcgggaagagagaggaccaatggtgtggatccttaataggtctgactagccgggcaacctgggctcagaacatcccaacagccattcagcaggttaggtctttgatcggcaatgaagagttcctggattacatgccctcaatgaaacgctttagaaaggaggaagagctcgaaggggcgatttggtga

SEQ ID NO: 15123 - RNA, 9873 nt, synthetic construct
  misc_feature 1..9873: note = derived and/or modified CDS sequence (opt3) from DENV-3__KF041254__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgtggttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaggacctggggaaaagccaagatcgtgacagcggaaactcaaaacagttccttcataattgatggccccaataccccagagtgccccagcgcctctcgggcttggaacgtttgggaagtggaggactatggttttggggtcttcacgacaaatatctggctgaagcttcgcgaaatgtacacccagatgtgtgaccacagattgatgtcagcagccgtgaaagatgagagggctgttcacgccgacatgggatactggattgagagtcagaagaacggcagctggaaactcgaaaaggcatccctgatcgaggtgaaaacttgcacctggcctaagtctcatacactatggtcgaatggtgtactggaaagcgatatgataatcccaaagtccctcgcgggcccgatttcacagcacaactatcgtcccgggtaccatactcaaaccgccggaccttggcacctgggcaaacttgagttggactttaattattgcgaggggacaacggtcgtgatcaccgaaaactgtggaactcggggcccaagtctgcgaacaaccactgtgtctggtaagttaattcacgagtggtgctgtagaagctgcacactcccccctctgaggtacatgggggaagatggatgttggtatggcatggagatccgcccaatatccgaaaaagaggagaatatggtcaagtcacttgttagcgctggttctggcaaagtggacaacttcaccatgggggtactgtgcttggccattctctttgaagaggtgatgcggggaaagttcggcaagaaacatatgatcgcaggggtcttctttacgttcgtgctgctactgtccggacagatcacttggagagatatggctcacaccctcattatgatcggcagtaatgccagcgacaggatgggtatgggggttacatacctggcacttattgccacctttaagatacagcccttcttggctctgggatttttcttacgcaaactcacttctcgagaaaacctgcttctgggcgtgggcctagcgatggccacaaccctccaactgccggaggatatcgaacagatggcaaatgggattgctttgggactgatggccttaaagctcatcacacagtttgagacttatcagctgtggaccgcccttatttccctgacgtgttcaaacacaatcttcaccttgactgtcgcttggcggaccgcaacactcatactggccggtgtgagtctactgcctgtttgccaaagctcgtccatgcgtaaaactgactggcttccaatgaccgtggcggctatgggcgtcccccctctccccctgtttatcttctctttgaaggatacgctgaagagaaggagctggccattaaatgagggggtaatggccgtgggactcgtttcaattctggcaagttcccttctgcgcaacgacgtgcctatggccggccccttggtcgctggtgggctcctgatcgcatgttacgtgattacaggaacctctgccgatctaactgtagaaaaagcggctgacgtgacatgggaggaagaggccgaacagaccggcgtcagccataacctgatgatcactgttgacgatgacggcacaatgcggataaaggatgacgagaccgagaatattcttacggtgctcctgaaaactgcattgttaatcgtgtccgggatctttccatactcaattccggccaccctgctcgtctggcacacatggcagaagcagacccaaagaagcggagtgctgtgggatgttcctagtcccccagaaacacagaaagctgagcttgaagagggtgtatataggataaagcagcagggcatcctggggaaaactcaagtgggagtcggcgtgcagaaggagggtgttttccataccatgtggcacgtgacgcgaggggccgtcttgacacacaacggaaagcgcctagaacccaattgggcatctgtgaaaaaggacctgatttcctacggcggcgggtggcggctcagcgctcagtggcaaaaaggagaggaagtacaggtcatcgccgtggagcctggtaagaacccaaaaaattttcagactatgcccggcaccttccagacaaccactggggaaattggagcgatcgccctggatttcaagcctggcacctcgggttcaccgataatcaacagagaggggaaggttgtgggactttatggcaatggcgtcgtgacaaaaaacgggggatacgtttctggtattgcacaaacgaatgctgagccagacggccccactcctgaattagaggaagagatgtttaagaaaaggaacctgaccatcatggatctccatccagggagtggaaagacacgtaaatatttgcccgccattgtgcgcgaagctatcaagcggagactgaggaccctcatactggcacctactcgagtcgtggccgccgagatggaggaagctcttaagggcctgccgattcggtaccagacaaccgcgacgaaatccgagcacactggtcgcgaaatcgtagacttgatgtgccatgcaacattcaccatgagactactgagccccgtgagggttccaaattataacctcatcattatggatgaggcccactttaccgaccctgcttctatcgccgcacgggggtacataagcactcgagtcggaatgggcgaagccgctgcgattttcatgacagccacccccccaggcacagcagatgcttttcctcagtccaatgcccccatccaggacgaggagagagacattccagaacgctcatggaacagtgggaatgagtggatcactgatttcgcaggaaagacggtgtggtttgtgccgagcataaaagccggtaacgacattgctaactgtttaaggaagaatggcaaaaaggtcatccaactgtctcgtaagaccttcgatacagaataccagaaaactaagcttaacgactgggattttgtagtgaccacagacatctccgagatgggggccaatttcaaagcggatcgggttattgaccctagaaggtgcctgaagcccgtgatcctcaccgatggaccagagcgcgtcattttggcaggccccatgcctgtgactgccgcttcagccgctcagcgaagaggtcgggttgggaggaacccacagaaagaaaatgaccaatatatatttacgggccagcccctgaacaatgatgaggaccatgcacactggaccgaagccaagatgctcctggacaacatcaatacacctgagggaattatcccggctcttttcgaaccagagcgcgagaagagtgccgcaatcgatggcgaataccgtctaaaaggggagagcagaaagactttcgtggaactgatgcggaggggagacttgcccgtctggttagcgcacaaagtggcctccgagggtattaagtataccgatcgcaaatggtgctttgacggccagcgaaacaatcagatactggaagagaacatggatgtagagatctggacaaaggaaggggagaaaagaaagctccggcctaggtggctggacgctcgcacctactctgatccccttgccctgaaggaattcaaagactttgcagctggaagaaagtcgattgccctcgatttggtgactgagatcggcagggttccaagccatctggcacaccggacacgtaatgccctagacaacctggtcatgctccatacgtcagaacacggtgggcgcgcttatcgacacgcggtggaggagcttcctgaaaccatggagactctgttattgctgggcctcatgattctgcttacaggaggcgccaccctgttcctcatctccgggaaaggaataggtaagaccagtatcggcttgatttgtgtgatcgcatctagcgggatgctgtggatggctgaaattcccttacaatggatcgcctccgccatagtcctagagtttttcatgatggttctgctcattccagagcctgaaaaacagagaacaccgcaggataatcaacttgcatacgtggtaatcggaattctgactttggctgccatcatagcggctaacgagatgggcctgctcgaaacgaccaagagggacctgggtatgtcaaaggagcccggggtggtctctccaacaagctatcttgatgtggacctccatcctgccagtgcatggactctgtacgccgttgctaccacagtgatcacccccatgttgcggcacactattgaaaattccacggcaaacgtcagcctggccgcgatcgctaaccaggccgtagtgttaatgggcctagacaaaggatggccaatttctaagatggatctgggcgttcctctccttgcactggggtgctactcacaggtgaatcccttgacactgaccgccgctgtcctcctgcttatcactcattatgccataattggaccgggcttacaggcaaaagctacccgcgaggcccaaaagagaacagcggccggtatcatgaaaaacccaactgtggacgggatcattaccatcgatctggaccctgtcatatacgattccaagtttgagaagcagctcggacaggtgatgttgctggttctatgtgcagtgcagctgctccttatgaggacaagttgggctctgtgcgaagccttgacgctggcaaccggccccattactacactctgggagggtagcccaggcaaattctggaataccactatcgctgtatcgatggccaacatttttcgggggtcttatctggcccgagcgggattagctttctccatcatgaagagcgtgggcacagggaaaagaggaaccggctcacaaggtgaaacgcttggggagaagtggaaaaagaagctgaatcagctcagtcgcaaagaatttgacctatacaagaaatctggaataaccgaggtcgataggacagaggcaaaggaaggcctgaaacggggtgagactacccaccatgccgtttcccgtggcagcgctaagttgcagtggttcgtggaaagaaacatggtcatccccgaggggagggtgattgacctgggatgtggccgcgggggatggtcatattactgcgccggcctcaaaaaggtaacagaagtgcggggttatactaaggggggacctggccacgaggagccggttcccatgagtacctacggctggaatatcgtgaaacttatgagcgggaaggatgtcttttacctgccacctgaaaaatgtgacacattgctgtgcgatattggagagtcctctcccagccctaccgtggaagagtcccgaactatcagagtcctcaagatggtggagccatggttaaaaaacaatcagttctgtattaaggttctgaacccctatatgcctgcagtaatcgaacaccttgagaggctgcaacgcaagcatggtggcatgctagtgcggaatccactctcaagaaactctacgcacgaaatgtactggataagtaatgggacaggaaacattgtctcgagcgtgaatatggtttccaaactgttgctgaaccgtttcaccatgactcataggcggcccaccatcgagaaggacgtggatctcggcgccggtacacgccacgtcaacgctgaaccggagacgcctaatatggacgtgatcggggagcgaattaaaagaataaaggaagagcacaactctacctggcattatgacgatgaaaatccatacaaaacttgggcgtatcacggatcatacgaggtaaaggccacaggcagcgcatccagtatgatcaacggcgtggttaagcttctgaccaaaccctgggacgtcgtgcctatggtgactcagatggctatgacagataccacaccatttgggcagcaaagggtcttcaaggaaaaagttgacactcggaccccccgcccgatgcctggaacgagaaaggtgatggagattaccgccgagtggttatggaggacactgggtcgaaataaacggccccgtttgtgcactagagaagagtttaccaagaaggtacgcacaaacgcagccatgggcgctgtgttcactgaagagaatcagtgggattctgccaaagcggcagtcgaagacgaggagttttggaagctcgtggatagggaacgggagctgcataaactagggaagtgtggaagctgcgtttataacatgatgggcaaaagagaaaagaaacttggtgagttcgggaaggccaagggatcacgcgctatctggtacatgtggctgggcgccaggtacctcgagtttgaagcactgggcttcttgaatgaggaccactggttttcccgagaaaacagttatagcggggtggagggagaaggtctgcataaactcggctacattcttcgggatatctctaagataccagggggagctatgtatgccgacgataccgctggctgggacacgagaatcacagaggacgatctgcacaatgaggaaaaaattacccagcagatggaccctgagcacaggttactggccaacgcaatcttcaagttgacttaccaaaataaagtcgtgaaggtacagcgccccacaccaaccggtactgttatggatattatctcccgtaaggaccagcgggggtcaggacaggtgggcacctatggcctcaacacatttacgaatatggaagcgcaactggtcagacagatggagggggaaggagtgctaagcaaagccgatcttgagaacccccatctgcctgagaagaaaataacccagtggctcgaaactaagggtgtggagaggctgaaacgcatggctatttcgggcgacgattgcgtcgttaagccaatcgacgatcgattcgccaacgcattgttagctctgaatgacatggggaaggtgcggaaagatatcccgcagtggcaaccctctaagggatggcacgactggcagcaggtacctttttgtagtcatcacttccacgaactcattatgaaagatggcagaaagcttgtggtcccatgcaggccccaggacgagctgataggtcgcgccagaatctcccaaggggcaggatggagcctacgggaaacagcctgtctgggcaaagcgtacgctcagatgtggtcactcatgtatttccataggcgtgacttgcgactggcctccaacgcaatttgctctgccgtgcctgttcactgggtgccaaccagccgcactacatggagtatccatgctcaccatcagtggatgaccacggaggatatgcttacagtctggaatagagtgtggattgaggacaacccctggatggaagataagacccctgtaactacctgggagaatgttccgtacctgggcaagcgggaagaccaatggtgtgggtccctcatcggattaacaagcagggccacttgggcacagaacataccaaccgctatccagcaggtgcgctctctgattggtaatgaggagtttttggattacatgccctcaatgaaaagattccggaaggaagaggaactggagggcgccatctggtga

SEQ ID NO: 15124 - RNA, 9873 nt, synthetic construct
  misc_feature 1..9873: note = derived and/or modified CDS sequence (opt3) from DENV-3__KX380841__SS-prME
  source 1..9873: mol_type = other RNA
accagcctgtgcctcatgatgatccttcccgcagctctggcattccacttgacatccagggacggcgagcctaggatgattgtggggaagaacgaacggggaaagtctttactgtttaagactgcatcaggtataaatatgtgtacgctcatcgcgatggatctcggcgagatgtgcgacgataccgtcacctacaagtgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaggtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaagggattaccgcagaaatcactcctcaggcttccacgacagaggccatcctcccagaatatggaacccttggcctggagtgctctccgcgaactggtttggacttcaatgagatgattctactgaccatgaaaaacaaggcgtggatggtccatagacagtggtttttcgatctccccctgccttggacaagcggggccaccactgaaacaccaacgtggaataggaaagagcttctggtgacctttaagaacgcacacgctaaaaagcaagaagtagttgtgttgggctcccaggagggagccatgcacactgctctcacaggcgccaccgaaatacaaaattcagggggaacaagtatcttcgcaggtcatctgaagtgtcggttaaaaatggacaagctggagctaaaaggcatgagctacgccatgtgcactaacacctttgtcctcaagaaagaggtgtctgaaacgcagcacgggaccattctgatcaaggtcgagtacaagggagaagatgctccctgtaaaatacctttctccacagaggacggccaaggtaaggcgcataacgggcgtcttattactgcaaatccagtggttaccaaaaaggaggaacccgtgaacatcgaggccgaaccgcctttcggcgagtcaaatatcgtaattggaatcggcgataacgctttgaaaattaattggtataagaaggggagcagtataggaaaaatgtttgaagccacagcacgcggtgccagaaggatggctatcctgggcgacactgcctgggatttcgggtctgtcggaggcgtgctcaactccctgggtaagatggttcaccagatttttgggagcgcatacaccgcgcttttctcgggcgtgtcttgggtcatgaaaatcggaatcggcgtgctgttgacgtggattgggctcaattccaagaacacatcaatgagttttagctgcatagctatcggaattatcaccctgtatttaggcgccgtagtgcaggcagacatgggttgtgttattaattggaaagggaaggagctgaagtgcggatccggcatcttcgtcactaacgaggtgcatacatggaccgaacagtacaaatttcaagccgattctcccaagcggctagctactgccatagccggtgcttgggagaatggcgtgtgtgggatccgaagcaccacacgcatggaaaacctcctgtggaaacagattgccaatgagcttaactatatcttgtgggaaaataacattaagctgacggtcgttgtgggagacaccatcggcgtgctcgagcaggggaaaagaactctgacaccacagcctatggagttaaagtactcatggaaaacctggggaaaggcgaagatagtaacagccgaaactcaaaacagttccttcattatcgatggccccaataccccagagtgccccagcgcttctagggcatggaacgtctgggaagtggaggactatggttttggggttttcacgacaaatatttggctgaaacttcgggaagtgtacacccagatgtgtgaccaccgcttgatgtcagccgctgtcaaggatgagagagccgtgcacgcagacatgggatactggatcgagagtcagaaaaacggcagctggaagctcgaaaaagcgtccctgatagaggttaagacttgcacctggcctaagtctcatacactatggtcgaatggtgtgctggaaagcgatatgatcattccaaaatccctcgccggcccgatctcacagcacaactataggcccgggtaccatactcaaaccgctggaccttggcacctgggcaaacttgagttggactttaattattgcgaggggacaacggtagtcattaccgaaaactgtggaactcgtggcccaagtctgcggacaaccactgtgtctggtaaattaatccacgagtggtgctgtcgaagctgcacactaccccctctgagatacatgggggaagatggatgttggtatggcatggagataaggccaatttccgaaaaggaggagaatatggtgaaatcacttgtcagcgccggttctggcaaggttgacaacttcaccatgggggtgctgtgcttggcaatcctctttgaagaggtaatgcgcggaaagttcggcaaaaagcatatgatcgctggggtgttctttacgttcgtcctgctactgtccggacagattacttggcgggatatggcccacaccctcatcatgattggcagtaatgcaagcgacagaatgggtatgggggtgacatacctggcccttatagctacctttaaaatccagcccttcttggcgctgggatttttcttaaggaagctcacttctcgcgaaaacctgcttctgggcgttggcctagccatggcaacaaccctccaactgccggaggatattgaacagatggctaatgggatcgccttgggactgatggccttaaaactcattacacagtttgagacttatcagctgtggaccgctcttatctccctgacgtgttcaaacacaatattcaccttgactgtggcatggcgaaccgccacactcatcctggcgggtgtcagtctactgcctgtgtgccaaagctcgtccatgcggaagactgactggcttccaatgaccgttgctgccatgggcgtgccccctctccccctgtttattttctctttgaaggatacgctgaaacgtagaagctggccattaaatgagggggtcatggcagtaggactcgtgtcaatcctggccagttcccttctgaggaacgacgttcctatggctggccccttggtggccggtgggctcctgattgcctgttacgtcatcacaggaacctctgcggatctaactgtggaaaaggctgccgacgtaacatgggaggaagaggcagaacagaccggcgtgagccataacctgatgataactgtcgacgatgacggcacaatgcgcattaaagatgacgagaccgagaatatccttacggttctcctgaagactgccttgttaatcgtgtccgggatttttccatactcaataccggctaccctgctcgtgtggcacacatggcagaaacagacccaacggagcggagtcctgtgggatgtgcctagtcccccagaaacacagaaggccgagcttgaagagggtgtttatagaatcaaacagcagggcattctggggaagactcaagtaggagtgggcgtccagaaggacggtgtgttccataccatgtggcacgttacgagaggggcagtgttgacacacaacggaaaacgactagagcccaattgggcttctgtcaagaaagatctgatctcctacggcggcgggtggcgcctcagcgcccagtggcaaaagggagaagaggtgcaggtaattgcggtcgaacctggtaaaaacccaaagaattttcagactatgcccggcaccttccagacaaccactggggagatcggagccatagcactggacttcaagcctggcacctcgggttcaccgatcattaaccgggaagggaaagtggttggactttatggcaatggcgtggtcacaaagaacgggggatacgtgtctggtatcgctcaaacgaatgccgagccagatggccccactcctgagttagaagaggaaatgtttaaaaagagaaacctgaccattatggacctccatccagggagtggaaaaacaaggaagtatttgcccgctatcgttcgtgaggcaataaagcgccggctgagaaccctcattctggcccctactagggtggtcgccgctgaaatggaggaggcgcttaaaggcctgccgatccgataccagacaaccgcaacgaagtccgaacacactggtcgggagatcgtggatttgatgtgccatgccacattcaccatgcgcctactgagccccgtaagagtgccaaattataacctcattatcatggacgaagctcactttaccgatcctgcctctatagcagccagggggtacattagcactcgggttggaatgggcgaggctgcggccatcttcatgacagcaacacccccaggcacagctgacgcctttcctcagtccaatgcacccattcaggacgaggaacgagatatcccagagagatcatggaacagtgggaatgaatggataactgacttcgccggaaaaacggtctggtttgtgccgagcattaaggctggtaacgatatcgccaactgtttacgcaaaaatggcaagaaggtgatccaactgtctaggaaaaccttcgacacagagtaccagaagactaaacttaacgattgggactttgtcgtaaccacagatatttccgaaatgggggcgaatttcaaggcagaccgtgtgatcgatcctcggagatgcctgaaacccgttattctcaccgacggaccagagagggtgatattggccggccccatgcctgtcactgctgcctcagctgcacagcgccgaggtagagtggggcggaacccacagaaggagaatgatcaatatatctttacgggccagcccctgaacaatgacgaagaccatgcccactggaccgaggctaagatgctcctggataacattaatacacctgaaggaatcatcccggcccttttcgagccagaaagggagaaaagtgcagcgattgacggcgagtaccgcctaaagggggaaagccgtaaaactttcgttgagctgatgagacggggagatttgcccgtgtggttagcccacaaggtcgcttccgaaggtataaaatataccgacaggaagtggtgctttgatggccagcgcaacaatcagatcctggaggaaaacatggacgtggagatttggacaaaagagggggaaaagaagaaactccgacctagatggctggatgcccggacctactctgacccccttgcactgaaggagttcaaagattttgctgccggaaggaagtcgatcgcactcgacttggtaactgaaattggccgcgtgccaagccatctggcccacagaacaaggaatgctctagataacctggttatgctccatacgtcagagcacggtgggcgggcgtatcgtcacgccgtcgaggaacttcctgagaccatggaaactctgttattgctgggcctcatgatcctgcttacaggaggcgcaatgctgttcctcatatccgggaaaggaatcggtaagaccagtattggcttgatctgtgtgattgcttctagcgggatgctgtggatggccgagatccccttacaatggatagcctccgcaattgtgctagaatttttcatgatggtcctgctcatcccagagcctgagaagcagcgcaccccgcaggacaatcaacttgcttacgttgtgattggaatcctgacaatggccgcgataatcgctgccaacgaaatgggcttgctggagactacgaaacgagatctcggtatgtcaaaggaacccggggtagtgtctccaaccagctatctggacgtcgaccttcatcctgcaagtgcctggacactctacgctgtggcaactaccgttattacacccatgctgagacacaccatcgaaaattccactgccaacgtgagcttggcggctattgccaaccaggcagtcgtactgatgggcttagataaaggatggccaatctctaagatggacctaggcgtgcctctgctcgcccttgggtgctactcacaggttaatcccctgacgttgacagctgccgtgctgctcctggtcacccattatgcaataattggaccgggccttcaggctaaagccactagggaagcgcaaaagcggaccgccgcaggtatcatgaagaacccaacagtggatgggatcattactatcgacttagatcctgtcatatacgactccaaatttgagaagcagctgggacaggtgatgctcttggttctgtgtgctgtgcagctactgctcatgcgcaccagttgggccctttgcgaggcactgacattggctacgggccccattaccactctgtgggaaggtagcccaggcaaattctggaatacaaccatcgccgtatcgatggccaacatttttagagggtcttatctcgcgggagctggcctggcattctccatcatgaaaagcgtggggactggaaaaaggggcacaggttcacaaggggagaccttaggagaaaagtggaagaagaaacttaatcagctgagtcggaaagagtttgatctctacaagaaatctggcataacggaagtcgaccgaaccgaggccaaagagggtctaaaaagaggcgaaacaactcaccatgctgtttcccgcgggagcgccaagctgcagtggttcgtggagaggaacatggtcatccccgaaggacgggtgattgatttgggctgtgggcgtggaggctggtcatattactgcgcaggtctgaagaaagtaaccgaggtgagagggtatacaaagggaggccctggccacgaggaaccggttcccatgagtacttacgggtggaatatcgtgaaactcatgagcggaaaggacgtcttttaccttccacctgagaaatgtgataccctgttgtgcgacattggtgaatcctctcccagccctacagtggaggaatccaggaccatccgcgtcctgaagatggtggagccatggctcaagaacaatcagttctgtattaaagttttaaacccctatatgcctgccgtaatcgagcacctggaacggcttcaacgaaagcatggcgggatgctggtgagaaatccactatcaaggaactctactcacgagatgtactggataagtaatggaacgggcaacattgtctcgagcgtgaatatggtttcccgcctcctgttgaaccggttcacaatgacccatagacgtcccactatcgaaaaagatgtggacctgggtgctgggaccaggcacgtcaacgcggagccggaaacacctaatatggacgtgatcggagagcggattaagcgcataaaagaggaacacaactctacgtggcattatgatgacgagaatccatacaagacctgggcctatcacggctcatacgaagtaaaggcaactggcagcgcttccagtatgatcaacggggtggttaaactccttacaaagccctgggatgtcgtgcctatggtgacccagatggccatgactgacacaaccccatttggacagcaacgagtcttcaaagagaaggttgatacaagaactcccaggccgatgcctggtacccggaaagtgatggaaattacggcagagtggctgtggcgcaccttaggcagaaataagaggccccgactgtgcacacgggaggaatttactaagaaagtacgtaccaacgccgctatgggggccgtgttcacagaggaaaatcagtgggactctgcgaaggcagccgtcgaggatgaagagttttggaaattggtggacagagagcgcgaactccataagctgggaaaatgtggcagctgcgtttataacatgatgggtaagagggagaaaaagctaggggagttcggaaaggctaaaggctcacgggccatctggtacatgtggcttggcgcaagatacctggagtttgaggctctcgggttcctgaatgaagatcactggttttcccgcgagaacagttatagcggagtggaaggtgagggcttgcataagctggggtacattctcagggacatctctaaaataccaggaggcgccatgtatgctgatgacactgccggttgggacacccgaatcacggaagatgaccttcacaatgaggagaagattacacagcagatggatcctgaacaccggctgttagcaaacgcgatcttcaaactgacctaccaaaataaggtcgtgaaggtacagagacccactccaacagggaccgttatggacattatctccaggaaagatcagcgcggatcaggccaggtgggcacttatgggttgaacacctttacaaatatggaggcccaactcgtccgtcagatggaaggagagggtgtgctgagcaagacggacctagaaaacccccatcttcctgagaaaaagataacccagtggctggagactaaaggcgtggaacggctcaagagaatggctatttcgggggatgactgcgtcgttaagccaatcgatgacaggttcgccaacgcactgttggctttaaatgatatgggaaaagtgcgcaaggacatcccgcagtggcaaccctctaaaggctggcacgattggcagcaggtacctttttgtagtcatcacttccacgagctgattatgaaggacggtcgaaaactcgtggtcccatgccggccccaggacgaacttatagggagagccaggatctcccaaggagcaggctggagcctgcgcgagacagcctgtctaggcaaggcgtacgctcagatgtggtcactgatgtatttccatagacgggatctcaggttggcctccaacgcaatttgctctgccgtgcctgttcactgggtgccaaccagccgtactacatggagtatccatgctcaccatcagtggatgaccacggaagacatgctgacagtctggaatcgagtgtggattgaggataacccctggatggaggacaagacccctatcactacctgggaaaatgtaccgtaccttgggaaacgcgaggatcaatggtgtggatccctgataggtctcacaagcagagccacttgggcacagaacatcccaaccgctattcagcaggttcggtctttaatcggcaatgaagagtttctggactacatgccctcaatgaagaggttccgcaaagaggaagagagtgaaggggccatttggtga

SEQ ID NO: 15125 - RNA, 9873 nt, synthetic construct
  misc_feature 1..9873: note = derived and/or modified CDS sequence (opt3) from DENV-3__KX380842__SS-prME
  source 1..9873: mol_type = other RNA
accagcctgtgcctcatgatgatccttcccgccgctctggcattccacttgacatccagggacggagagcctaggatgattgtggggaagaacgaacggggaaagtctttactgtttaagactgcctcaggtataaatatgtgtacgctcatcgcgatggatctcggcgagatgtgcgacgataccgtcacctacaagtgtccacatattactgaagttgagccggaagacatcgattgctggtgtaacctgaccagtacatgggtgacctatgggacttgcaatcaggctggagagcaccgccgagacaagcgtagcgtcgcccttgcaccccatgtgggcatgggtctggatacaagaacccagacgtggatgtccgccgagggggcttggaggcaggtcgaaaaggtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaagggattaccgcagaaatcactcctcaggcttccacgacagaggccatcctcccagaatatggaacccttggcctggagtgctctccgcgaactggtttggacttcaatgagatgattctactgaccatgaaaaacaaggcgtggatggtccatagacagtggtttttcgatctccccctgccttggacaagcggggccaccactgaaacaccaacgtggaataggaaagagcttctggtgacctttaagaacgcacacgctaaaaagcaagaagtagttgtgttgggctcccaggagggagccatgcacactgctctcacaggcgccaccgaaatacaaaattcagggggaacaagtatcttcgcaggtcatctgaagtgtcggttaaaaatggacaagctggagctaaaaggcatgagctacgccatgtgcactaacacctttgtcctcaagaaagaggtgtctgaaacgcagcacgggaccattctgatcaaggtcgagtacaagggagaagatgctccctgtaaaatacctttctccacagaggacggccaaggtaaggcgcataacgggcgtcttattactgcaaatccagtggttaccaaaaaggaggaacccgtgaacatcgaggccgaaccgcctttcggcgagtcaaatatcgtaattggaatcggcgataacgctttgaaaattaattggtataagaaggggagcagtataggaaaaatgtttgaagccacagcacgcggtgccagaaggatggctatcctgggcgacactgcctgggatttcgggtctgtcggaggcgtgctcaactccctgggtaagatggttcaccagatttttgggagcgcatacaccgcgcttttctcgggcgtgtcttgggtcatgaaaatcggaatcggcgtgctgttgacgtggattgggctcaattccaagaacacatcaatgagttttagctgcatagctatcggaattatcaccctgtatttaggcgccgtagtgcaggcagacatgggttgtgttattaattggaaagggaaggagctgaagtgcggatccggcatcttcgtcactaacgaggtgcatacatggaccgaacagtacaaatttcaagccgattctcccaagcggctagctactgccatagtgggtgcatgggagaatggcgtctgtgggatccgaagcaccacacgcatggaaaacctcctgtggaaacagattgctaatgagcttaactatatcttgtgggaaaataacattaagctgacggttgtggtgggagacaccatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgcctctagggcttggaacgtgtgggaagttgaggactatggttttggggtgttcacgacaaatatttggctgaaacttcgggaagtctacacccagatgtgtgaccaccgcttgatgtcagcagccgtgaaggatgagagagctgttcacgccgacatgggatactggatcgagagtcagaaaaacggcagctggaagctcgaaaaagcatccctgatagaggtgaagacttgcacctggcctaagtctcatacactatggtcgaatggtgtactggaaagcgatatgatcattccaaaatccctcgcgggcccgatctcacagcacaactataggcccgggtaccatactcaaaccgccggaccttggcacctgggcaaacttgagttggactttaattattgcgaggggacaacggtcgtgattaccgaaaactgtggaactcgtggcccaagtctgcggacaaccactgtgtctggtaaattaatccacgagtggtgctgtcgaagctgcacactaccccctctgagatacatgggggaagatggatgttggtatggcatggagataaggccaatttccgaaaaggaggagaatatggtcaaatcacttgttagcgctggttctggcaaggtggacaacttcaccatgggggtactgtgcttggccatcctctttgaagaggtgatgcgcggaaagttcggcaaaaagcatatgatcgcaggggtcttctttacgttcgtgctgctactgtccggacagattacttggcgggatatggctcacaccctcatcatgattggcagtaatgccagcgacagaatgggtatgggggttacatacctggcacttatagccacctttaaaatccagcccttcttggctctgggatttttcttaaggaagctcacttctcgcgaaaacctgcttctgggcgtgggcctagcgatggccacaaccctccaactgccggaggatattgaacagatggcaaatgggatcgctttgggactgatggccttaaaactcattacacagtttgagacttatcagctgtggaccgcccttatctccctgacgtgttcaaacacaatattcaccttgactgtcgcttggcgaaccgcaacactcatcctggccggtgtgagtctactgcctgtttgccaaagctcgtccatgcggaagactgactggcttccaatgaccgtggcggctatgggcgtaccccctctccccctgtttattttctctttgaaggatacgctgaaacgtagaagctggccattaaatgagggggtaatggccgtgggactcgtttcaatgctggcaagttcccttctgaggaacgacgtgcctatggccggccccttggtcgctggtgggctcctgatcgcatgttacgtgattacaggaacctctgccgatctaactgtagaaaaggcggctgacgtgacatgggaggaagaggccgaacagaccggcgtcagccataacctgatgatcactgttgacgatgacggcacaatgcgcataaaagatgacgagaccgagaatattcttacggtgctcctgaagactgcattgttaatcgtgtccgggatctttccatactcaattccggccaccctgctcgtctggcacacatggcagaaacagacccaacggagcggagtgctgtgggatgttcctagtcccccagaaacacagaaggctgagcttgaagagggtgtatatagaataaaacagcagggcatcctggggaagactcaagtgggagtcggcgtgcagaaggacggtgttttccataccatgtggcacgtgacgagaggggccgtcttgacacacaacggaaaacgactagagcccaattgggcatctgtgaagaaagatctgatttcctacggcggcgggtggcgcctcagcgctcagtggcaaaagggagaagaggtacaggtcatcgccgtggaacctggtaaaaacccaaagaattttcagactatgcccggcaccttccagacaaccactggggagattggagcgatcgccctggacttcaagcctggcacctcgggttcaccgataatcaaccgggaagggaaagttgtgggactttatggcaatggcgtcgtgacaaagaacgggggatacgtttctggtattgcacaaacgaatgctgagccagatggccccactcctgagttagaagaggaaatgtttaaaaagagaaacctgaccatcatggacctccatccagggagtggaaaaacaaggaagtatttgcccgccattgtgcgtgaggctatcaagcgccggctgagaaccctcatactggcacctactagggtcgtggccgccgaaatggaggaggctcttaaaggcctgccgattcgataccagacaaccgcgacgaagtccgaacacactggtcgggagatcgtagatttgatgtgccatgcaacattcaccatgcgcctactgagccccgtgagagttccaaattataacctcatcattatggacgaagcccactttaccgatcctgcttctatcgccgcaagggggtacataagcactcgggtcggaatgggcgaggccgctgcgattttcatgacagccacacccccaggcacagcagacgcttttcctcagtccaatgcccccatccaggacgaggaacgagatattccagagagatcatggaacagtgggaatgaatggatcactgacttcgcaggaaaaacggtgtggtttgtgccgagcataaaggccggtaacgatattgctaactgtttacgcaaaaatggcaagaaggtcatccaactgtctaggaaaaccttcgacacagagtaccagaagactaaacttaacgattgggactttgtagtgaccacagatatctccgaaatgggggccaatttcaaggcggaccgtgttattgatcctcggagatgcctgaaacccgtgatcctcaccgacggaccagagagggtcattttggcaggccccatgcctgtgactgccgcttcagccgctcagcgccgaggtagagttgggcggaacccacagaaggagaatgatcaatatatatttacgggccagcccctgaacaatgacgaagaccatgcacactggaccgaggccaagatgctcctggataacatcaatacacctgaaggaattatcccggctcttttcgagccagaaagggagaaaagtgccgcaatcgacggcgagtaccgcctaaagggggaaagccgtaaaactttcgtggagctgatgagacggggagatttgcccgtctggttagcgcacaaggtggcctccgaaggtattaaatataccgacaggaagtggtgctttgatggccagcgcaacaatcagatactggaggaaaacatggacgtagagatctggacaaaagagggggaaaagaagaaactccgacctagatggctggatgctcggacctactctgacccccttgccctgaaggagttcaaagattttgcagctggaaggaagtcgattgccctcgacttggtgactgaaatcggccgcgttccaagccatctggcacacagaacaaggaatgccctagataacctggtcatgctccatacgtcagagcacggtgggcgggcttatcgtcacgcggtggaggaacttcctgagaccatggaaactctgttattgctgggcctcatgattctgcttacaggaggcgccatgctgttcctcatctccgggaaaggaataggtaagaccagtatcggcttgatttgtgtgatcgcatctagcgggatgctgtggatggctgagattcccttacaatggatcgcctccgccatagtcctagaatttttcatgatggttctgctcattccagagcctgagaagcagcgcaccccgcaggacaatcaacttgcatacgtggtaatcggcattctgacaatggctgccatcatagcggctaacgaaatgggcttgctggagactacgaaacgagatctcggtatgtcaaaggaacccggggtggtctctccaaccagctatctggacgtggaccttcatcctgccagtgcatggacactctacgccgttgctactaccgtgatcacacccatgctgagacacaccattgaaaattccactgcaaacgtcagcttggccgcgatcgctaaccaggccgtagtgctgatgggcttagataaaggatggccaatttctaagatggacctaggcgttcctctgctcgcacttgggtgctactcacaggtgaatcccctgacgttgacagccgctgtcctgctcctggtgacccattatgccatcataggaccgggccttcaggcaaaagctactagggaagcccaaaagcggaccgcggccggtattatgaagaacccaacagtcgatgggatcatcactattgacttagatcctgtgatctacgactccaaatttgagaagcagctgggacaggttatgctcttggtgctgtgtgcagtacagctactgctcatgcgcaccagttgggctctttgcgaggccctgacattggcaacgggccccataaccactctgtgggaaggtagcccaggcaaattctggaatacaaccattgctgtgtcgatggccaacatctttagagggtcttatctcgccggagcgggcctggctttctccattatgaaaagcgtcgggactggaaaaaggggcacaggttcacaaggggagaccttaggagaaaagtggaagaagaaacttaatcagctgagtcggaaagagtttgatctctacaagaaatctggcatcacggaagttgaccgaaccgaggcaaaagagggtctaaaaagaggcgaaacaactcaccatgccgtgtcccgcgggagcgctaagctgcagtggttcgtcgagaggaacatggtgatacccgaaggacgggtaatcgatttgggctgtgggcgtggaggctggtcatattactgcgccggtctgaagaaagtgaccgaggttagagggtatacaaagggaggccctggccacgaggaaccggtgcccatgagtacttacgggtggaatattgtcaaactcatgagcggaaaggacgtgttttaccttccacctgagaaatgtgataccctgttgtgcgacatcggtgaatcctctcccagccctacagtcgaggaatccaggaccattcgcgtgctgaagatggttgagccatggctcaagaacaatcagttctgtatcaaagtattaaacccctatatgcctgcagtgattgagcacctggaacggcttcaacgaaagcatggcgggatgctggtcagaaatccactatcaaggaactctactcacgagatgtactggatcagtaatggaacgggcaacatagtgtcgagcgttaatatggtgtcccgcctcctgttgaaccggttcacaatgacccatagacgtcccactattgaaaaagatgtcgacctgggtgccgggaccaggcacgtgaacgctgagccggaaacacctaatatggacgtaatcggagagcggatcaagcgcattaaagaggaacacaactctacgtggcattatgatgacgagaatccatacaagacctgggcgtatcacggctcatacgaagtgaaggccactggcagcgcatccagtatgataaacggggttgtcaaactccttacaaagccctgggatgtggtgcctatggtcacccagatggctatgactgacacaaccccatttggacagcaacgagttttcaaagagaaggtggatacaagaactcccaggccgatgcctggtacccggaaagtaatggaaatcacggccgagtggctgtggcgcaccttaggcagaaataagaggccccgactgtgcacacgggaggaatttactaagaaagtgcgtaccaacgcagccatgggggctgtcttcacagaggaaaatcagtgggactctgccaaggcggcagtggaggatgaagagttttggaaattggttgacagagagcgcgaactccataagctgggaaaatgtggcagctgcgtgtataacatgatgggtaagagggagaaaaagctaggggagttcggaaaggccaaaggctcacgggctatttggtacatgtggcttggcgccagatacctggagtttgaggcactcgggttcctgaatgaagatcactggttttcccgcgagaacagttatagcggagtcgaaggtgagggcttgcataagctggggtacatcctcagggacatttctaaaatcccaggaggcgctatgtatgccgatgacactgctggttgggacacccgaataacggaagatgaccttcacaatgaggagaagatcacacagcagatggatcctgaacaccggctgttagccaacgcaattttcaaactgacctaccaaaataaggtggtaaaggttcagagacccactccaacagggaccgtgatggacatcatttccaggaaagatcagcgcggatcaggccaggtcggcacttatgggttgaacacctttacaaatatggaggcgcaactcgtgcgtcagatggaaggagagggtgtgctgagcaagacggacctagaaaacccccatcttcctgagaaaaagatcacccagtggctggagactaaaggcgtcgaacggctcaagagaatggccatatcgggggatgactgcgttgtgaagccaattgatgacaggttcgctaacgccctgttggcattaaatgatatgggaaaagtacgcaaggacatcccgcagtggcaaccctctaaaggctggcacgattggcaacaggtgcctttttgtagtcatcacttccacgagctgatcatgaaggacggtcgaaaactcgtcgtgccatgccggccccaggacgaacttattgggagagctaggatatcccaaggagccggctggagcctgcgcgagacagcatgtctaggcaaggcctacgcgcagatgtggtcactgatgtatttccatagacgggatctcaggttggcttccaacgccatctgctctgcaattcctgttcactgggtgccaaccagccgtactacatggagtatccatgcccaccatcagtggatgaccacggaagacatgctgacagtctggaatcgagtgtggattgaggataacccctggatggaggacaagacccctatcactacctgggaaaatgtaccgtaccttgggaaacgcgaggatcaatggtgtggatccctgataggtctcacaagcagagctacttgggcccagaacatcccaaccgcaattcagcaggttcggtctttaatcggcaatgaagagtttctggactacatgccctcaatgaagaggttccgcaaagaggaagagagtgaaggggctatttggtga

SEQ ID NO: 15126 - RNA, 9873 nt, synthetic construct
  misc_feature 1..9873: note = derived and/or modified CDS sequence (opt3) from DENV-3__KX380839__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacaatcacttacaaatgtccactgattaccgaagtcgagccggaagacatcgattgctggtgtaaccttacaagtacctgggttacttatgggacatgcaatcaggcgggagagcatcgccgagacaagcgtagcgtggctctggccccccacgtaggcatgggtttggataccagagcacaaacgtggatgtccgccgagggggcttggaggcaggtggaaaaagtcgagacttgggcattccggcatcctggatttaccattctcgccctgttcctggctcactacatcggcacatctctcactcagaaggtggttatatttatcttactgatgcttgtgaccccatcgatgacaatgcgctgtgtcggcgtggggaacagagacttcgtagaaggattgtcaggtgccacctgggttgatgtggtcctggagcatggcgggtgcgtgacgactatggcgaagaataaacccacactagacattgagctccagaagaccgaagcaactcaactggccacacttaggaaactgtgtatcgagggaaagattaccaacgtgacgaccgatagccggtgccctacacagggcgaagctactttgccagaggaacaggaccagaattatgtctgtaaacacacctacgttgatcgcggttgggggaacggatgcggcctctttggcaaggggagtctggtgacatgcgccaagttccaatgtttagagctgactgagggaaaagtagtgcagcacgaaaatctcaagtataccgtcatcataacagtgcataccggtgaccagcaccaggttggcaacgagactcaaggggtgacggcagaaattacaccccaggcttccaccgtcgaggccatctttcgatcttacggaactcttggcctggaatgcagccctagaaccggtttggacttcaatgagatgattctactgacaatgaaaaacaaggcgtggatggtgcataggcagtggtttttcgatctcccactgccgtggacctccggggccactacagagacgcccacctggaataaaaaggaacttctggtaacttttaaaaacgcacacgctaagaagcaagaggttgtggtcttgggctcacaggaaggagccatgcacacagctctcaccggcgccacagagatccagactagtgggggaaccagcatcttcgcaggtcatctgaaatgtcggttaaagatggacaaactggaactaaagggcatgtcttatgccatgtgctccaatgctttcgtgctcaaaaaggaggtctcagagacgcagcacgggaccattctgataaaggtggaatacaaaggagaggatgcgccttgtaagatcccatttagcacagaagacggccaaggtaaagcacataacgggcgtcttattactgccaaccccgttgtgaccaagaaagaggagcctgtaaatatcgaagctgagccacccttcggcgaaagtaacataattatcggaatcggcgataaggccttgaagattaattggtacaaaaaggggtcttccatcggaaaaatgtttgaggcaacagcccgcggtgctagaaggatggccattctgggcgacactgcatgggatttcgggagcgtcggaggcgtgctcaactcgctgggtaagatggttcaccagatatttgggtctgcgtataccgctcttttctccggcgtgtcatggatcatgaaaattggaatcggcgtcctgttgacgtggatcgggctcaatagtaagaacacaagcatgtccttttcttgcattgtgataggaatcattaccctgtacttaggcgccgtagtgcaggcagacatgggttgtgttatcaattggaaggggaaagaactgaagtgcggaagcggcattttcgtcactaacgaggtgcatacatggaccgagcagtataaatttcaagccgattcaccgaagcggctagctactgccatcgcaggtgcttgggaaaatggcgtgtgtgggatacgaagtaccacacgcatggagaacctcctgtggaaacagatcgccaatgaacttaactacattttgtgggagaataacatcaagctgacggtcgttgtgggagacattatcggcatactcgaacaggggaaaagaaccctgactcctcagcccatggagttaaagtattcctggaagacatggggaaaagcgaagattgtgaccgccgagacacaaaatagctctttcatcattgatggcccaaacactcctgaatgccccaacgcttcaagggcatggaatgtatgggaggtcgaagactacggttttggggtgttcaccacgaacatctggctgaaacttcgggagatgtatacacagttgtgtgaccaccgcctcatgagtgccgctgttaaggatgaaagagccgtgcacgcagacatgggatactggatagagagccagaaaaatggctcctggaagctggagaaggcgtctctaatcgaagtcaaaacctgcacttggccaaagtcgcataccctgtggagcaacggtgtgctcgagtccgatatgattatccccaaatcactggccggccctattagtcagcacaattacaggccagggtatcatacacaaactgctggaccgtggcaccttggcaagttggaactggactttaactactgcgaggggaccacagttgtgatcacggagaattgtggaacccgtggcccctctttacggactacaaccgtaagcggtaaactcatacacgaatggtgctgtcgatcctgcactctgcctccacttagatatatgggggaggatggatgttggtacggcatggaaattaggcccatcaacgagaaggaagagaatatggtcaagtcactggtgagcgccggttctggcaaagtggacaacttcacaatgggggtcttgtgcctcgcaatcctgttcgaggaagttatgcgcggaaagtttggcaaaaagcatatgattgctggggtgctattcacctttgtactgctcctgtccggacagatcacgtggcgggatatggccagaactcttattatgataggcagtaatgcaagcgacaggatgggtatgggggtgacctatttggccctgatcgctacattcaaaattcagccttttttagcgctcggattctttctgcgcaagcttacctctcgagagaacctgctactcggcgtcggcctggccatggcaactacattgcaactgccagaagatatcgagcagatggctaatgggattgccttaggactcatggccctgaagcttatcacccagttcgaaacataccagctgtgggctgcattggtgtccctcatgtgttcaaacactatatttaccctgacggttgcctggcggacagcgaccctaatcctggctggtattagtcttctccccatgtgccaaagctcgtccatgcgtaaaactgactggctgccgatgaccgtggccgcaatgggcgtccctccattgcccctgttcatcttttctttaaaggatacactcaaaagaaggagctggcctctgaatgagggggtgatggccgttggacttgtgtcaattctggctagttccttgctccgcaacgacgtccccatggcaggcccactggtagccggtgggctactgatcgcgtgttatgtgataactggaacctctgctgatcttacggttgagaaggccgcagacgtgacatgggaagaggaagccgagcagaccggcgtcagccacaacctcatgattactgtggacgatgacggcacaatgcggatcaaagatgacgaaaccgagaatatcctgactgtattgttaaagacagctctgctcattgtgtccgggatattcccttactcaatccccgccaccctgcttgtctggcatacgtggcagaaacagactcaaagaagcggagttctgtgggatgtgccaagtccgcctgagacccagaaggcagaattggaggaaggtgtgtacaggattaagcagcagggcatctttgggaaaacacaagtcggagtgggcgttcagaaggagggtgtattccacaccatgtggcatgtgacacgaggggctgtcctaactcacaacggaaaacgcctggagcccaattgggcctctgtgaagaaagacctcatttcctatggcggcgggtggcggctgagcgcgcagtggcaaaagggagaagaggttcaggtgatcgccgtcgaaccaggtaagaaccccaaaaatttccagaccatgcctggcatatttcagacgacaactggggagatcggagcaattgctcttgatttcaagccaggcacctcgggttcacccatcattaacagagaagggaaagtggtaggattatacggcaatggcgtcgtgacaaagaacgggggatatgtttctggtatcgcccaaaccaatgctgagcctgacggcccgactccagagctggaagaggaaatgtttaaaaagaggaacctcaccataatggatttgcaccccgggagtggaaagacacgtaaatacctgcctgcaattgtgcgcgaggccatcaagcggagactcaggacgctgatccttgccccaactcgagtcgtggctgcggaaatggaggaggcactgaaaggcttgcccattcggtatcagaccacagccaccaagtccgaacatactggtaaagagatcgttgacctaatgtgccacgctacattcaccatgcgcctgctcagccctgtgagagtcccgaattacaacttaataattatggatgaagcccattttacggaccccgcatctatcgccgctagggggtatattagcactcgggtgggaatgggcgaggcggccgcaatcttcatgacagctaccccacctggcaccgccgaagcatttccccagtccaatgccccaatacaggatgaggagcgagacattcctgaaagatcatggaacagtgggaatgactggatcactgatttcgctggaaagacagtatggtttgtgcccagcatcaaggccggtaacgacattgcgaactgtctgcgcaaaaatggcaagaaagttatccaactttctaggaagaccttcgatacagagtaccagaaaactaagctgaacgactgggattttgtcgtgacgaccgacatttccgaaatgggggcaaatttcaaggccgatcgtgtgatagacccacggagatgcctcaaaccggtcatcttgacagatggacctgagagggtaattctggctggccccatgccagtgactgttgcctcagctgcacagcgccgaggtagagtggggcggaacccccagaaggagaatgaccaatacatcttcaccggccagcctctcaacaatgatgaagaccacgcccattggacagaggctaaaatgctgcttgacaacatcaataccccagaaggaattatacccgccctatttgagcctgaaagggagaagagtgcagcgatcgatggcgagtatcgcctgaaaggggaaagccgtaagactttcgtcgagttgatgagacggggagacttaccggtgtggctggcccacaaagttgcttccgaaggtattaagtacacggataggaagtggtgctttgacggcgagcgcaacaatcagatcctcgaagagaacatggatgtggagatttggaccaaagaaggggagaagaaaaagctgcgaccaagatggcttgacgcccggacatattctgatcccctggcactcaaagaattcaaggactttgctgccggaaggaagtcgatcgcattggatctggtcactgagataggccgcgtgcctccccacctagcccatagaaccaggaatgctctggacaacctcgtaatgcttcacacaagcgaatacggtgggcgggcgtatcgtcatgccgtggaggagctgccagaaaccatggagactttattgctgctcggcctgatgatccttctgacaggaggcgttatgctcttcttgatttcagggaaaggagtcggtaagacgtccatcggcctgatttgtgtggtggcaagttctgggatgttatggatggctgatatccctctacagtggatagccagcgccattgtcctggaatttttcatgatggttctccttatccccgagccagagaaacaacgcacccctcaggacaatcagctggcatacgtggtaattggaatcttgactctggctgccatagtggcggctaacgaaatgggcctcctggagacaaccaagcgagatcttggtatgtccaaagaaccgggggtcgtgtcacccacctcttatctcgacgttgacctgcacccagccagcgcatggacattgtacgccgtggctactacggtcatcacccctatgctgagacacacaattgagaatagtactgcaaacgtatccttagccgcgatcgctaaccaagccgtggttctaatgggcctggataagggatggcccattagcaagatggacctcggcgtgccacttctggcattggggtgctactctcaggtcaatcctctgaccctcacagccgctgtgctgcttttagtcacccattatgccatcataggacccggcctgcaggcaaaagctactagggaagcccagaagcggacggcggccggtattatgaaaaacccgacagtggatgggatcatgaccatcgacctcgatccagttatttacgactcaaagtttgagaaacaattgggacaggtgatgctgctagtactgtgtgcagtgcagctccttctgatgcgcacttcctgggctttctgcgaggccttgaccctggcaacaggccctatcactaccctctgggaaggtagtcccggcaagttttggaatacaacgatagctgtcagcatggccaacattttcagagggtcgtatctggccggagcgggcttagctttttctatcatgaagtccgttgggaccggaaaaaggggcactggtagccagggggagacacttggagaaaagtggaaaaagaaactgaatcaactctcacggaaggagttcgatctatacaaaaagagtggcattaccgaagtggaccgaactgaggcaaaggagggtctgaaaagaggcgaaatcacacaccatgccgtctctcgcgggtccgctaagttgcagtggttcgtggagaggaacatggtaataccagaaggacgggtgatcgatctgggctgtgggcgtggaggctggagctattactgcgccggtctcaaaaaggttaccgaggtgagagggtatacgaaaggaggccccggccacgaagagcctgtcccgatgtcaacctacgggtggaatattgtgaagcttatcagtggaaaggacgtcttttacctgcccccagagaaatgtgatacattgctgtgcgacattggtgaaagctccccttctcccactgtggaggaaagcaggaccatccgcgttctcaagatggtagagccttggttaaaaaacaatcagttctgtattaaggtgctgaacccatatatgcccgcagtcatcgagcatcttgaacggctgcagcgaaaacacggcgggatgctagtgagaaatcctctctccaggaactcaacacacgagatgtactggatatctaatggaactggcaacattgttagttcggtgaatatgatcagccgcctgttgctgaaccggtttaccatgacatatagacgtccaaccatcgaaaaggatgtcgacctcggtgccgggactaggcatgtgaacgctgagcccgaaacgccgaatatggacgtaattggagagcggatacgccgaatcaaggaggaacactcctctacatggcattacgatgacgagaacccttataaaacctgggcgtaccacggctcatatgaagtgaaggccactggcagcgcatccagtatgattaatggggttgtcaaacttctgaccaagccatgggatgtggtgcccacagtcacgcaaatggctatgaccgacactacacctttcggacagcagagagtttttaaagagaaggtggataccaggactccaaagcccatgccgggtacacggaaagtaatggaaatcaccgccgagtggttatggcgcacactgggcagaaacaagaggcctcgattgtgcactcgggaggaattcaccaaaaaggtgcgtacgaatgcagccatgggggctgtctttaccgaggaaaaccaatgggactctgccagagcggcagtggaggatgaagagttctggaaactcgttgaccgcgagagggaactgcacaagctaggaaaatgtggcagctgcgtgtacaatatgatgggtaagcgggagaagaaacttggggaatttggaaaggccaaaggctcaagagctatttggtacatgtggctgggcgcccgctatctcgagttcgaggcactggggtttttgaacgaagatcattggttctccagggagaatagttacagcggagtcgaaggtgagggcctgcacaagctcgggtatatccttcgagacatatctaaaatccccggaggcgctatgtacgccgatgacacagctggttgggacactcggattaccgaagatgacctgcataacgaggagaagatcacacagcagatggatccagaacacagacagttagccaatgcaatttttaagctgacttatcaaaacaaagtggtaaaggttcagaggcctacccccaaagggacggtgatggacatcatatcccgcaaggatcagcgtggatcaggccaggtcggcacatacgggttgaataccttcactaacatggaggcgcaactcattcggcagatggaaggagagggtgtgctgagcaaaacagacctagaaaatccacatcttctggagaagaagatcacccagtggctcgagactaaaggcgtggaaagactgaagaggatggccatctcgggggatgactgcgtcgttaaacccattgatgaccgcttcgctaacgccttgttagcactgaacgatatgggaaaggtgcgaaaagacatacctcagtggcaaccatctaagggctggcacgattggcagcaggtaccgttttgtagtcaccatttccacgagctcatcatgaaggacggtcggaaacttgtggtcccctgcagacctcaggacgaactgattgggagggctcgcatctcccaaggagccggctggagcctaaaggagaccgcatgtctgggcaaagcctatgcgcagatgtgggctctcatgtactttcatagacgggatttgaggctggcctcaaatgcaatttgctccgccgtgccagttcactgggtgcccacatctcgtacgacctggagcatccacgctcatcaccagtggatgactacagaagacatgcttaccgtctggaaccgagtgtggatagaggataatccttggatggaggacaagactccagtaacaacctgggaagatgttccctacctggggaaacgcgaggaccaatggtgtggaagtctcatcggtttaacgtccagagccacatgggcacagaacattctgaccgctatccagcaggtgcggagcttgattggcaatgaagagttcctggattatatgccttctatgaagaggtttcgcaaggaggaagagtcagaaggggccatctggtga

SEQ ID NO: 15127 - RNA, 9873 nt, synthetic construct
  misc_feature 1..9873: note = derived and/or modified CDS sequence (opt3) from DENV-3__KX380840__SS-prME
  source 1..9873: mol_type = other RNA
accagcctgtgcctcatgatgatgcttcccgccactctggctttccacttgacttccagggacggagagcctaggatgatcgtggggaagaacgaacggggaaagtctttactgtttaagacggcatcaggtattaatatgtgtaccctaatagccatggatctcggcgagatgtgcgacgatacaatcacttacaagtgtccactgattaccgaagtcgagccggaagacatcgattgctggtgtaaccttacaagtacctgggttacttatgggacatgcaatcaggcgggagagcatcgccgagacaagcgtagcgtggctctggcaccacacgtaggcatgggtttggataccagagcacagacgtggatgtccgccgagggggcttggagacaggtggaaaaggtcgagacttgggcattccggcatcctggatttaccattctcgccctgttcctggctcactacatcggcacatctctcactcagaaggtggttatatttatcttactgatgcttgtgaccccatcgatgacaatgcgctgtgtcggcgtggggaacagagacttcgtagaaggattgtcaggtgccacctgggttgatgtggtcctggagcatggcgggtgcgtgacgactatggcgaagaataaacccacactagacattgagctccagaagaccgaagcaactcaactggccacacttaggaaactgtgtatcgagggaaagattaccaacgtgacgaccgatagccggtgccctacacagggcgaagctactttgccagaggaacaggaccagaattatgtctgtaaacacacctacgttgatcgcggttgggggaacggatgcggcctctttggcaaggggagtctggtgacatgcgccaagttccaatgtttagagctgactgagggaaaagtagtgcagcacgaaaatctcaagtataccgtcatcataacagtgcataccggtgaccagcaccaggttggcaacgagactcaaggggtgacggcagaaattacaccccaggcttccaccgtcgaggccatctttcgatcttacggaactcttggcctggaatgcagccctagaaccggtttggacttcaatgagatgattctactgacaatgaaaaacaaggcgtggatggtgcataggcagtggtttttcgatctcccactgccgtggacctccggggccactacagagacgcccacctggaataaaaaggaacttctggtaacttttaaaaacgcacacgctaagaagcaagaggttgtggtcttgggctcacaggaaggagccatgcacacagctctcaccggcgccacagagatccagacaagtgggggaaccagcatcttcgcaggtcatctgaaatgtcggttaaagatggacaaactggaactaaagggcatgtcttatgccatgtgctccaatgctttcgtgctcaaaaaggaggtctcagagacgcagcacgggaccattctgataaaggtggaatacaaaggagaggatgcgccttgtaagatcccatttagcacagaagacggccaaggtaaagcacataacgggcgtcttattactgccaaccccgttgtgaccaagaaagaggagcctgtaaatatcgaagctgagccacccttcggcgaaagtaacataattatcggaatcggcgataaggccttgaagattaattggtacaaaaaggggtcttccatcggaaaaatgtttgaggcaacagcccgcggtgctagaaggatggccattctgggcgacactgcatgggatttcgggagcgtcggaggcgtgctcaactcgctgggtaagatggttcaccagatatttgggtctgcgtataccgctcttttctccggcgtgtcatggatcatgaaaattggaatcggcgtcctgttgacgtggatcgggctcaatagtaagaacacaagcatgtccttttcttgcattgtgataggaatcattaccctgtacttaggcgccgtagtgcaggcagacatgggttgtgttatcaattggaaggggaaagaactgaagtgcggaagcggcattttcgtcactaacgaggtgcatacatggaccgagcagtataaatttcaagccgattcaccgaagcggctagctactgccatcgccggtgcttgggaaaatggcgtgtgtgggatacgaagtaccacacgcatggagaacctcctgtggaaacagatcgccaatgaacttaactacattttgtgggagaataacatcaagctgacggtcgttgtgggagacattatcggcatactcgaacaggggaaaagaaccctgactcctcagcccatggagttaaagtattcctggaagacatggggaaaagcgaagattgtgaccgccgagacacaaaatagctctttcatcattgatggcccaaacactcctgaatgccccaacgctctgagggcatggaatgtatgggaggtcgaagactacggttttggggtgttcaccacgaacatctggcttaaattgcgggagatgtatacacagctctgtgaccaccgcctgatgtcagccgctgttaaggatgaaagagccgtgcacgcagacatgggatactggatagagagtcagaaaaatggcagctggaagctagagaaggcgtccctgatcgaagtcaaaacctgcacttggccaaagtctcataccctctggtcgaacggtgtgctggagagcgatatgattatccccaaatcccttgccggccctatttcacagcacaattacaggccagggtatcatacacaaactgctggaccgtggcacttgggcaagctggaattagactttaactactgcgaggggaccacagttgtgatcacggagaattgtggaacccgtggccccagtctccggactacaaccgtatctggtaaactgatacacgaatggtgctgtcgaagctgcactcttcctccactgagatatatgggggaggatggatgttggtacggcatggaaattaggcccatcaacgagaaggaagagaatatggtcaagtccttggtgtcagccggtagcggcaaagtggacaacttcacaatgggggtcctctgcctggcaatcctattcgaggaagttatgcgcggaaagtttggcaaaaagcatatgattgctggggtgctgttcacctttgtactcctgctttctggacagatcacgtggcgggatatggccagaactttgattatgataggctccaatgcaagtgacaggatgggtatgggggtgacctatctggccttaatcgctacattcaaaattcagccttttctcgcgctgggattctttcttcgcaagctgaccagccgagagaacctactcctgggcgtcggcttggccatggcaactacactgcaattaccagaagatatcgagcagatggctaatgggattgccctcggactgatggcccttaagctgatcacccagttcgaaacataccagttgtgggctgcactcgtgtctctgatgtgttccaacactatatttaccctaacggttgcctggcggacagcgaccctgatccttgctggtatttcactcctgcccatgtgccaaagtagctcgatgcgtaaaactgactggttgccgatgaccgtggccgcaatgggcgtccctccactgcccttattcatcttttccctcaaggatacactgaaaagaaggtcttggcctcttaatgagggggtgatggccgttggactggtgagcattttggcttcaagtctcctgcgcaacgacgtccccatggcaggccccctagtagccggtgggctgcttatcgcgtgttatgtgataactggaacctccgctgatctcacggttgagaaggccgcagacgtgacatgggaagaggaagccgagcagaccggcgtctctcacaacctgatgattactgtggacgatgacggcacaatgcggatcaaagatgacgaaaccgagaatatcttgactgtattactgaagacagctctcctgattgtgagcgggatattcccttactccatccccgccacccttctggtctggcatacgtggcagaaacagactcaaagatcaggagttttgtgggatgtgccaagcccgcctgagacccagaaggcagaactagaggaaggtgtgtacaggattaagcagcagggcatctttgggaaaacacaagtcggagtgggcgttcagaaggagggtgtattccacaccatgtggcatgtgacacgaggggctgtcctgactcacaacggaaaacgcctcgagcccaattgggccagtgtgaagaaagacctgatttcttatggcggcgggtggcggctttccgcgcagtggcaaaagggagaagaggttcaggtgatcgccgtcgaaccaggtaagaaccccaaaaatttccagaccatgcctggcatatttcagacgacaactggggagatcggagcaattgctttagatttcaagccaggcaccagcggttcgcccatcattaacagagaagggaaagtggtaggactgtacggcaatggcgtcgtgacaaagaacgggggatatgtttcaggtatcgcccaaaccaatgctgagcctgacggcccgactccagagctcgaagaggaaatgtttaaaaagaggaacttgaccataatggatctgcaccccgggtctggaaagacacgtaaatacctccctgcaattgtgcgcgaggccatcaagcggagactgaggacgcttatcctggccccaactcgagtcgtggctgcggaaatggaggaggcattgaaaggcctacccattcggtatcagaccacagccaccaagagtgaacatactggtaaagagatcgttgacctgatgtgccacgctacattcaccatgcgcctcttatcccctgtgagagtcccgaattacaacctgataattatggatgaagcccattttacggaccccgcaagcatcgccgctagggggtatatttctactcgggtgggaatgggcgaggcggccgcaatcttcatgacagctaccccacctggcaccgccgaagcatttccccagagcaatgccccaatacaggatgaggagcgagacattcctgaaagatcctggaactcagggaatgactggatcactgatttcgctggaaagacagtatggtttgtgcccagtatcaaggccggtaacgacattgcgaactgtcttcgcaaaaatggcaagaaagttatccaactgagcaggaagaccttcgatacagagtaccagaaaactaagctcaacgactgggattttgtcgtgacgaccgacatttctgaaatgggggcaaatttcaaggccgatcgtgtgatagacccacggagatgcttgaaaccggtcatcctgacagatggacctgagagggtaattctcgctggccccatgccagtgactgttgcctccgctgcacagcgccgaggtagagtggggcggaacccccagaaggagaatgaccaatacatcttcaccggccagcctctgaacaatgatgaagaccacgcccattggacagaggctaaaatgcttctagacaacatcaataccccagaaggaattatacccgccctgtttgagcctgaaagggagaagtcagcagcgatcgatggcgagtatcgcttgaaaggggaaagtcgtaagactttcgtcgagttaatgagacggggagacctgccggtgtggctcgcccacaaagttgctagcgaaggtattaagtacacggataggaagtggtgctttgacggcgagcgcaacaatcagatcctggaagagaacatggatgtggagatttggaccaaagaaggggagaagaagaaacttcgaccaagatggctggacgcccggacatattccgatcccctcgcattgaaagagttcaaagactttgctgccggaaggaagtctatcgcactggatctagtcactgagataggccgcgtgcctccccacctggcccatagaaccaggaatgctctcgacaaccttgtaatgctgcacacatcggaatacggtgggcgggcgtatcgtcatgccgtggaggagttaccagaaaccatggagactttgctgctcctgggccttatgatcctgctcacaggaggcgttatgttgttcctgattagcgggaaaggagtcggtaagacgtcaatcggcttaatttgtgtggtggcatccagtgggatgctatggatggctgatatccctctgcagtggatagcctctgccattgtcctcgaatttttcatgatggttcttctgatccccgagccagagaaacaacgcacccctcaggacaatcagttggcatacgtggtaattggaatcctgactctcgctgccatagtggcggctaacgaaatgggcctgcttgagacaaccaagcgagatctcggtatgagcaaagaaccgggggtcgtgtcccccacctcatatctggacgttgacttgcacccagcctctgcatggacactgtacgccgtggctactacggtcatcacccctatgttaagacacacaattgagaatagcactgcaaacgtaagtctagccgcgatcgctaaccaagccgtggttctgatgggcctcgataagggatggcccatttccaagatggaccttggcgtgccactgttggcactggggtgctacagccaggtcaatcctctcaccctgacagccgctgtgcttttactggtcacccattatgccatcataggacccggcctccaggcaaaagctactagggaagcccagaagcggacggcggccggtattatgaaaaacccgacagtggatgggatcatgaccatcgacttggatccagttatttacgactctaagtttgagaaacaactgggacaggtgatgctactggtactctgtgcagtgcagcttctgttgatgcgcacttcatgggctttctgcgaggccctgaccctcgcaacaggccctatcactaccctgtgggaaggttcccccggcaagttttggaatacaacgatagctgtcagtatggccaacattttcagagggagctatttagccggagcgggccttgctttttcgatcatgaagtctgttgggaccggaaaaaggggcactggttcccagggggagacactgggagaaaagtggaaaaagaaactcaatcaactaagccggaaggagttcgatctgtacaaaaagtcaggcattaccgaagtggaccgaactgaggcaaaggagggtttgaaaagaggcgaaatcacacaccatgccgtcagtcgcgggtctgctaagctgcagtggttcgtggagaggaacatggtaataccagaaggacgggtgatcgatctcggctgtgggcgtggaggctggtcctattactgcgccggtcttaaaaaggttaccgaggtgagagggtatacgaaaggaggccccggccacgaagaacctgtcccgatgagcacctacgggtggaatattgtgaagctgatctcaggaaaggacgtcttttacttgcccccagagaaatgtgatacactgctctgcgacattggtgaaagtagcccttcccccactgtggaggaatctaggaccatccgcgttttaaagatggtagagccttggctgaaaaacaatcagttctgtattaaggtgcttaacccatatatgcccgcagtcatcgagcatctggaacggctacagcgaaaacacggcgggatgctcgtgagaaatcctctgagcaggaactccacacacgagatgtactggatatcaaatggaactggcaacattgtttctagtgtgaatatgatctcgcgcttgctgctcaaccggtttaccatgacatatagacgtccaaccatcgaaaaggatgtcgaccttggtgccgggactaggcatgtgaacgctgagcccgaaacgccgaatatggacgtaattggagagcggatacgccgaatcaaggaggaacacagctccacatggcattacgatgacgagaacccttataaaacctgggcgtaccacggctcttatgaagtgaaggccactggctcagcaagctccatgattaatggggttgtcaaactgttaaccaagccatgggatgtggtgcccacagtcacgcaaatggctatgaccgacactacacctttcggacagcagagagtttttaaagagaaggtggataccaggactccaaagcccatgccgggtacacggaaagtaatggaaatcaccgccgagtggctgtggcgcacattgggcagaaacaagaggcctcgactctgcactcgggaggagttcaccaaaaaggtgcgtacgaatgcagccatgggggctgtctttaccgaggaaaaccaatgggacagtgccagagcggcagtggaggatgaagagttctggaaactggttgaccgcgagagggaactacacaaacttggaaaatgtggctcttgcgtgtacaatatgatgggtaagcgggagaagaaactgggggaatttggaaaggccaaaggcagcagagctatttggtacatgtggctcggcgcccgctatctggagttcgaggcattggggtttctgaacgaagatcattggttctcaagggaaaattcctacagtggagtcgaaggtgagggcctccacaaacttgggtatatcctgcgagacataagcaaaatccccggaggcgctatgtacgccgatgacacagctggttgggacactcggattaccgaagatgacttacataacgaggagaagatcacacagcagatggatccagaacacagacagctggccaatgcaatttttaagttgacttatcaaaacaaagtggtaaaggttcagaggcctacccccaaagggacggtgatggacatcatatctcgcaaggatcagcgtggatccggccaggtcggcacatacgggctcaataccttcactaacatggaggcgcaactgattcggcagatggaaggagagggtgtgctatcaaaaacagaccttgaaaatccacatctgctcgagaagaagatcacccagtggctggagactaaaggcgtggaaagattgaagaggatggccatcagcggggatgactgcgtcgttaaacccattgatgaccgcttcgctaacgccttactggcactcaacgatatgggaaaggtgcgaaaagacatacctcagtggcaaccatcgaagggctggcacgattggcagcaggtaccgttttgttctcaccatttccacgagcttatcatgaaggacggtcggaaactggtggtcccctgcagacctcaggacgaactaattgggagggctcgcatcagtcaaggagccggctggtccctgaaggagaccgcatgtctcggcaaagcctatgcgcagatgtgggctttgatgtactttcatagacgggatctgaggcttgccagcaatgcaatttgctcagccgtgccagttcactgggtgcccacatcccgtacgacctggtctatccacgctcatcaccagtggatgactacagaagacatgctgaccgtctggaaccgagtgtggatagaggataatccttggatggaggacaagactccagtaacaacctgggaagatgttccctacctcgggaaacgcgaggaccaatggtgtggcagcttaatcggtctgacgagtagagccacatgggcacagaacattttgaccgctatccaacaggtgcggtccctgattggcaatgaagagttcctcgattatatgcctagcatgaagaggtttcgcaaggaggaagagtctgaaggggccatctggtga

SEQ ID NO: 15128 - RNA, 9873 nt, synthetic construct
  misc_feature 1..9873: note = derived and/or modified CDS sequence (opt3) from DENV-3__JF808121__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtacgaatatgtgtaccctaatagcgatggatctcggcgagatgtgcgacgatacagtcacttacaaatgtccacatatcaccgaagttgagccggaagacattgattgctggtgtaacctgacaagtacctgggtgacttatgggacatgcaatcaggctggagagcgccgacgtgacaagagaagcgtagcccttgcaccccacgtgggcatgggtctggataccaggacgcaaacttggatgtccgccgagggggcttggcggcaggtcgaaaaagtggagacctgggcattgcgccatcctggattcacaatcctcgccctgtttctggctcactacattggcacttctctcacccagaaggttgtgatcttcatattactgatgcttgtcacaccatcgatgaccatgagatgtgtgggcgtagggaacagggactttgttgaaggattgtcaggtgccacgtgggtggatgtcgtgctggagcatggcgggtgcgtgactacaatggcgaagaataaacccaccctagacatcgagctccagaagactgaagcaacacaactggccacccttcggaaactgtgtattgagggaaagatcacgaacattaccacagatagccgctgccctactcagggcgaagctgtcttgccagaggaacaggaccagaattatgtttgtaaacacacctacgtggatcgaggttgggggaacggatgcggcctcttcggcaaggggagtctggtaacatgcgccaagtttcaatgtttagagctgatcgagggaaaagtggtccagtatgaaaatctcaagtacactgtgataattaccgttcacacaggtgaccagcatcaggtgggcaacgagacccaaggggtcactgcagaaatcacgccccaggcttccacaaccgaggccattcttcctgaatatggaactctgggcttggagtgctctccaagaaccggtctagacttcaatgagatgatcctgctcacaatgaaaaacaaggcgtggatggtgcacaggcagtggtttttcgatctgccgcttccctggaccagcggggccactacagaaacgcctacctggaatcggaaagagctgttggtaacttttaagaacgcacatgctaaaaagcaagaagttgtggtcctcggctcccaggagggagccatgcacacagctctgaccggcgccacagaaatccagaattcagggggaactagtattttcagcggtcacttaaagtgtcgtctgaaaatggacaagctagagctcaaaggcatgtcttacgcaatgtgcaccaacacgtttgtgctgaagaaagaggtctccgaaacccagcatgggacaatacttatcaaggtggagtacaagggagaagatgccccatgtaaaattcccttctcaactgaggacggccaaggtaaggctcacaacgggcgcttgatcaccgcgaatcctgttgtgacaaaaaaggaggaaccagtaaacatagaggcagaacccccgttcggcgagagcaatattgtcatcggaactggcgataacgccctgaaaatcaattggtataagaaggggagttctattggaaaaatgtttgaagctaccgccagaggtgcaaggcggatggccatcctcggcgacacggcttgggatttcgggtccgtgggaggcgttctgaacagccttggtaagatggtgcatcagatttttgggtcggcctacacagcactgttctctggcgtctcctgggtgatgaaaataggaatcggcgtattgctcacctggattgggctgaattcaaagaacactagtatgagcttttcctgcatcgcgatcggaattataacattatatctgggcgctgtggttcaggccgacatgggttgtgtcatcaattggaaagggaaggagctaaagtgcggatctggcattttcgtgaccaacgaggtgcacacttggaccgaacagtacaaatttcaagcagatagccctaagcgactcgccacagctatcgccggtgcatgggagaatggcgtctgtgggattcgctcaacgaccagaatggaaaacctgctttggaaacagatcgctaatgagttgaactatatactgtgggaaaataacatcaagctcactgttgtggtgggagacattatcggcgtactggagcaggggaaaaggacattaaccccccagccaatggagctgaagtacagttggaaaacatggggaaaggccaagattgtcactgcggaaacccaaaactccagcttcatcatagatggccctaatacgcccgagtgcccatctgcctcacgggcttggaacgtgtgggaagttgaggactatggttttggggtgttcacaaccaatatttggcttaaattgcgcgaagtctacactcagctctgtgaccatagactgatgagtgcagccgtgaaggatgagagggctgttcacgccgacatgggatactggatcgagagccagaaaaacggctcctggaagctagaaaaagcatctctgattgaggtgaagacctgcacatggcccaagtcgcacactctctggagcaatggtgtactggaatccgatatgatcatacctaaatcacttgcgggcccaatcagtcagcataaccaccgtccggggtatcatacccaaacagccggaccctggcacttgggcaagctggagttagactttaattactgcgaggggacgaccgtcgtgattactgaaaactgtggaacacggggcccttctctccgaaccactacagtgagcggtaaactgatccacgagtggtgctgtagatcctgcacccttccacccctgaggtatatgggggaagatggatgttggtacggcatggagattcgccctatctcagaaaaggaggagaatatggtcaaaagcttggtttctgctggttccggcaaggtggacaacttcacgatgggggtactctgcctggccatactatttgaagaggtgatgcggggaaagttcggcaaaaagcatatgattgcaggggtcttctttactttcgtgctgctcctgagtggacagatcacctggagagatatggctcacacacttaccatgatcggcagcaatgcctctgacaggatgggtatgggggttacttatttggcactgattgccacatttaaaatccagccattcttagctctcggatttttcctgcgcaagcttacctcccgagaaaacctgctactcggcgtgggcctggcgatggccacaactttgcaactgcccgaggatattgaacagatggcaaatgggatagctttaggactcatggccctgaaacttatcacccagtttgagacgtaccagctgtggattgccttgatctcactcacatgtagtaacaccatgttcactctgaccgtcgcttggcggacagcaactctaattctggccggtgtgagccttctcccggtttgccaatcgtcctctatgcgtaagaccgactggctgcctatggcggtggctgccatgggcgtcccacccttgcctctgtttatcttcagcttaaaggatacgctcaaaagaaggtcatggcccctgaatgagggggtaatggcagtgggacttgttagtatactggcctcctctttgctccgcaacgacgtgccaatggctggccctctggtcgcaggtgggctactgatcgcctgttatgtgattacaggaaccagcgcggatcttactgtagaaaaggctgccgacatcacatgggaggaagaggcagaacagaccggcgtgtcccataacctcatgattactgtcgacgatgacggcacaatgcggatcaaagatgacgagaccgagaatatactgacggttttgttaaagactgccctgctcattgtgtcaggggtgtttccctacagcatcccagctaccctgcttgtctggcacacatggcagaaacagacccaaagaagtggagtgctgtgggatgttccgtctcctcccgaaacacagaaggccgagttggaagagggtgtatacaggatcaaacagcagggcattttcgggaagactcaagtgggagtcggcgtgcagaaggagggtgtttttcataccatgtggcacgtgacgcgaggggcagtcctaacatataacggaaaacgcctggaaccaaattgggcttccgtgaagaaagacctcataagctacggcggcgggtggcggctgtcggcccagtggcaaaagggagaggaagtacaggtcatcgcggtggagcccggtaaaaaccctaagaatttccagactatgccaggcaccttccagacaaccactggggaaattggagccatcgcacttgattttaagcccggcacctcaggttctcctattatcaacagagaggggaaagttgtgggattatatggcaatggcgtcgtgacaaagaacgggggatacgttagtggtatagctcaaacgaatgccgagccggacggcccaactcccgaactggaggaagagatgttcaaaaagaggaacctcaccatcatggatttgcaccctgggtccggaaaaacacgtaagtatctgccagctattgtgcgcgaagcaatcaagcggagactcaggaccctgattcttgcccccactcgagtcgtggccgctgagatggaggaagcgctgaaaggcttgcctatccggtaccagacaaccgcaacgaagagcgagcatactggtcgcgaaatagtagacctaatgtgccacgccacatttaccatgagactgctctctccggtgagggttcccaattataacttaattatcatggatgaggctcatttcaccgacccagccagcatcgcagcccgggggtacatttccactcgagtcggaatgggcgaagctgcggccatctttatgacagcaacccctcccggcacagctgatgccttcccacagtcaaatgcacctatacaggacgaggagagagacattcccgaacgcagttggaacagcgggaatgagtggatcactgattttgccggaaaaacggtgtggttcgtgccatctattaaggctggtaacgacatcgccaactgtctgaggaaaaatggcaagaaggtcatacaactttcccgtaaaacctttgatacagaataccagaagactaaactgaacgactgggatttcgtagtgaccacagacatttcagagatgggggcgaattttaaggcagatcgggttatcgacccgagaaggtgcctcaaacctgtgatcttgaccgatggacccgagcgcgtcattctggccggcccaatgcccgtgactgctgccagtgctgcacagcgaagaggtcgggttgggaggaaccctcagaaggaaaatgaccaatatatcttcacgggccagccactcaacaatgatgaggaccacgcccattggaccgaagctaagatgctgcttgacaacattaatacacccgagggaataatccctgccctattcgaaccggagcgcgagaaaagcgcagcgattgatggcgaataccgtctgaagggggagtccagaaaaacttttgtggaattgatgcggaggggagacttaccagtctggctggcccacaaggtggcttctgagggtatcaaatataccgatcgcaagtggtgcttcgacggccagcgaaacaatcagatcctcgaagagaacatggatgtagagatttggacaaaagaaggggagaagaagaaactgagaccccggtggcttgacgccaggacctactcggatcctctggcactcaaggaatttaaagacttcgctgccggacgcaagagcatagcattggatctggtgactgagatcggcagagttccctcacacctagcccataggacacggaatgctctggacaacctcgtcatgcttcacacgtccgaacatggtgggcgtgcgtatcgccacgccgtggaggagctgccagaaaccatggagactttattgctgctcggcctgatgattcttctgacaggaggcgcaatgctctttttgatcagtgggaaaggaattggtaagacctctatcggcctgatatgtgtgatcgctagctccgggatgttatggatggccgaaattcctctacaatggatcgcctcagcaattgtcctggagttctttatgatggttctccttatccccgagccagaaaagcagcgaacccctcaggataatcaactggcttacgtggtaataggaattttgacactggccgcgatcattgctgccaacgagatgggcctcctggaaactacgaaaagagaccttggtatgtctaaggagccgggggtggtcagccccaccagttatctcgatgtggacctgcacccagcatccgcctggacattgtacgctgttgcaactaccgtgatcacacctatgctgaggcataccatagaaaatagcactgccaacgtctctttagcggctatcgccaaccaggcagtagtgctaatgggcctggacaaaggatggcccatttcaaagatggatctcggcgttccacttctggccttggggtgctactcccaggtgaatcctctgacgctcacagctgccgtcctgcttttaatcacccactatgcaattatcggacccggcctgcaggctaaagccactcgggaggcgcaaaagcgcaccgccgcaggtataatgaagaacccgacagtggacgggattatgactatcgatctcgacccagtcatctacgatagtaaattcgagaagcagttgggacaggtgatgctgctagttctgtgtgctgtgcagctccttctgatgagaaccagctgggccttgtgcgaagcactgacactcgctacgggccctattaccactctgtgggagggttcgcccggcaaattttggaatacaaccatcgccgtatctatggccaacatattcagggggtcctatttagcgggagctggccttgcatttagcattatgaagtcagtggggactggaaaacggggcacaggtagtcaaggggaaaccctgggagagaagtggaagaaaaagctcaatcagctatctcgaaaagaattcgacctgtacaagaaatccggcatcacggaggtcgatagaaccgaggccaaggaaggtttgaaacgcggcgagattacacatcacgctgttagcagggggtcagccaagctgcagtggtttgtggaacggaacatggtcatcccagagggacgtgtgatagacctcggctgtgggagaggaggctggagttattactgcgcaggtcttaagaaagtaactgaagtgagggggtataccaagggaggccccggccatgaggagcctgttccgatgagcacatacgggtggaatatcgtgaaactgatgtccggaaaggatgtcttctacttgcccccagaaaaatgtgacactctgctctgcgatattggtgagtctagcccttcccccaccgtggaagagtcacgcacaatccgggtcttaaagatggtggagccttggctgaagaacaatcagttctgtattaaagttcttaacccatatatgcccaccgtaatcgaacacctggagcgactacaaagaaagcacggcgggatgctcgtgaggaatcctctgtctcgcaacagtactcatgaaatgtactggatttcgaatggaacgggcaacatcgtcgccagcgtgaatatggtttcccggttgctgctcaacagatttacaatgaaacaccgtaggccaaccatagagaaggacgtggatcttggtgctgggactcggcatgtcaacgcggaacccgagaccccgaatatggacgtgattggagagcgcatcaaacgaatcaaggaagagcacaactctacatggcactatgacgatgaaaatccttacaagacgtgggcctatcatggctcatacgaggtaaaagcaaccggcagcgcttccagtatgattaacggggtggttaagctgttaactaaaccatgggacgtcgtgcccatggtgacacagatggccatgaccgatactacacctttcggacagcaaagagtctttaaggaaaaagttgacaccaggacaccacggtctatgcccggtactcgcagagtgatgggcataaccgcagagtggctgtggaagacgttggggaggaataagaaaccgcgactctgccctcgggaggaattcaccaagaaagtacgtacaaacgccgctatgggagccgtgtttactgaggaaaatcagtgggatagcgcgaaggcagccgtcgaggacgaagatttctggaaactggtggacagagagcgcgagctacacaagcttggcaaatgtggttcatgcgtttataacatgatggggaagagggaaaagaaactgggagagtttggcaaggctaaaggctcccgggccatctggtacatgtggctcggggcaagatacctggaattcgaggctttgggatttctgaatgaggatcattggttcagtcgcgaaaacagctattctggtgtggagggcgaagggctccacaagcttggatacattctgagggacatctccaaaattcccggcggtgccatgtatgctgatgacaccgccgggtgggacacacgaatcactgaggatgacttacataatgaagagaagataacccagcagatggatccagagcaccggcaactggcaaacgcgatctttaagttgacgtaccagaataaagtcgtgaaggtacagagacctacacccaccggaactgttatggacattatctcaaggaaagatcagcgcggcagcggccaagtggggacatatggactcaacaccttcactaatatggaagcccagctgattcgtcagatggagggtgaaggcgtcctatcgaaggctgaccttgagaacccacacctgcccgaaaaaaagatcacccagtggctcgagacaaagggggtggagcggctgaaaagaatggccatatctggagatgactgcgtggtcaagcctattgatgacaggtttgcaaacgctttgttagccctgaatgatatgggcaaagttcgcaaggacatcccacaatggcagccgagtaaaggttggcatgattggcagcaggtgcccttctgttcccaccatttccacgaactcatcatgaaggacgggcgaaagcttgtagtgccttgccggccacaagacgagctgattggaagagcaaggataagccagggctcaggctggtccctacgcgaaacggcctgtctggggaaagcgtacgctcagatgtggtctctcatgtattttcacagacgggatttgaggctggccagcaacgcaatctgcagtgccgtccccgtgcattgggttcctacctcccgtatgacttggagcattcacgctcatcaccaatggatgacaaccgaggacatgcttactgtgtggaatcgagtctggatcgaagataacccatggatggaggacaagacacccgtgaccacgtgggagaatgtaccttacctgggaaaacgcgaagatcagtggtgtggttctctcattggcttaacatcaagagccacctgggcacagaacatcccgactgctatacagcaagttcggagtctgatcgggaatgaggaattcttggactacatgccatccatgaagaggtttcgcaaagaggaggaaagcgagggagccatttggtga

SEQ ID NO: 15129 - RNA, 9873 nt, synthetic construct
  misc_feature 1..9873: note = derived and/or modified CDS sequence (opt3) from DENV-3__JF808120__SS-prME
  source 1..9873: mol_type = other RNA
accagcctgtgcctcatgatgatccttcccgcagctctggcattccacttgacatccagagacggagagcctaggatgattgtggggaagaatgaacggggaaagtctttactgtttaagactgcctcaggtataaatatgtgtacgctgatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccagacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagctgatagagggaaaagtggtccagtatgaaaatctcaagtacacagtgattatcactgttcacaccggtgaccagcatcaggtgggcaacgagacacaaggggtcaccgcagaaattactccccaggcttccacgacagaggccatccttcctgaatatggaaccctgggcttggagtgctctccaagaactggtctagacttcaatgagatgatcctgctcaccatgaaaaacaaggcgtggatggtgcacaggcagtggtttttcgatctgccgcttccctggacaagcggggccaccactgaaacacctacgtggaatcggaaagagctgttggtaacctttaagaacgcacatgctaaaaagcaagaagttgtggtcctcggctcccaggagggagccatgcacactgctctgacaggcgccaccgaaattcaaaattcagggggaacaagtatattcgcaggtcacttaaagtgtcgtctgaaaatggacaagctagagctcaaaggcatgagctacgccatgtgcactaacacctttgtgctgaagaaagaggtctctgaaacgcagcatgggaccatccttattaaggtggagtacaagggagaagatgctccatgtaaaatccccttctccacagaggacggccaaggtaaggcgcacaacgggcgcttgataactgcaaatcctgttgtgaccaaaaaggaggaaccagtaaacattgaggccgaacccccgttcggcgagtcaaatatcgtcatcggaacaggcgataacgctctgaaaattaattggtataagaaggggagcagtatcggaaaaatgtttgaagccactgcaagaggtgccaggcggatggctattctcggcgacaccgcctgggatttcgggtctgtgggaggcgttctgaactcccttggtaagatggtgcatcagatatttgggagcgcatacacggcgctgttctcgggcgtctcttgggtgatgaaaatcggaattggcgtattgctcacatggatcgggctaaattccaagaacacctcaatgagttttagctgcatcgctattggaataatcactttatatctgggcgccgtggttcaggcagacatgggttgtgtcattaattggaaagggaaggagctaaagtgcggatccggcatcttcgtgacaaacgaggtgcacacctggactgaacagtacaaatttcaagccgattctcctaagcgactcgctaccgccattgccggtgcttgggagaatggcgtctgtgggatccgcagcacaacgagaatggaaaacctgctttggaaacagatagccaatgagttgaactatatcctgtgggaaaataacattaagctcaccgttgtggtgggagacatcattggcgtactgaaacaggggaagaggactttaacaccccagccaatggagctgaaatactcatggaagacctggggaaaggcgaaaatcgtcacagccgagactcaaaacagttccttcataattgatggccctaatacccccgaatgcccaagcgcttctcgggcatggaacgtgtgggaggttgaagactatggttttggggtgttcacgacaaatatctggcttaagttgcgcgaggtctacacccagctctgtgaccatagactgatgtcagccgctgtgaaagatgaaagggccgttcacgcagacatgggatactggattgagagtcagaagaacggcagctggaaactagagaaggcgtccctgatcgaagtgaagacttgcacctggcccaaatctcacacactctggtcgaatggtgtactggagagcgatatgataatccctaagtcccttgccggcccaatttcacagcataaccaccgtccggggtatcatactcaaaccgctggaccctggcacttgggcaaactggaattagactttaattactgcgaggggacaacggtcgtgatcaccgagaactgtggaactcggggccctagtctccgaacaaccactgtgtctggtaagctgattcacgaatggtgctgtagaagctgcacacttccacccctgaggtatatgggggaggatggatgttggtacggcatggaaatccgccctatatccgagaaagaagagaatatggtcaagtcattggttagcgccggttctggcaaggtggacaacttcaccatgggggtactctgcctggcaattctatttgaggaagtgatgcggggaaaattcggcaagaaacatatgatcgctggggtcttctttacgttcgtgctgctcctgtccggacagatcacttggagagatatggcccacacccttattatgatcggcagtaatgcaagcgacaggatgggtatgggggttacatatttggccctgattgctacctttaagatacagccattcttagcgctcggatttttcctgcgcaaacttacttctcgagagaacctgctactcggcgtgggcctggccatggcaacaaccttgcaactgcccgaagatatcgagcagatggctaatgggattgccttaggactcatggccctgaaacttatcacacagtttgaaacttaccagctgtggaccgctttgatttccctcacgtgttcaaacacaatgttcaccctgactgtcgcatggcggaccgccacactaatcctggcgggtgtgagtcttctcccggtttgccaaagctcgtccatgcgtaagactgactggctgcctatggctgtggccgcaatgggcgtcccacccttgcctctgtttatattcaatttaaaagataccctcaagagaaggtcttggcccctgaacgagggggtaatggccgtgggacttgttagcatcctggcttcaagtttgctccgcaacgacgtgccaatggcaggccctctggtcgccggtgggctactgattgcgtgttatgtgatcacgggaacatccgctgatcttaccgtagagaaagccgcagacattacttgggaagaggaagccgagcagacaggcgtgtctcataatctcatgatcaccgtcgacgatgacggcactatgcggataaaggatgacgaaacagagaacattctgaccgttttgttaaaaacggctctgctcatcgtgagcggggtgtttccctactccatcccagccactctgcttgtctggcacacctggcagaagcagacacaaagatcaggagtgctgtgggatgttccgagccctcccgagacccagaaagcagaattggaggaaggtgtatacaggattaagcagcagggcatactagggaagacacaagtgggagtcggcgtgcagaaagagggtgttttccatactatgtggcacgtgacccgaggggctgtcctgacgtataatggaaagcgcctcgagccaaactgggccagtgtgaaaaaggacctgatctcttacggcggcgggtggcggctttccgcgcagtggcaaaaaggagaagaggtacaggtcattgccgtggaacccggtaagaatcctaagaactttcagacaatgccaggcactttccagaccacaaccggggagatcggagcaattgctttagatttcaaacccggcactagcggttcgcctatcataaatagagaagggaaggttgtgggactgtatggcaacggcgtcgtgaccaaaaatgggggatacgtttcaggtatcgcccaaacaaacgctgagccggacggcccaacgcccgagctcgaagaggaaatgtttaagaaaaggaatttgactattatggatctgcaccctgggtctggaaagacccgtaagtatctcccagcaatcgtgcgcgaggccattaaacggagactgaggacacttatcctggcccccacccgagtcgtggctgcggaaatggaggaggcattgaagggcctacctatacggtaccagactacagccaccaaaagtgaacatacgggtcgcgagattatcgacctgatgtgccacgctactttcacaatgagactcttatccccggtaagggtgcccaactataatctgatcattatggatgaagcccattttaccgacccagcaagcatcgccgctcgggggtacatatctacccgagttggaatgggcgaggcggccgcaattttcatgactgctacacctcccggcaccgccgatgcatttccacagagcaacgcccctatccaggacgaagagagagacattcccgagcgctcctggaactcagggaacgaatggatcacagatttcgctggaaagactgtctggtttgtgccaagtataaaagccggtaacgacattgcgaattgtcttaggaagaacggcaagaaagtgatccaactgagccgtaagacgttcgataccgagtaccagaaaacaaagctcaatgactgggattttgtcgtaactaccgacatctctgaaatgggggcaaacttcaaagccgatcgggtgattgacccgagaaggtgcttgaagcctgttatcctgacagatggacccgagcgcgtgattctcgctggcccaatgcccgtcaccgccgcttccgcagcccagcgaagaggtcgggtggggaggaatcctcagaaggagaacgaccaatatatatttactggccagccactgaataacgatgaagaccacgctcattggacggaggccaaaatgcttctagacaatatcaacacccccgaaggaattatccctgcactgttcgagccggaacgcgagaagtcagcggccatcgatggcgagtaccgtttgaaaggggaaagtagaaagacattcgttgagttaatgcggaggggagacctgccagtgtggctcgctcacaaagtcgccagcgaaggtattaagtatactgatcgcaaatggtgctttgacggccagcgaaataaccagatactggaggaaaatatggatgtggagatctggaccaaggagggggaaaagaagaaacttagaccccggtggctggacgcaaggacatactccgatcctctcgctttgaaagagttcaaagactttgccgcaggacgcaaatctattgccctggatctagtaaccgaaatcggcagagtgccctcgcacctggctcataggactcggaacgcgctcgacaatcttgttatgctgcacacaagcgagcatggtgggcgtgcctatcgccacgcagtcgaagagttaccagagacgatggaaaccttgctgctcctgggccttatgattctgctcactggaggcgctatgttgttcctgatctcagggaagggaataggtaagacatccatcggcttaatttgtgtgatcgccagttctgggatgctatggatggccgagattcctctgcaatggatcgcaagcgctatagtgctcgaatttttcatgatggtccttctgattcccgagccagagaaacagcgaacccctcaggataaccaattggcctacgttgtgatcggcattctgaccctcgcggctatcatagccgcaaatgaaatgggcctgcttgagacaactaagagagacctcggtatgtccaaagaaccgggggtagtgtcacccacgtcttatctggatgtcgacttgcacccagccagcgcttggaccctgtacgcagtggccacaactgttatcacccctatgttaaggcatacaattgagaacagtaccgcgaacgtgtccctagctgccatcgcaaatcaggccgtcgtactgatgggcctcgacaagggatggcccattagcaaaatggatcttggcgtgccactgttggctctggggtgctactctcaggttaaccctctcactctgacggccgcagtgcttttactgatcacacactatgctataattggacccggcctccaggccaaggcgacccgggaagcccaaaagcgcactgcagctggtatcatgaaaaatccgaccgtcgacgggatcatgacaattgatttggacccagtgatctacgattcaaagtttgagaaacagctgggacaggtcatgctactggtgctctgtgccgttcagcttctgttgatgagaacttcctgggcactgtgcgaggctctcaccctggccacaggccctataacgaccttatgggaaggtagtcccggcaagttctggaacactacaattgccgtgagcatggcgaatatctttagggggtcgtatcttgctggagcaggcctggccttctctattatgaaatccgtagggaccggaaagcggggcactggtagccaaggggagacactcggagaaaagtggaaaaagaaactaaaccagctgtcacgaaaggagtttgacttgtacaaaaagagtggcatcaccgaagtggatagaacggaggctaaagagggtctgaagcgcggcgaaataacccatcacgccgtctctagggggtccgcaaagctccagtggttcgttgagcggaatatggtgatcccagaaggacgtgtcattgaccttggctgtgggagaggaggctggagctattactgcgccggtctgaaaaaggtgacagaggtaagggggtatactaaaggaggccccggccatgaagaacctgtgccgatgaccacatacgggtggaacatcgttaagttgatgtcaggaaaagatgtgttttacctgcccccagagaagtgtgacactctcttatgcgatattggtgaaagtagcccttcccccaccgtcgaggaatctcgcacaatccgggtgctgaagatggtcgagccttggcttaaaaataaccagttctgtattaaggtgctgaatccatatatgcccaccgttatcgagcacctagaacgactccaaagaaaacacggcgggatgctggtaaggaaccctttgagccgcaattccactcatgagatgtactggatatcaaacggaacgggcaatattgtggcttctgtcaacatggtgagtcggctgctccttaacagattcacaatgacccaccgtaggccaactatcgaaaaggacgttgatctgggtgcggggacccggcatgtgaatgccgagcccgaaacaccgaacatggacgtcatcggagagcgcattaaacgaataaaggaggaacacaattcgacgtggcactatgacgatgagaacccttacaagacctgggcatatcatggcagctacgaagtgaaagctactggctccgcctcttcaatgatcaatggggtagtgaagttactgacaaaaccatgggacgttgtccccatggtgacccagatggcaatgactgatacaaccccttttggacagcaaagagtgttcaaggagaaagtcgacacaaggactccacggagcatgcccggtacccgcagagttatgggcattacggccgaatggttgtggaggaccctcgggcgaaacaagaagccgcggctgtgcacacgtgaggagtttactaaaaaggtgagaaccaatgctgccatgggagcggtattcacagaagagaaccagtgggattccgcaaaagccgctgtggaagacgaggatttttggaagctagtcgaccgcgaaagggagcttcacaaactgggcaagtgtggtagttgcgtgtataatatgatggggaaacgggagaagaagctcggagagttcggcaaagccaagggctctagagcaatctggtacatgtggctgggggctcgctacttggagtttgaagccctgggattcctcaacgaggatcattggtttagcagggaaaattcatattccggtgttgaaggcgaggggcttcacaaactgggatacattttacgagacatcagtaagatacctggcggtgctatgtatgccgatgacactgcagggtgggacacccggatcacggaagatgacctgcataacgaggagaagattacacagcagatggatcccgagcacagacaattggcgaatgccatcttcaagctcacctaccagaacaaggtggtcaaagtgcagaggccaactcctacaggaaccgtaatggacattatcagccgcaaggatcagcgtggctctggccaagttgggacttatggactgaatacctttacaaacatggaggctcagctaatacggcagatggaaggtgagggcgtgctttccaaagccgacctggaaaacccccacctcccagagaagaaaattacgcagtggctggaaaccaagggggtcgagagattgaagaggatggcaatctcaggagatgactgcgtggtgaaacccatcgatgaccgcttcgctaatgccttactggcactcaacgatatgggcaaggtccgaaaagacattcctcaatggcagccaagcaagggttggcatgattggcagcaggttccgttttgttcgcaccatttccacgagcttataatgaaagacgggcggaagctggtggtaccctgcagacctcaagacgaactaatcggaagggcccgcatttctcagggcagtggctggtccctgagagagactgcgtgtctcgggaaggcttacgcccagatgtggagcttgatgtatttccaccggagggatctgcgtcttgcatcaaatgccatctgctccgctgtgccagtccattgggtgcccacatctcgaaccacttggagcattcacgcccatcaccaatggatgacaaccgaagacatgctgacggtttggaaccgcgtgtggatcgaggataatccttggatggaagacaaaacaccagtcaccacttgggagaacgtgccctacctcggaaagagagaggatcagtggtgtggtagtttaataggcctgacctcccgggcaacatgggctcagaatatccctactgccattcagcaagtaaggagcttgatcgggaacgaagagtttctggactacatgccgtctatgaaacgcttcagaaaggaagaggagtcagaaggagcgatttggtga

SEQ ID NO: 15130 - RNA, 9873 nt, synthetic construct
  misc_feature 1..9873: note = derived and/or modified CDS sequence (opt3) from DENV-3__JF808119__SS-prME
  source 1..9873: mol_type = other RNA
accagcctgtgcctcatgatgatccttcccactgccctggctttccacttgacttccagagacggcgagcctaggatgattgtggggaagaacgaacggggaaaatctttactgtttaagacggcatcaggtataaatatgtgtaccctaatcgccatggatctcggcgagatgtgcgacgatacagtcacttacaaatgtccacatattaccgaagttgagccggaagacatcgattgctggtgtaacctgacaagtacctgggtgacttatgggacatgcaatcaggcgggagagcaccgccgagacaagcgtagcgtagctcttgcaccccatgtgggcatgggtctggataccagaacgcagacttggatgtccgcagagggggcctggaggcaggtcgaaaaagtggagacctgggctttgcggcaccctggattcacaattctcgcactgtttctggcccattacatcggcacttctctcacccagaaggttgtgatattcatcttactgatgcttgtcacaccatcgatgaccatgcgctgtgtgggcgtagggaacagagactttgttgaaggattgtcaggtgctacgtgggtggatgtcgtgctggagcacggcgggtgcgtgactacaatggccaagaataaacccaccctagacattgagctccagaagactgaagcgacacaactggcaacccttaggaaactgtgtatcgagggaaagattacgaacatcaccacagatagccggtgccctactcagggcgaagccgtcttgccagaggaacaggaccagaattatgtttgtaaacacacctacgtggatcgcggttgggggaacggatgcggcctcttcggcaaggggagtctggtaacatgcgctaagtttcaatgtttagagcccatagagggaaaagtggtccagtatgaaaatctgaagtacactgtgattatcaccgttcatacaggtgaccagcaccaggtgggcaacgagacccaaggggtcactgccgaaattacgcctcaggcatccacaaccgaggctatcctcccagaatatggaactcttggcctggagtgctctccgcgaaccggtttggacttcaatgagatgatcctactgacaatgaaaaacaaggcctggatggtgcatagacagtggtttttcgatctccccctgccttggaccagcggggcgactacagaaacgccaacctggaataggaaagagcttctggtaacttttaagaacgcccacgccaagaagcaagaagttgtggtcttgggctcccaggagggagctatgcacacagccctcaccggcgctacagaaattcaaaattcagggggaacaagtatattcgccggtcatctgaagtgtcggttaaaaatggacaagctggagctaaaaggcatgagctacgcaatgtgcaccaacacgtttgtgctcaagaaagaggtctctgaaacccagcacgggacaatcctgattaaggtggagtacaagggagaagatgccccctgtaaaatccctttctccactgaggacggccaaggtaaggctcataacgggcgtcttataaccgcgaatccagttgtgactaagaaggatgagcccgtaaacattgaagcagagccgcctttcggcgaatcaaatatcgtcatcggaattggcgacaacgccttgaaaatcaattggtataagaaggggagcagtattggaaaaatgtttgaggctactgcccgcggtgcaagaaggatggccatactgggcgataccgcttgggacttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgatatgggttgtgtcatcaattggaaagggaaggaactgaagtgcggatccggcattttcgtgacaaacgaggtgcatacctggactgagcagtacaaatttcaagcagactctcccaagcggctagccaccgctatcgccggtgcatgggaaaatggcgtctgtgggatacgaagcacaacgcgcatggagaacctcctgtggaaacaggttgctaatgaacttaactatatcttgtgggagaataacattaagctgaccgtggtggtaggagatatcattggcgtcctcgaacaggggaaaagaactctgacaccacagcctatggagttaaagtactcatggaaaacctggggaaaggccaagatcgtgacagcggagactcaaaacagttccttcataattgacggccccaataccccagaatgccccagcgcctctagggcttggaacgtttgggaggtggaagactatggttttggggtcttcacgacaaatatctggctgaaacttcgggaggtgtacacccagttgtgtgatcaccgcctcatgtcagcagccgttaaggacgaaagagctgtgcacgccgatatgggatactggattgagagtcagaaaaacggcagctggaagctggagaaagcatccctaatcgaagtaaagacttgcacctggcctaagtctcatacactgtggtcgaatggtgtcctcgagagcgacatgataatcccaaaatccctggcgggcccgatttcacagcacaaccataggcccgggtatcacactcaaaccgccggaccttggcaccttggcaagttggaactggattttaattactgcgaggggacaacggtggtgatcaccgagaactgtggaactcgtggcccaagtttacggacaaccactgtctctggtaaactcattcatgaatggtgctgtcgaagctgcacactgccccctcttagatatatgggggaggacggatgttggtacggcatggaaatcaggccaatatccgagaaggaagagaatatggttaaatcactggtgagcgctggttctggcaaggtagataacttcaccatgggggtgttgtgcctcgccattctgtttgaggaagtcatgcgcggaaagttcggcaaaaagcacatgatcgcaggggtgttctttatgttcgttctactgctctccggacagatcacgtggcgggacatggctcatactctgattatgatcggcagtaatgccagcgatagaatgggtatgggggtgacctatcttgcattgattgccacatttaaaatacagcccttcctggctttaggatttttcctcaggaagctgacctctcgcgagaaccttctgctaggcgtcggcctcgcgatggccactacactgcaattgccggaagacatcgagcagatggcaaatgggattgctctgggattaatggccctcaaactgatcacccagtttgaaacataccagctttggactgccctgatttccttgacctgttcaaacacgatgttcacactcaccgtggcttggcgaactgcaaccctgatcctagccggtgttagtctgcttcctgtgtgccaaagctcgtccatgcggaagacagattggctcccaatggcggtcgctgccatgggcgtaccccctctgcccttgtttatattctctctgaaggacactttaaaacgtagaagctggccactcaatgagggggtgatggcagttggactggtgtcaatccttgccagttccctgttgaggaacgatgtccctatggctggccccctcgtggctggtgggctgctaattgcctgttatgtaatcaccggaacgtctgcggacctgacagtggagaaggctgccgacattacctgggaagaggaagcagagcagactggcgtcagccacaaccttatgatcacagttgatgacgatggcaccatgcgcataaaagacgatgaaactgagaatattctcacagtgctgttgaagaccgccttactgatcgtgtccggggtctttccatactcaatcccggctacgctcctggtgtggcatacttggcagaaacagacccaacggagcggagttctttgggacgtacctagtcccccagagacacagaaggccgaactggaggaaggtgtgtacagaattaaacagcagggcatattcgggaagacccaagtcggagtgggcgttcagaaggagggtgtgtttcacacaatgtggcacgtcactagaggggcagtgttgacctataacggaaaacgactagagcccaattgggcttctgtaaagaaagatctgatctcctacggcggcgggtggcgcctcagcgcccagtggcaaaagggagaagaggtccaggtgattgcggttgaacctggtaaaaacccaaagaatttccagacgatgcccggcacattccagactaccacaggggagatcggagccattgcactggactttaagcctggcacctcgggttcaccgatcataaaccgggaagggaaagtggtcggactttatggcaatggcgtggttactaagaacgggggatacgtgtctggtatcgctcaaaccaatgccgagccagatggccccacacctgagttagaagaggaaatgttcaaaaagagaaacctgacgattatggacctccatccagggagtggaaaaactaggaagtatttgcccgctatcgtccgtgaggcaattaagcgccggctgagaaccctcatcctggcccctacaagggtggtagccgctgaaatggaggaggcgcttaaaggcctgccgatacgataccagaccactgcaacaaagtccgaacacaccggtcgggagattgtggatttgatgtgccatgccacgtttactatgcgcctactgagccccgttagagtcccaaattataacctcatcatcatggacgaagctcacttcacagatcctgcctctattgcagccagggggtacatcagcacccgggtgggaatgggcgaggctgcggccatatttatgaccgcaactcccccaggcacagctgacgccttccctcagtccaatgcacccattcaggacgaggaacgagatatcccagagagatcatggaacagtgggaatgaatggattaccgactttgccggaaaaacagtgtggttcgtcccgagcatcaaggctggtaacgatatagccaactgtttacgcaaaaatggcaagaaggtaattcaactgtctaggaaaacttttgacacggagtaccagaagaccaaacttaacgattgggacttcgtggttacaactgatatctccgaaatgggggcgaattttaaggcagaccgtgtgatcgatcctcggagatgcctgaaacccgtcattctcaccgacggaccagagagggtgatcttggccggccccatgcctgttacagctgcctcagctgcacagcgccgaggtagagtggggcggaacccacagaaggagaatgatcaatatattttcaccggccagcccctgaacaatgacgaagaccatgcccactggactgaggctaagatgctcctggataacataaatacgcctgaaggaatcattccggcccttttcgagccagaaagggagaaaagtgcagcgatcgacggcgagtaccgcctaaagggggaaagccgtaaaacctttgtcgagctgatgagacggggagatttgcccgtgtggttagcccacaaggtagcttccgaaggtatcaaatatacagacaggaagtggtgcttcgatggccagcgcaacaatcagattctggaggaaaacatggacgtggagatatggactaaagagggggaaaagaagaaactccgacctagatggctggatgcccggacctactctgacccccttgcactgaaggagtttaaagatttcgctgccggaaggaagtcgatcgcactcgacttggttacagaaattggccgcgtcccaagccatctggcccacagaaccaggaatgctctagataacctggtgatgctccatacttcagagcacggtgggcgggcgtatcgtcacgccgtggaagaacttcctgagacaatggaaacgctgttattgctgggcctcatgatcctgcttaccggaggcgcaatgctgtttctcatttccgggaaaggaatcggtaagacaagtataggcttgatctgtgtcattgcttctagcgggatgctgtggatggccgagatccccttacaatggattgcctccgcaatcgttctagagttctttatgatggtgctgctcataccagagcctgagaagcagcgcacaccgcaggacaatcaacttgcttacgtagtgattggaatcctgaccttggccgcgattatcgctgccaacgaaatgggcctgctcgagaccacaaaacgagatctgggtatgtcaaaggaacccggggtcgtgtctccaactagctatcttgacgttgacctccatcctgcaagtgcctggacgctgtacgctgtggcaaccacagtcataactcccatgttgagacacaccatcgaaaattccacagccaacgtaagcctggcggctattgccaaccaggcagtggttttaatgggcctagataaaggatggccaatctctaagatggacctgggcgtgcctctccttgccctggggtgctactcacaggtcaatcccttgaccctgactgctgccgtgctcctgcttattacgcattatgcaatcataggaccgggcttacaggctaaagccacaagggaagcgcaaaagcggaccgccgcaggtattatgaagaacccaactgtcgatgggatcatgaccatcgacctggatcctgtgatttacgactccaaattcgagaagcagctcggacaggttatgttgctggtgctatgtgctgtacagctgctccttatgcgcacaagttgggccctgtgcgaggcattgactctggctaccggccccatcacaacgctctgggaaggtagcccaggcaaattttggaataccactatagccgtgtcgatggccaacattttcagagggtcttatctggcgggagctggcttagcattttccatcatgaaaagcgtcgggacaggaaaaaggggcaccggttcacaaggggagactcttggagaaaagtggaagaaaaagctgaatcagctcagtcggaaagagttcgatctatacaagaaatctggcattacagaagttgaccgaaccgaggccaaggagggtctgaaaagaggcgaaacgacccaccatgctgtgtcccgcgggagcgccaagttgcagtggtttgtcgagaggaacatggtgatccccgaaggacgggtaatagatctgggctgtgggcgtggaggctggtcatattactgcgcaggtctcaagaaagtgacagaggttagagggtatactaagggaggccctggccacgaggaaccggtgcccatgagtacctacgggtggaatatcattaaacttatgagcggaaaggacgtcttctacctgccacctgagaaatgtgatacattgctgtgcgacatcggtgaatcctctcccagccctactgtggaggaatccaggaccattcgcgtcctcaagatggtggagccatggttaaagaacaatcagttctgtatcaaaattctgaacccctatatgcctacagttatcgagcaccttgaacggctgcaacgaaagcatggcgggatgctagtaagaaatccactctcaaggaactctacccacgagatgtactggataagtaatggaactggcaacattgtggcctcggtcaatatggtgagccgcctgttgctgaaccggtttacgatgacacatagacgtcccaccatcgaaaaagatgttgacctcggtgctgggactaggcacgtgaacgcggagccggaaacccctaatatggacgtcatcggagagcggattaagcgcataaaagaggaacacaactccacatggcattatgatgacgagaatccatacaagacgtgggcctatcacggctcttacgaagtgaaggcaaccggctcagctagctccatgatcaacggggtagtgaaacttctgactaagccctgggatgttgtccctatggtgacacagatggccatgaccgacactacaccattcggacagcaacgagtgtttaaagagaaggtcgataccagaacacccaggagtatgccgggtactcggcgcgttatgggcattaccgcagaatggttatggagaacgctggggaggaataaaaagcctcgattgtgcacccgggaggagttcacaaagaaagtgcgtactaacgccgctatgggagccgtatttaccgaagagaatcagtgggactctgcgaaggcagccgtggaagatgaggacttctggaaactcgtcgatagagaacgcgagctgcataagctaggcaaatgtggtagctgcgtgtataacatgatggggaagagggagaagaaacttggagaatttggcaaagctaaaggctcacgggccatctggtacatgtggctgggggcaagatacctcgagttcgaagctctgggatttttgaatgaggaccactggttctcccgcgagaacagttatagcggtgttgaaggcgaggggctgcataagctcggatacattcttagggatatctctaaaatacccggcggtgccatgtatgctgacgacacagccgggtgggatactcgaatcaccgaagacgatctgcacaatgaggaaaagattacgcagcagatggacccagagcaccggcaattagcaaacgcgatctttaaactgacataccagaataaggtggtcaaggtgcagagacctacccccactggaacagtaatggatattatctccaggaaagaccagcgcggctcaggccaagttgggacctatggattgaacactttcaccaatatggaggcccagctcatacgtcagatggaaggtgagggcgtgctgagcaaggctgatctagaaaacccacatcttcccgagaaaaagattacacagtggctggaaacgaaaggggtcgagcggctcaagagaatggccatctcgggagaggactgcgtgctgaagcctatcgatgacaggtttgataacgcattgttagctctgaatgacatgggcaaagtgcgcaaggatattccacaatggcagccgtctaaaggttggcacgactggcagcaggtccccttctgtagtcatcacttccacgaactcataatgaaggacgggcgaaaacttgttgtgccttgccggccacaagatgagctgatcggaagggccaggatttcccagggcgcaggctggagcctacgcgaaaccgcctgtctggggaaggcgtacgctcagatgtggtcactcatgtattttcatagacgggacttgaggctggcctccaacgcaatctgctctgccgtacccgtgcactgggtccctactagccgtacaacctggagtattcatgcacttcaccaatggatgactacagaggatatgatcaccgtgtggaatcgagtttggatagaagacaacccatggatggaggataagacgcccgtgacaacctgggaggacgtcccttacctgggaaaacgcgaagatcagtggtgtggttccctcatcggcttaactagcagagccacctgggcacagaatattccgacagctatccagcaagtgcggtctctgattgggaacgaggagttcttggactacatgccatcaatgaagaggtttcgcaaagaggaggaaagtgagggagccatctggtga

SEQ ID NO: 15131 - RNA, 9873 nt, synthetic construct
  misc_feature 1..9873: note = derived and/or modified CDS sequence (opt3) from DENV-3__JF808118__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccatccttcggaaactgtgtattgagggaaagatcacaaacataaccacggatagccgctgccctacccagggcgaagctgtcttgccagaggaacaggaccagaattatgtttgtaaacacacatacgtggatcgaggttgggggaacggatgcggcctcttcggcaaggggagtctggtaacttgcgccaagtttcaatgtttagagcccattgagggaaaagtggtccagtatgaaaatctgaagtacaccgtgatcattacagttcacactggtgaccagcatcaggtgggcaacgagacccaaggggtcacagcagaaatcacccctcaggcttccactacggaggccatcctcccagaatatggaacacttggcctggagtgctctccgagaaccggtttggacttcaatgagatgattctactgactatgaaaaacaaggcgtggatggtgcacaggcagtggtttttcgatctccccctgccttggaccagcggggccacaaccgaaactccaacatggaatcggaaagagcttctggtaacgtttaagaacgcacatgctaaaaagcaagaagttgtggtcttgggctcccaggagggagccatgcacaccgctctcactggcgccacagaaatacagaattcagggggaaccagtatcttcgcaggtcacctgaagtgtcgtttaaaaatggacaagctggagctaaaaggcatgagctacgccatgtgcacaaacacttttgtgctcaagaaagaggtctctgaaacccagcatgggacgattctgatcaaggtggagtacaagggagaagatgctccctgtaaaatacctttctccaccgaggacggccaaggtaaggcgcacaacgggcgccttattacagcaaatccagttgtgactaaaaaggaggaacccgtaaacatcgaggccgaaccgcctttcggcgagtcaaatatcgtcattggaatcggcgataacgctttgaaaattaattggtataagaaggggagcagtataggaaaaatgtttgaagccaccgcaagaggtgccaggcggatggctatcctgggcgacacagcctgggatttcgggtctgtgggaggcgttctcaactccctgggtaagatggtgcatcagatttttgggagcgcatacactgcgcttttctcgggcgtctcttgggtgatgaaaatcggaatcggcgtactgttgacctggattgggctcaattccaagaacacgtcaatgagttttagctgcatagctatcggaattatcacactgtatttaggcgccgtggttcaggcagacatgggttgtgtcattaattggaaagggaaggagctgaagtgcggatccggcatcttcgtgaccaacgaggtgcacacttggacagaacagtacaaatttcaagccgattctcccaagcgactagctaccgccatagcaggtgcttgggagaatggcgtctgtgggatccgcagcactaccagaatggaaaacctcctgtggaaacagattgccaatgagcttaactatatcttgtgggaaaataacattaagctgacagttgtggtgggagacatcataggcgtactcgagcaggggaaaaggacgctgaccccacagcctatggagttaaagtactcatggaaaacttggggaaaggcgaagattgtcacagccgaaacccaaaacagttccttcatcattgatggccccaatacaccagagtgccccagcgcttctcgggcatggaacgtgtgggaagttgaggactatggttttggggtgttcactaccaatatctggctgaaacttcgcgaagtctacacgcagttgtgtgaccatagactcatgtcagccgctgtgaaggatgagagggccgttcacgcagacatgggatactggatagagagtcagaaaaacggcagctggaagctggaaaaagcgtccctaatcgaggtgaagacatgcacctggcctaagtctcacactctgtggtcgaatggtgtactcgaaagcgatatgattatcccaaaatccctggccggcccgatttcacagcataaccaccgtcccgggtatcatacccaaacagctggaccttggcaccttggcaagttggagctggactttaattactgcgaggggactaccgtcgtgatcacagaaaactgtggaacgcggggcccaagtttacgaaccactacagtgtctggtaaactcatacacgagtggtgctgtagaagctgcaccctgccccctcttaggtatatgggggaagatggatgttggtacggcatggagattcgcccaatctccgaaaaggaggagaatatggtcaaatcactggttagcgccggttctggcaaggtggacaacttcactatgggggtattgtgcctcgcaatcctgtttgaagaggtgatgcggggaaagttcggcaaaaagcatatgattgctggggtcttctttacattcgtgctactgctctccggacagatcacctggagagatatggcccacacgctgattatgataggcagtaatgcaagcgacaggatgggtatgggggttacttatcttgccttgatcgctacctttaaaattcagcccttcctggcgttaggatttttcctccgcaagctgacatctcgagaaaaccttctgctaggcgtgggcctcgccatggcaaccactctgcaattgccggaggatatcgaacagatggctaatgggattgccctgggattaatggccctcaaactgatcacacagtttgagacctaccagctttggacagctctgatatccttgacttgttcaaacaccatgttcacgctcacagtcgcatggcggaccgccactctgatcctagcgggtgtgagtctgcttcctgtttgccaaagctcgtccatgcgtaagaccgactggctcccaatggctgtggccgcaatgggcgtcccccctctgcccttgtttattttctctctgaaggatacattaaaaagaaggagctggccactcaatgagggggtaatggccgtgggactggtttcaatccttgctagttccctgttgcgcaacgacgtgcctatggcaggccccctcgtcgccggtgggctgctaattgcgtgttatgtgatcactggaacctctgctgatctgacggtagaaaaggccgcagacataacatgggaggaagaggccgaacagaccggcgtgagccataaccttatgattactgtcgacgatgacggcacaatgcggatcaaagatgacgagaccgagaatatcctcactgttctgttgaagacagctttactgattgtgtccggggtgtttccatactcaataccggccaccctcctggtctggcacacgtggcagaaacagactcaaagaagcggagtgctttgggatgttcctagtcccccagaaacccagaaggcagagctggaagagggtgtatacaggatcaaacagcagggcattttcgggaagacacaagtgggagtcggcgtgcagaaggagggtgtttttcataccatgtggcacgtgacacgaggggctgtcttgacttataacggaaaacgcctagaacccaattgggcctctgtgaagaaagacctgatctcctacggcggcgggtggcggctcagcgcgcagtggcaaaagggagaggaagtacaggtcattgccgtggagcctggtaaaaacccaaagaatttccagaccatgcccggcacgttccagacaactaccggggaaatcggagcaatagctctggattttaagcctggcacatcgggttcaccgatcattaacagagaggggaaagttgtgggactttatggcaatggcgtcgtgaccaagaacgggggatacgtttctggtatcgcccaaactaatgctgagccagacggccccacccctgaattagaggaagagatgttcaaaaagaggaacctgacaattatggatctccacccagggagtggaaaaacgcgtaagtatttgcccgcaatcgtgcgcgaagccataaagcggagactgaggactctcattctggcccctacccgagtcgtggctgcggagatggaggaagcacttaaaggcctgccgatccggtaccagacaaccgccactaagtccgagcatacaggtcgcgaaatcgtagacttgatgtgccacgctacctttacgatgagactactgagccccgtgagggttccaaattataacctcattatcatggatgaggcccatttcactgaccctgcatctatagccgctcgggggtacattagcacacgagtcggaatgggcgaagcggccgcaatctttatgaccgctacccccccaggcactgccgatgcattccctcagtccaatgcccccattcaggacgaggagagagacatcccagaacgctcatggaacagtgggaatgagtggataacagattttgctggaaaaaccgtgtggttcgtgccgagcattaaggccggtaacgacatcgcgaactgtttaaggaaaaatggcaagaaggtcatccaactgtctcgtaaaacatttgatactgaataccagaagacgaaacttaacgactgggatttcgtagtgaccacagacatttccgagatgggggcaaattttaaggccgatcgggttatcgaccctagaaggtgcctgaaacccgtgattctcactgatggaccagagcgcgtcatattggctggccccatgcctgtgaccgccgcttcagcagcccagcgaagaggtcgggttgggaggaacccacagaaggaaaatgaccaatatatcttcacaggccagcccctgaacaatgatgaggaccacgctcattggaccgaagccaagatgctcctggacaacattaatactcctgagggaatcatcccggcacttttcgaaccagagcgcgagaaaagtgcggccattgatggcgaataccgtctaaagggggagagcagaaaaacgtttgtggaactgatgcggaggggagacttgcccgtctggttagctcacaaggtggcctccgagggtataaaatataccgatcgcaagtggtgcttcgacggccagcgaaacaatcagatcctggaagagaacatggatgtagagatttggacaaaagaaggggagaagaagaaactcagacctcggtggctggacgcaaggacttactctgatccccttgctctgaaggaatttaaagacttcgccgcaggacgcaagtcgatcgccctcgatttggtgaccgagattggcagagttccaagccacctggctcataggacacggaatgcgctagacaacctggtcatgctccacacctcagaacatggtgggcgtgcctatcgccacgcagtggaggagcttcctgaaactatggagacactgttattgctgggcctcatgatcctgcttacgggaggcgctatgctgtttctcatatccgggaaaggaatcggtaagaccagtattggcttgatctgtgtgattgcctctagcgggatgctgtggatggccgaaatccccttacaatggatagcatccgctattgtcctagagttctttatgatggttctgctcatcccagagcctgaaaagcagcgaactccgcaggataatcaacttgcctacgtggtaattggaatcctgacattggcggctataatcgccgcaaacgagatgggcctgctcgaaaccaccaaaagagacctgggtatgtcaaaggagcccggggtggtctctccaacaagctatcttgatgtggacctccaccctgccagtgcttggactctgtacgcagttgccacgaccgtgattacacccatgttgaggcatactatcgaaaattccaccgcgaacgtcagcctggctgccattgcaaaccaggccgtagtgttaatgggcctagacaaaggatggccaatctctaagatggatctgggcgttcctctccttgctctggggtgctactcacaggtgaatcccttgacactgaccgccgcagtcctcctgcttataactcactatgctattatcggaccgggcttacaggccaaagcgacgcgggaggcccaaaagcgcacagcagctggtatcatgaagaacccaaccgtggacgggattatgactatcgatctggaccctgtcatatacgattccaaattcgagaagcagctcggacaggtgatgttgctggttctatgtgccgtgcagctgctccttatgagaaccagttgggcactgtgcgaagctttgacactggccactggccccattaccacactctgggagggtagcccaggcaaattttggaatacgaccatcgccgtatcgatggcgaacattttcagggggtcttatctggctggagcaggcttagccttttccatcatgaagagcgtggggactggaaaacggggcacaggttcacaaggggaaacccttggagagaagtggaagaaaaagctgaatcagctcagtcgaaaagaattcgacctatacaagaaatctggcataactgaggtcgatagaacagaggctaaggaaggtctgaaacgcggcgagaccacgcatcacgccgtttccagggggagcgcaaagttgcagtggtttgtggaacggaacatggtcatccccgagggacgtgtgattgacctgggctgtgggagaggaggctggtcatattactgcgccggtctcaagaaagtaaccgaagtgagggggtatacaaagggaggccctggccatgaggagccggttcccatgagtacttacgggtggaatatcgtgaaacttatgagcggaaaggatgtcttctacctgccacctgaaaaatgtgacaccttgctgtgcgatattggtgagtcctctcccagccctacagtggaagagtcccgcactatccgggtcctcaagatggtggagccatggttaaagaacaatcagttctgtattaaagttctgaacccctatatgcctaccgtaatcgaacaccttgagcgactgcaaagaaagcacggcgggatgctagtgaggaatccactctcacgcaactctacacatgaaatgtactggataagtaatggaaccggcaacattgtcgcttcggtgaatatggttagccggctgttgctgaacagatttactatgacgcaccgtaggcccacaatcgagaaagacgtggatctcggtgcggggacccggcatgtcaacgccgaaccggagactcctaatatggacgtgatcggagagcgcattaagcgaataaaagaagagcacaactccacctggcactatgacgatgaaaatccatacaagacatgggcatatcatggctcttacgaggtaaaggctacgggctcagccagctccatgatcaacggggtggttaaacttctgaccaagccctgggacgtcgtgcctatggtgactcagatggcaatgacagataccactccattcggacagcaaagagtctttaaagaaaaggttgacacaaggaccccccggagtatgccgggtacacgcagagtgatgggcattactgccgagtggttatggaggaccctggggcgaaataaaaagcctcggttgtgcacgcgtgaggaattcaccaagaaagtaagaacaaacgctgccatgggagcggtgtttactgaggaaaatcagtgggattctgcaaaggccgctgtcgaggacgaagatttctggaaactcgtggaccgcgagagggagctgcacaagctaggcaaatgtggtagctgcgtttataacatgatggggaagcgggaaaaaaagcttggagagtttggcaaggccaaaggctcaagagcaatctggtacatgtggctgggggctcgctacctcgaattcgaggccctgggatttttgaatgaggatcattggttctccagggaaaacagttatagcggtgtggagggcgaagggctgcacaagctcggatacattcttcgagacatctctaaaatacccggcggtgctatgtatgccgatgacaccgcagggtgggacacacggatcactgaggatgacctgcataatgaagagaagattacccagcagatggatccagagcacagacaattagcgaacgccatctttaaactgacgtaccagaataaggtcgtgaaggtacagaggcctacacccaccggaactgttatggacattatctcccgcaaagatcagcgtggctcaggccaagtggggacatatggattgaacaccttcactaatatggaagctcagctcatacggcagatggagggtgaaggcgtcctgagcaaggccgacctagagaacccacaccttcccgaaaaaaagattacccagtggctggagacaaaaggggtggagagactcaagaggatggcaatctcgggagatgactgcgtggtcaagcctatcgatgaccgctttgctaacgccctgttggcattaaatgatatgggcaaagttcgaaaggacattccacaatggcagccgtctaaaggttggcatgattggcagcaggtgcccttctgtagtcaccatttccacgaactgataatgaaggacgggcggaaactcgtagtgccttgcagaccacaagacgagcttatcggaagggcccgcatttcccagggcgcgggctggagcctgagagaaacggcttgtctagggaaggcctacgcacagatgtggtcactgatgtattttcaccggagggatctccgtttggcctccaacgctatctgctctgccgtccccgtgcattgggttcctaccagccgaactacatggagtattcacgcacatcaccaatggatgaccactgaggacatgctgacagtgtggaatcgcgtctggatcgaagataacccatggatggaggacaagacccccgtgacgacatgggagaatgtaccttaccttggaaaaagagaagatcagtggtgtggttccctgataggcctcaccagccgggctacttgggcccagaacatcccgaccgcgattcagcaagttaggtctttaatcgggaatgaggaattcctggactacatgccatcaatgaagcgctttagaaaagaggaggaaagtgagggagctatttggtga

SEQ ID NO: 15132 - RNA, 9873 nt, synthetic construct
  misc_feature 1..9873: note = derived and/or modified CDS sequence (opt3) from DENV-3__JF808127__SS-prME
  source 1..9873: mol_type = other RNA
accagcctgtgcctcatgatgatccttcccgcagctctggcattccacttgacttccagggacggcgagcctaggatgattgtggggaagaacgaacggggaaagtctttactgtttaagactgcctcaggtataaatatgtgtacgctgatcgcgatggatctcggcgagatgtgcgacgataccgtcacatacaagtgtccacacattactgaagttgagccggaagacatcgattgctggtgtaacctgaccagtacatgggtgacctatgggacttgcaatcaggctggagagcgccgacgtgacaagagaagcgtcgcccttgcaccccacgtgggcatgggtctggatacaaggacccagacgtggatgtccgccgagggggcttggcggcaggtcgaaaaggtggagacttgggcattgcgccatcctggattcaccattctcgccctgtttctggctcactacatcggcacatctctcactcagaaggttgtgatattcatcttactgatgcttgtcaccccatcgttgacaatgagatgtgtgggcgtagggaacagggactttgttgaaggactgtcaggtgccacctgggtggatgtcgtgctagagcatggcgggtgcgtgacgactatggcgaagaataagcccacactcgacattgagctgcagaagaccgaagcaactcagcttgccacactgcggaagttgtgtatcgagggaaagattaccaacatcacgaccgatagccgctgccctacacagggcgaagctgtcctcccagaggaacaggaccagaattatgtttgtaaacacacttacgtggatcgaggttgggggaacggatgcggcctgttcggcaaggggagtttagtaacctgcgccaagtttcaatgtctggagcccatagagggaaaagtggtccagtatgaaaatctcaagtacacagtgattatcactgttcacaccggtgaccagcatcaggtgggcaacgagacacaaggggtcaccgcagaaattactcctcaggcttccacgacagaggccatccttccagaatatggaaccctgggcttggagtgctctccgagaactggtctagacttcaatgagatgatcctgctcaccatgaaaaacaaggcgtggatggtgcacaggcagtggtttttcgatctgccccttccttggacaagcggggccaccactgaaacaccaacgtggaatcggaaagagctgttggtaacctttaagaacgcacatgctaaaaagcaagaagttgtggtcctcggctcccaggagggagccatgcacactgctctgacaggcgccaccgaaattcaaaattcagggggaacaagtatattcgcaggtcacttaaagtgtcgtctgaaaatggacaagctagagctcaaaggcatgagctacgccatgtgcactaacacctttgtgctgaagaaagaggtctctgaaacgcagcatgggaccatccttattaaggtggagtacaagggagaagatgctccctgtaaaatccctttctccacagaggacggccaaggtaaggcgcacaacgggcgcttgataactgcaaatccagttgtgaccaaaaaggaggaacccgtaaacattgaggccgaaccgcctttcggcgagtcaaatatcgtcatcggaacaggcgataacgctctgaaaattaattggtataagaaggggagcagtatcggaaaaatgtttgaagccactgcaagaggtgccaggcggatggctattctcggcgacaccgcctgggatttcgggtctgtgggaggcgttctgaactcccttggtaagatggtgcatcagatatttgggagcgcatacacggcgctgttctcgggcgtctcttgggtgatgaaaatcggaattggcgtattgctcacatggatcgggctaaattccaagaacacctcaatgagttttagctgcatcgctattggaataatcactttatatctgggcgccgtggttcaggcagacatgggttgtgtcattaattggaaagggaaggagctaaagtgcggatccggcatcttcgtgacaaacgaggtgcacacctggactgaacagtacaaatttcaagccgattctcccaagcgactcgctaccgccattgccggtgcttgggagaatggcgtctgtgggatccgcagcacaacgagaatggaaaacctgctttggaaacagatagccaatgagttgaactatatcctgtgggaaaataacattaagctcaccgttgtggtgggagacatcattggcgtactggagcaggggaaaaggactttaacaccacagcctatggagctgaagtactcatggaaaacctggggaaaggcgaagatcgtcacagccgaaactcaaaacagttccttcataattgatggccccaataccccagagtgccccagcgcttctcgggcatggaacgtgtgggaagttgaggactatggttttggggtgttcacgacaaatatctggcttaaattgcgcgaagtctacacccagctctgtgaccatagactgatgtcagccgctgtgaaggatgagagggccgttcacgcagacatgggatactggattgagagtcagaaaaacggcagctggaagctagaaaaagcgtccctgatcgaggtgaagacttgcacctggcctaagtctcacacactctggtcgaatggtgtactggaaagcgatatgataatcccaaaatcccttgccggcccgatttcacagcataaccaccgtcccgggtatcatactcaaaccgctggaccttggcacttgggcaagctggagttagactttaattactgcgaggggacaacggtcgtgatcaccgaaaactgtggaactcggggcccaagtctccgaacaaccactgtgtctggtaaactgattcacgagtggtgctgtagaagctgcacacttccccctctgaggtatatgggggaagatggatgttggtacggcatggagatccgcccaatatccgaaaaggaggagaatatggtcaaatcattggttagcgccggttctggcaaggtggacaacttcaccatgggggtactctgcctggcaattctatttgaagaggtgatgcggggaaagttcggcaaaaagcatatgatcgctggggtcttctttacgttcgtgctgctcctgtccggacagatcacttggagagatatggcccacacccttattatgatcggcagtaatgcaagcgacaggatgggtatgggggttacatatttggccctgattgctacctttaaaatacagcccttcttagcgctcggatttttcctgcgcaaacttacttctcgagaaaacctgctactcggcgtgggcctggccatggcaacaaccttgcaactgccggaggatatcgaacagatggctaatgggattgccttaggactcatggccctgaaacttatcacacagtttgagacttaccagctgtggaccgctttgatttccctcacgtgttcaaacacaatgttcaccctgactgtcgcatggcggaccgccacactaatcctggcgggtgtgagtcttctccctgtttgccaaagctcgtccatgcgtaagactgactggctgccaatggctgtggccgcaatgggcgtaccccctttgcccctgtttatattctctttaaaggataccctcaaaagaaggagctggccactgaatgagggggtaatggccgtgggacttgtttcaatcctggctagttccttgctccgcaacgacgtgcctatggcaggccccctggtcgccggtgggctactgattgcgtgttatgtgatcacgggaacatctgctgatcttaccgtagaaaaggccgcagacattacttgggaggaagaggccgaacagacaggcgtgagccataacctcatgatcaccgtcgacgatgacggcactatgcggataaaagatgacgagacagagaatattctgaccgttttgttaaagacggctctgctcatcgtgtccggggtgtttccatactcaatcccggccactctgcttgtctggcacacctggcagaaacagacacaaagaagcggagtgctgtgggatgttcctagtcccccagaaacccagaaggcagagttggaagagggtgtatacaggattaaacagcagggcatattcgggaagacacaagtgggagtcggcgtgcagaaggagggtgtttttcatactatgtggcacgtgacccgaggggctgtcctaacgtataacggaaaacgcctggaacccaattgggcctctgtgaagaaagacctcatctcctacggcggcgggtggcggctgagcgcgcagtggcaaaagggagaggaagtacaggtcattgccgtggagcctggtaaaaacccaaagaatttccagacaatgcccggcactttccagaccacaaccggggaaatcggagcaattgctcttgattttaagcctggcacttcgggttcaccgatcataaacagagaggggaaagttgtgggattatatggcaatggcgtcgtgaccaagaacgggggatacgtttctggtatcgcccaaacaaatgctgagccagacggccccacgcctgaactggaggaagagatgttcaaaaagaggaacctcactattatggatttgcacccagggagtggaaaaacccgtaagtatctgcccgcaatcgtgcgcgaagccattaagcggagactcaggacactgatccttgcccctacccgagtcgtggctgcggagatggaggaagcactgaaaggcttgccgatacggtaccagactacagccaccaagtccgagcatacgggtcgcgaaattgtagacctaatgtgccacgctacttttacaatgagactgctcagccccgtgagggttccaaattataacttaatcatcatggatgaggcccatttcaccgaccctgcatctattgccgctcgggggtacatcagcacccgagtcggaatgggcgaagcggccgcaatatttatgactgctacacccccaggcaccgccgatgcattccctcagtccaatgcccccattcaggacgaggagagagacatcccagaacgctcatggaacagtgggaatgagtggattacagattttgctggaaaaactgtgtggttcgtgccgagcatcaaggccggtaacgacatagcgaactgtctgaggaaaaatggcaagaaggtcattcaactttctcgtaaaacgtttgataccgaataccagaagacaaaactgaacgactgggatttcgtagtgactaccgacatctccgagatgggggcaaattttaaggccgatcgggttatcgaccctagaaggtgcctcaaacccgtgattttgacagatggaccagagcgcgtcatcctggctgaacccatgcctgtgaccgccgcttcagcagcccagcgaagaggccgggttggtaggaacccacagaaggagaatgaccaatatattttcactgggcagcccctcaacaatgatgaagaccacgctcattggacggaggccaagatgctgcttgacaacataaatacccctgaaggcatcattccggcactattcgagccagagcgcgagaagagtgcggccatcgatggagagtaccgtctgaagggcgaaagcagaaaaacatttgtggagttgatgcggagaggggacttacccgtctggctggctcacaaggtggcctccgaaggaatcaaatatactgatcgcaagtggtgcttcgacggtcagcgaaacaatcagattctcgaggagaacatggatgtagaaatatggaccaaagagggcgaaaagaagaaactgagacctcggtggcttgacgcaaggacatactctgatcccctggctctcaaggagtttaaagacttcgccgcagggcgcaagtcgatcgccttggatctggtgaccgaaattggaagagttccaagccacctagctcataggactcggaatgcgctggacaacctcgtcatgcttcacacatcagagcatggcggtcgtgcctatcgccacgcagtggaggaactgcctgagacgatggaaaccttattgctgctcgggctgatgatccttctgactggcggagctatgctctttttgatttccggcaaagggatcggaaagacaagtataggtctgatctgtgtgattgcctctagcggcatgttatggatggccgagatccccctacaatggattgcatccgctatcgtcctggagttctttatgatggttctccttataccagaacctgagaagcagcgaaccccgcaggataatcaactggcctacgtggtaattgggatcttgaccctggcggctattatcgccgcaaacgaaatgggactcctggagacaactaaaagagaccttggcatgtcaaaggaacccggtgtggtctctccaacgagctatctcgatgtggacctgcaccctgccagtgcttggaccttgtacgcagttgccacaactgtgataacccccatgctgaggcatacaatcgaaaattccaccgcgaacgtcagcttagctgccattgcaaaccaggccgtagtgctaatggggctggacaaaggctggccaatctctaagatggatctcggagttcctcttctggctttgggctgctactcacaggtgaatcccctgactctcacggccgcagtcctgcttttaattacacactatgctatcatagggccgggactgcaggccaaagcgacccgggaggcccaaaagcgcactgcagctggcattatgaagaacccaaccgtggacggtatcatgacaatcgatctcgaccctgtcatttacgattccaaattcgaaaagcagttgggacaggtgatgctgctagttctgtgtgccgtgcagctccttctgatgagaacaagttgggcattgtgcgaggctctgaccctcgccacaggacccatcacgaccctgtgggaaggcagcccaggtaaattttggaatactacaatagccgtatcgatggcgaacattttcaggggctcttatttagctggggcaggacttgccttttccatcatgaaaagcgtgggcaccgggaaacggggaactggctcacaaggtgagacactgggggaaaagtggaagaaaaagctcaatcagctaagtcgaaaagagttcgacctgaacaagaaatctggaattaccgaggtcgatagaacggaagctaaggagggcttgaaacgcggtgaaatcacccatcacgccgtttccaggggcagcgcaaagctgcagtggtttgtggagcggaatatggtcatacccgaagggcgtgtgatcgacctcggatgtggcagagggggatggtcatactattgcgccggccttaagaaagtaacagaggtgaggggttacactaaaggcgggcctgggcatgaggaaccggttcccatgagtacctatggctggaacattgtgaaactgatgagcgggaaggatgtcttctacttgccacctgagaaatgtgacacactgctctgcgatatcggagaatcctctcccagccctactgtggaggagtcccgcaccattcgggtcttaaagatggtggaaccatggctgaagaataaccagttctgtatcaaagttcttaatccctacatgcctacagtaattgagcacctggaacgactacaaagaaagcacggtggcatgctcgtgaggaacccactgtcacgcaattctacccatgagatgtattggatcagtaacgggactggaaatatagtcgcttcggtgaaaatggttagccggttgctgctcaacagatttacgatgacacaccgtaggcccaccattgaaaaggacgtggatcttggcgcgggtactcggcatgtcaacgccgagccggagacccctaatatggacgtgatcggggaacgcatcaaacgaattaaggaggaacacaactccacatggcactacgacgatgagaatccatataagacgtgggcataccatggatcttatgaagtaaaagctaccggctcagccagctccatgataaacggcgtggttaagctgttaactaaaccctgggacgtcgtgcctatggtgacacagatggcaatgaccgatactacaccattcgggcagcaaagagtctttaaggagaaagttgacaccaggacaccccggagtatgccgggaactcgcagagtgatgggtatcaccgccgagtggctgtggaggacgttgggccgaaataagaagcctaaactctgcacccgggaagagttcacaaagaaagtacgtactaacgctgccatgggggcggtgtttaccgaagagaatcagtgggattctgcaaaggccgctgtcgaagacgaggatttctggaaactggtggacagagagcgcgaactacacaaacttggaaaatgtggcagctgcgtttacaacatgatgggtaagagggagaagaaactgggggaatttggaaaggccaaaggctcacgggcaatttggtatatgtggctcggcgctagatacctggagttcgaggccttggggtttctgaatgaagatcattggttctcccgcgagaacagttacagcggagtggaaggtgagggcctccacaaacttgggtatatcctgagggacatttctaaaatccccggaggcgctatgtacgccgatgacacagcaggttgggacactcgaataaccgaagatgacttacataatgaggagaagatcacgcagcagatggatccagaacaccggcaactggcgaacgccatttttaagttgacatatcagaataaagtcgtgaaggtacagagacctacccccactgggacagttatggacatcatttccaggaaagatcagcgcggatcaggccaagtgggcacctacgggctcaacactttcaccaatatggaggctcagctgatccgtcagatggaaggagagggtgtcctaagcaaggccgaccttgaaaacccacatctgcccgagaaaaagataacacagtggctcgagacgaagggcgtggaacggctgaaaagaatggcaatttcgggggatgactgcgtggtcaagcctatcgatgacaggtttgctaacgccttgttagcactgaatgatatgggaaaagttcgcaaggacatcccacaatggcagccgtctaaaggctggcatgattggcaacaggtgcccttctgtagtcaccatttccacgagctcattatgaaggacggtcgaaaacttgtagtgccttgccggccacaagacgaactgatagggagagccaggatctcccagggagcgggctggagcctacgcgagaccgcttgtctgggcaaagcctatgcacagatgtggtcactcatgtactttcacagacgggatttgaggctggcctccaacgctatttgctctgccgtccccgtgcattgggttcctactagccgtacaacctggagtatccacgcacatcaccaatggatgactacagaagacatgcttaccgtgtggaatcgagtctggattgaggataacccatggatggaggacaagacgcccgtgacaacctgggaaaatgtaccttatctggggaaacgcgaggatcagtggtgtggatccctcatcggtttaactagcagagctacctgggcccagaacataccgacagcgatccagcaagttcggtctctgattggcaatgaagagttcttggactacatgccatcaatgaagaggtttcgcaaagaggaagagagtgaaggggctatctggtga

SEQ ID NO: 15133 - RNA, 9873 nt, synthetic construct
  misc_feature 1..9873: note = derived and/or modified CDS sequence (opt3) from DENV-3__JF808124__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagcccatagagggaaaagtggtccagtatgaaaatctgaagtacacagtgattatcactgttcacaccggtgaccagcatcaggtgggcaacgagacacaaggggtcaccgcagaaattactcctcaggcttccacgacagaggccatcctcccagaatatggaaccttcggccttgagtgctctccgagaactggtctggactttaatgagatgatcttgctaaccatgaaaaacaaggcgtggatggtgcacaggcagtggttctttgatctgcccctcccttggacaagcggggccaccactgaaacaccaacgtggaatcggaaagagctgcttgtaaccttcaagaacgcacatgctaaaaagcaagaagttgtggtcctgggctcccaggagggagccatgcacactgctttgacaggcgccaccgaaattcagaattcagggggaacaagtatatttgcaggtcacctcaagtgtcgtctgaaaatggacaagttagagctgaaaggcatgagctacgccatgtgcactaacaccttcgtgctaaagaaagaggtctctgaaacgcagcatgggaccatcctcattaaggtggagtacaagggagaagatgctccctgtaaaatccctttctccacagaggacggccaaggtaaggcgcacaacgggcgcctgataactgcaaatccagttgtgaccaaaaaggaggaacttgtaaacattgaggccgaacccccgtttggcgagtcaaatatcgtcatcggaattggcgataacgctttgaaaatcaattggtataagaaggggagcagtattggaaaaatgttcgaagccacagcaagaggtgccaggcggatggctatactgggcgacactgcctgggattttgggtctgtgggaggcgttctcaactccctgggtaagatggtgcatcagatcttcgggagcgcatacaccgcgcttttttcgggcgtctcttgggtgatgaaaattggaatcggcgtactgttgacgtggatcgggctcaattccaagaacacatcaatgagtttcagctgcattgctataggaatcattaccctgtatttaggcgccgtggttcaggcagacatgggttgtgtcatcaattggaaagggaaggagctgaagtgcggatccggcatttttgtgactaacgaggtgcacacatggaccgaacagtacaaattccaagccgattctcctaagcgactagctactgccatcgcaggtgcttgggagaatggcgtctgtgggatacgcagcaccacaagaatggaaaacctcctgtggaaacaggttgccaatgagcttaactatatcttgtgggaaaataacattaagctgacggtggtggtaggagacatcattggcgtcctcgagcaggggaaaaggaccctgactccccagccaatggagttaaagtactcatggaaaacatggggaaaggcgaagatcgtgaccgccgaaacacaaaacagttcctttataattgatggccctaatactcccgagtgcccaagcgcttctcgggcatggaacgtttgggaagtggaggactatggtttcggggtctttaccacgaatatctggctgaaacttcgcgaagtgtacacacagttgtgtgaccatagactcatgtcagccgctgttaaggatgagagggccgtgcacgcagacatgggatactggattgagagtcagaaaaacggcagctggaagctggaaaaagcgtccctaatcgaggtaaagacctgcacttggcccaagtctcacaccctgtggtcgaatggtgtcctcgaaagcgatatgataatccctaaatccctggccggcccaatttcacagcataaccaccgtccggggtatcatacacaaactgctggaccctggcaccttggcaagttggagctggacttcaattactgcgaggggaccacagtggtgatcacggaaaactgtggaacccggggccctagtttacgaactacaaccgtctctggtaaactcattcacgagtggtgctgtagaagctgcactctgccaccccttaggtatatgggggaagatggatgttggtacggcatggagatccgccctatatccgaaaaggaggagaatatggttaaatcactggtgagcgccggttctggcaaggtagacaactttacaatgggggtgttgtgcctcgcaattctgttcgaagaggtcatgcggggaaagttcggcaaaaagcatatgatcgctggggtgctatttacctgtgttctgctcctgtccggacagatcacgtggagagatatggcccacactcttattatgatcggcagtaatgcaagcgacaggatgggtatgggggtgacctatttggccctgattgctacattcaaaatacagccatttttagcgctcggattctttctgcgcaagcttacctctcgagaaaacctgctactcggcgtcggcctggccatggcaactacattgcaactgcccgaggatatcgaacagatggggaatggaattgctttaggtctcatggccctgaaacttatcacccagttcgagacataccagctgtggactgccttgatttccctcacctgctcaaacacgatgtttacactgaccgtggcttggcggactgcaaccctaatcctggccggcgttagtcttctcccggtgtgtcaaagctcgtccatgcgtaagacagactggctgcctatggcggtcgctgccatgggggtaccacccttgcctctgttcatattttctttaaaggatactctcaaaagaaggagctggcccctgaatgagggagtgatggcagttggccttgtgtcaatcctggccagttccttgctccgcaacgacgtcccaatggctggtcctctggtggcagggggactactgattgcctgctatgtaatcaccggcacgtctgcggatcttacagtggaaaaggctgccgacattacctgggaggaagaggcagaacagactggcgtcagccataacctcatgatcacagttgacgatgacgggaccatgcggataaaagatgacgagactgagaatattctgacagtgttgttaaagaccgccctgctcatcctgtccggagtgttcccctactcaatcccagctacgcttctggtctggcacacttggcagaaacagacccaaagaagcggtgtgttgtgggatgttccgagtcctcccgaaacacagaaggccgagctagaagagggcgtatacaggattaaacagcaggggatatttggaaagacccaagtgggcgtcggtgtgcagaaggagggggttttccatacaatgtggcacgtgactcgaggagcagtcctgacctataacggcaaacgcctcgaaccaaattgggcttctgtgaagaaagacctgatctcctacggcgggggatggcggcttagcgcccagtggcaaaagggtgaggaagtacaggtcattgcggtggagcccggcaaaaaccctaagaattttcagacgatgccagggacattccagactaccacaggagaaatcggcgccattgcattagatttcaagcccggtacctcggggtcacctatcataaacagagagggaaaagttgtgggcctgtatggcaatggggtcgtgactaagaacggaggttacgtttctggcatcgctcaaaccaatgccgagccggacgggccaacacccgaactcgaggaagagatgtttaaaaagaggaacttgacgattatggatctgcaccctggaagtggcaaaactcgtaagtatctcccagctatcgtgcgcgaagcaattaagcggagactgaggacccttatcctggcccccacacgagtcgtggccgctgagatggaggaagcgttgaaaggtctacctatacggtaccagaccactgcaacaaagtccgagcataccgggcgcgaaattgtagacctgatgtgtcacgccacgttcactatgagactcttaagcccggtgagggttcccaattataacctgatcatcatggatgaggctcattttacagacccagcctctattggagcacggggctacatcagcacccgagtcggcatgggggaagccgctgcgatattcatgaccgccactcctcccggaacagcagatgcttttccacagtccaatgcccctattcaggacgaggagagagacatccccgaacgctcatggaacagtggtaatgagtggattaccgatttcgcaggcaaaacagtgtggtttgtgccaagcatcaaggccgggaacgacatagctaactgccttaggaaaaatggaaagaaggtcattcaactgtctcgtaaaactttcgatacggaataccagaagaccaaactcaacgactgggattttgtagtgacaactgacatctccgagatgggcgccaatttcaaggcggatcgggttatcgacccgagaaggtgcttgaaacctgtgattctgaccgatggtcccgagcgcgtcatcctcgcagggccaatgcccgtgacagccgcttcagccgctcagcgaagaggccgggttggaaggaaccctcagaaggaaaatgaccaatatatttttaccggccagccactgaacaatgatgaggaccacgcacattggactgaagccaagatgcttctagacaacataaatacgcccgaggggatcattcctgctctgttcgaaccggagcgcgagaaaagtgccgcaatcgatggagaataccgtttgaagggtgagagcagaaaaaccttcgtggaattaatgcggaggggcgacctgccagtctggctcgcgcacaaggtggcctccgaggggatcatttatacagatcgcaaatggtgttttgacggacagcgaaacaatcagatactggaagagaacatggatgtagagatctggactaaggaaggcgagaaaaagaagcttagaccccggtggctggacgctaggacctactctgatcctctcgccttgaaagaattcaaggactttgcagctggtcgcaaatcgattgccctggatctagtgacagagatcgggagagttcccagccacctggcacataggacccggaatgccctcgacaaccttgtcatgctgcacacttcagaacatggcggacgtgcttatcgccacgcggtggaggagttaccagaaacaatggagacgttgctgctcctgggccttatgattctgctcaccgggggagccatgttgttcctgatctccggtaagggcatagggaaaactagtatcggattaatttgcgtgatcgcatctagcggcatgtcctggatggctgaaattcctctacaatggatcgcctcagccatagtcctggagtttttcatgatggttctccttattcccgagccagaaaagcagcgaacacctcaggataatcaactggcatacgtggtaatcggtattttgaccctggctgccatcatagcggctaacgagatggggctcctggaaaccacaaagagagaccttggcatgtctaaagagccgggagtggtcagccccactagttatctcgatgtggacctgcacccagcctccgcatggacgttgtacgccgttgctaccacagtgatcactcctatgctgaggcataccattgaaaatagcacagcaaacgtctctttagccgcgatcgctaaccaggccgtagtgctaatgggcctggacaaggggtggcccatttcaaaaatggatctcggagttccacttctggcattgggctgttactcccaggtgaatcctctgaccctcactgccgctgtcctgcttttaatcacgcactatgccataattggtcccgggctgcaggcaaaggctacacgggaggcccaaaaacgcaccgcggccggaatcatgaagaacccgactgtggacggcatcatgaccattgatctcgacccagtcatctacgatagtaagtttgagaaacagttgggtcaggtgatgctgctagttctgtgcgcagtgcagctccttctgatgagaacaagctgggctttgtgtgaagccctgactctcgcaaccggccctataacaacgctgtgggaggggtcgcccggaaagttctggaataccactattgctgtatctatggccaacatctttaggggctcctatttagccggggcgggacttgctttcagcattatgaaatcagtgggcacaggtaagcgggggaccggaagtcaaggcgaaactctgggtgagaaatggaagaagaaactcaatcagctatctcgaaaggaatttgacctgtacaaaaagtccggcatcacagaggtcgatagaaccgaggcaaaagaagggttgaagcgcggagagataacgcatcacgccgttagcaggggctcagctaaactgcagtggttcgtggaacggaacatggtcatcccagaggggcgtgtgattgacctcggatgcggcagaggtgggtggagttattactgtgccggacttaagaaggtaaccgaagtgaggggctatacaaaaggcgggcccggacatgaggagcctgttccgatgagcacttacggttggaatatcgtgaagctgatgtccggcaaagatgtcttttacttgcccccagaaaagtgcgacaccctgctctgtgatattggggagtctagcccttcccccacagtggaagagtcacgcactatccgggtcttaaaaatggtggagccttggctgaagaacaatcagttctgcattaaggttcttaacccatatatgcccaccgtaatcgaacacctggagcgactacaaagaaaacacggaggcatgctcgtgaggaatcctctgtctcgcaacagtacacatgaaatgtactggatatcgaatggtaccgggaacattgtcgcaagcgtgaatatggtttcccggttgctgctcaacagattcactatgacgcaccgtaggccaacaatcgagaaggacgtggatcttggagccggcacccggcatgtcaacgctgaacccgagactccgaatatggacgtgatcggcgagcgcattaaacgaataaaggaagagcacaactctacctggcactatgacgatgaaaatccttacaaaacatgggcgtatcatgggtcatacgaggtaaaggccacgggaagcgcatccagtatgatcaacggtgtggttaagctgttaaccaaaccatgggacgtcgtgcccatggtgactcagatggctatgacagataccactccttttggccagcaaagagtcttcaaggaaaaagttgacacaaggaccccacggtctatgcccgggacacgcagagtgatgggaattactgccgagtggctgtggaggaccttgggccgaaataagaaaccgcggctctgtacgcgtgaggaatttaccaagaaggtaagaacaaacgcagccatgggtgctgtgttcactgaggaaaatcagtgggatagcgccaaagcggcagtcgaggacgaagatttttggaagctggtggaccgcgagagggagctacacaaacttgggaagtgcggatcatgcgtttataacatgatgggcaaacgggaaaagaaactgggcgagttcgggaaggccaagggatccagagctatctggtacatgtggctcggtgcccgctacctggaatttgaggcattgggcttcctgaatgaggatcattggtttagtagggaaaacagctattctggggtggagggagaaggcctccacaaacttggttacattctgcgagacatctccaagatacctgggggagctatgtatgccgatgacaccgctggctgggacacacggatcactgaggatgacttacataatgaagagaaaattacccagcagatggatcccgagcacagacaactggccaacgcaatcttcaagttgacgtaccagaataaagtcgtgaaggtacagaggccaacacctaccggcactgttatggacattatctcacgcaaggatcagcgtgggagcggacaagtgggtacatatggcctcaacacctttactaatatggaagcgcagctgatacggcagatggagggggaaggagtcctatcgaaagccgaccttgagaacccccacctgccagaaaagaaaattacccagtggctcgagacaaagggcgtggagagactgaaaaggatggctatctctggtgatgactgtgtggtcaagcccatcgatgaccgcttcgccaacgcattgttagctctgaatgatatggggaaggttcgaaaagacattcctcaatggcagccaagtaagggatggcatgattggcagcaggtgccgttttgctcccaccatttccacgaactcataatgaaagacggccggaagcttgtagtgccctgtagacctcaagacgagctgatcggcagggcccgcattagccagggggcaggatggtcactaagagaaacggcctgcctgggtaaagcgtacgctcagatgtggtccctcatgtatttccaccggagggatttgcgtctggcctctaacgcaatctgtagcgccgtcccagtgcattgggttcccaccagtcgaactacatggtccattcacgctcatcaccaatggatgaccactgaggacatgcttacagtgtggaatcgcgtctggatcgaagataacccttggatggaggacaagaccccagtgacgacatgggagaatgtaccctacctgggcaagagagaagatcagtggtgcgggagcctcataggattaacctctcgggccacttgggcacagaacatccctaccgctattcagcaagttaggtcactgatcggcaatgaggaatttttggactacatgccgagtatgaaacgcttcagaaaggaggaggaatccgagggtgccatttggtga

SEQ ID NO: 15134 - RNA, 9873 nt, synthetic construct
  misc_feature 1..9873: note = derived and/or modified CDS sequence (opt3) from DENV-3__JF808126__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcaccttactgatgcttgtcacaccatcgatgaccatgcgctgtgtgggcgtagggaacagagactttgttgaaggattgtcaggtgccacgtgggtggatgtcgtgctggagcacggcgggtgcgtgactacaatggcgaagaataaacccaccctagacatcgagctccagaagactgaagcaacacaactggccacccttaggaaactgtgtattgagggaaagatcacgaacattaccacagatagccggtgccctactcagggcgaagctgtcttgccagaggaacaggaccagaattatgtttgtaaacacacctacgtggatcgcggttgggggaacggatgcggcctcttcggcaaggggagtctggtaacatgcgccaagtttcaatgtttagagcccatcgagggaaaagtggtccagtatgaaaatctgaagtacactgtgataattaccgttcatacaggtgaccagcaccaggtgggcaacgagacccaaggggtcactgcagaaatcacgcctcaggcttccacaaccgaggccattctcccagaatatggaactcttggcctggagtgctctccgcgaaccggtttggacttcaatgagatgatcctactgacaatgaaaaacaaggcgtggatggtgcatagacagtggtttctcgatctgccccttccttggaccagcggggccactacagaaacgccaacctggaataggaaagagctgttggtaactttcaagaacgcacacgctaaaaagcaagaagttgtggtcctcggctcccaggagggagccatgcacacagctctgaccggcgccacagaaatccagaattcagggggaactagtatttttgcaggtcatttaaagtgtcggctgaaaatggacaagctagagctcaaaggcatgagctacgccatgtgcaccaacacgttcgtgctgaagaaagaggtctctgaaacccagcacgggacaatacttatcaaggtggagtacaagggagaagatgctccctgtaaaattcctttttccactgaggacggccaaggtaaggcgcataacgggcgtttgatcaccgcaaatccagttgtgacaaaaaaggaggaacccgtaaacatagaggccgaaccgcctttcggcgagtcaaatattgtcatcggaatcggcgataacgctctgaaaattaattggtataagaaggggagcagtatcggaaaaatgttcgaagccactgcacgcggtgccagaaggatggctattctcggcgacaccgcctgggattttgggtctgtgggaggcgttctgaactcccttggtaagatggtgcaccagatattcgggagcgcatacacggcgctgttttcgggcgtctcttgggtgatgaaaatcggaattggcgtattgctcacatggatcgggctgaattccaagaacacctcaatgagtttcagctgcatcgctattggaataatcactttatatctgggcgccgtggttcaggcagacatgggttgtgtcattaattggaaagggaaggagctaaagtgcggatccggcatctttgtgacaaacgaggtgcatacctggactgaacagtacaaattccaagccgattctcccaagcggctcgctaccgccattgcaggtgcttgggagaatggcgtctgtgggatccgaagcacaacgcgcatggaaaacctgctttggaaacagatagccaatgagttgaactatatcctgtgggaaaataacattaagctcaccgttgtggtgggagacatcattggcgtactggagcaggggaaaagaactttaacaccacagcctatggagctgaagtactcatggaaaacctggggaaagagtaagatcgtcacagcggaaactcaaaactccagctttataattgatggccccaataccccagagtgcccctctgcctcaagggcttggaacgtgtgggaagttgaggactatggtttcggggtgtttacgacaaatatctggcttaaattgcgggaagtctacacccagctctgtgaccaccgcctgatgagtgcagccgtgaaggatgagagagctgttcacgccgacatgggatactggattgagagccagaaaaacggctcctggaagctagaaaaagcatctctgatcgaggtgaagacttgcacctggcctaagtcgcatacactctggagcaatggtgtactggaatccgatatgataatcccaaaatcacttgcgggcccgattagtcagcacaaccataggcccgggtatcacactcaaaccgccggaccttggcacttgggcaagctggagttagacttcaattactgcgaggggacaacggtcgtgatcaccgaaaactgtggaactcgtggcccagctctccggacaaccactgtgtctggtaaactgattcatgagtggtgctgtcgaagctgcacacttccccctctgagatatatgggggaagatggatgttggtacggcatggagatcaggccaatatccgaaaaggaggagaatatggtcaaatcattggttagcgccggttctggcaaggtggacaactttaccatgggggtactctgcctggcaattctattcgaagaggtgatgcgcggaaagtttggcaaaaagcacatgatcgctggggtcttcttcacgtttgtgctgctcctgtccggacagatcacttggcgggatatggcccatacccttattatgatcggcagtaatgcaagcgacagaatgggtatgggggttacatatttggccctgattgctaccttcaaaatacagccctttttagcgctcggattctttctgaggaagcttacttctcgcgaaaacctgctactcggcgtgggcctggccatggcaacaaccttgcaactgccggaggatatcgaacagatggctaatgggattgccttaggactcatggccctgaaacttatcacacagttcgagacttaccagctgtggaccgctttgatttccctcacgtgttcaaacacaatgtttaccctgactgtcgcatggcgaaccgccacactaatcctggcgggtgtgagtcttctccctgtttgccaaagctcgtccatgcggaagactgactggctgccaatggctgtggccgcaatgggcgtcccccctttgcccctgttcatattttctttaaaggataccctcaaacgtagaagctgtccactgaatgagggggtaatggccgtgggacttgtttcaatcctggctagttccttgctcaggaacgacgtgcctatggcaggccccctggtcgccggtgggctactgattgcgtgctatgtgatcacgggaacatctgctgatcttaccgtagaaaaggccgcagacattacttgggaggaagaggccgaacagacaggcgtgagccacaacctcatgatcaccgtcgacgatgacggcactatgcgcataaaagatgacgagacagagaatattctgaccgttttgttaaagacggctctgctcatcgtgtccggggtgttcccatactcaatcccggccactctgcttgtctggcatacctggcagaaacagacacaacggagcggagtgctgtgggatgttcctagtcccccagaaacccagaaggcagagttggaagagggtgtatacagaattaaacagcagggcatatttgggaagacacaagtgggagtcggcgtgcagaaggagggtgttttccacactatgtggcacgtgaccaggggggctgtcctaacgtataacggaaaacgactggaacccaattgggcctctgtgaagaaagacctcgtatcctacggcggcgggtggcgcctgagcgcgcagtggcaaaagggagaggaagtccaggtgatcgccgttgagcctggtaaaaacccaaagaattttcagacaatgcccggcactttccagaccacaaccggggaaattggagcaatcgctcttgatttcaagcctggcacttcgggttcaccgattatcaaccgggaggggaaagtggtcggattatatggcaatggcgtggttaccaagaacgggggatacgtgtctggtatagcccaaacaaatgctgagccagacggccccacgcctgaactggaggaagagatgtttaaaaagagaaacctcactatcatggatttgcatccagggagtggaaaaaccaggaagtatctgcccgcaattgtccgtgaagccatcaagcgccggctcagaacactgattcttgcccctaccagggtggtagctgcggagatggaggaagcactgaaaggcttgccgatccgataccagactacagccaccaagtccgagcacacgggtcgggaaatagtggacctaatgtgtcatgctactttcacaatgcgcctgctcagccccgttagagtccagaattataacttaattatcatggatgaggcccactttaccgacccagcatctatcgccgctagggggtacattagcacccgggtgggaatgggcgaagcggccgcaatcttcatgactgctacacctcccggcaccgccgatgcatttccacagtccaatgcccctatacaagacgaggagcgagacattcccgaaagatcatggaacagtgggaatgagtggatcacagatttcgctggaaaaactgtgtggtttgtcccaagcattaaggccggtaacgacatcgcgaactgcctgcgcaaaaatggcaagaaggtaatacagctttctaggaaaacgttcgataccgaataccagaagacaaaactgaacgactgggattttgtggttactaccgacatttccgagatgggggcaaatttcaaggccgatcgtgtgatcgacccgcggagatgcctcaaacctgtcatcttgacagatggacccgagagggtgattctggctggcccaatgcccgttaccgccgcttcagcagcccagcgccgaggtagagtggggcggaaccctcaaaaggaaaatgaccagtatatctttactggccagccactcaacaatgatgaggaccatgctcactggacggaagccaagatgctgcttgacaacattaatacccccgagggaataatccctgcactattcgaaccggagagggagaaaagtgcggccattgatggcgaataccgcctgaagggggagagccgtaaaacattcgtcgaattgatgagacggggagacttaccagtgtggctggctcacaaggtagcctccgagggtatcaaatatactgataggcgctggtgttttgacggccagcgaaacaatcaaatcctcgaagagaacatggatgtggagatttggaccaaggaaggggagaaaaagaagctgagaccccggtggcttgacgcaaggacatactctgatcctctggctctcaaagaattcaaggactttgccgcaggacgcaaatcgatagccttggatctggttaccgagatcggcagagtccccagccatctagctcacaggactcggaatgcgctggacaacctcgtgatgcttcatacatcagaacacggtgggcgtgcctatcgccacgcagtggaggagctgccagaaacgatggagaccttattgctgctcggcctgatgattcttctgactggaggcgctatgctcttcttgatctccgggaagggaattggtaaaacaagtatcggcctgatatgcgtcatcgcctctagcgggatgttatggatggccgaaattcctctaccctggatcgcatccgctattgttctggagtttttcatgatggtgctccttatcccagagcctgaaaagcagcgaaccccgcaggataatcaactggcctacgtagtgataggaattttgaccctggcggctatcattgccgcaaacgagatgggcctcctggaaacaactaagagagaccttggtatgtcaaaagagcccggggtcgtgtctccaacgagctatctcgatgttgacctgcatcctgccagtgcttggaccttgtacgcagtggccacaactgtcatcacccccatgctgaggcacacaatagaaaattccaccgcgaacgtaagcttagctgccatcgcaaaccaggccgtggttctaatgggcctggacaagggatggccaatttctaaaatggatctcggcgtgcctcttctggctttggggtgttactcacaggtcaatcccctgactctcacggccgcagtgctgcttttaatcacacattatgctattatcggaccgggcctgcaggccaaggcgacccgggaggcccaaaaacgcactgcagctggtataatgaagaacccaaccgtcgacgggattatgacaatcgatctcgaccctgtgatctacgattccaagtttgagaaacagttgggacaggttatgctgctagtgctgtgcgccgtacagctccttctgatgagaactagttgggcattgtgtgaagctctgaccctcgccacaggccccattacgaccctgtgggagggtagcccaggcaagttctggaatactacaatcgccgtgtcgatggcgaacatatttagggggtcttatttagctggagcaggccttgccttctccattatgaaaagcgtcgggaccggaaagcggggcactggttcacaaggggaaacactgggagagaaatggaagaagaaactcaatcagctaagtcgaaaggaatttgacctgtacaaaaagtctggcatcaccgaggttgatagaacggaggctaaagaaggtttgaagcgcggcgagattacccaccatgccgtgtccagggggagcgcaaaactgcagtggttcgtcgaacggaacatggtgatccccgagggacgtgtaatagacctcggctgcgggagaggaggctggtcatattactgtgccggtcttaagaaggtgacagaagttagggggtatactaaaggaggccctggccacgaggagccggtgcccatgagtacctacgggtggaatatcgtcaagctgatgagcggaaaagatgtgttttacttgccacctgaaaagtgcgacacactgctctgtgatattggtgagtcctctcccagccctactgtcgaagagtcccgcaccatccgggtgttaaaaatggttgagccatggctgaagaacaatcagttctgcattaaggtacttaacccctatatgcctacagtgatcgaacacctggagcgactacaaagaaaacatggcgggatgctcgtcaggaatccactgtcacgcaactctacccacgaaatgtactggattagtaatggaactggcaacatcgtggcttcggttaatatggtgagccggttgctgctcaacagattcacgatgacacatcgtaggcccaccatagagaaggacgtcgatcttggtgcggggactcggcacgtgaacgccgaaccggagacccctaatatggacgtaattggagagcgcatcaaacgaatcaaggaagagcacaactccacatggcattatgacgatgaaaatccatacaaaacgtgggcatatcacggctcttacgaggtgaaggctaccggctcagccagctccatgattaacggggttgtcaagctgttaactaaaccctgggacgtggtgcctatggtcacacagatggcaatgaccgatactacaccatttggacagcaaagagttttcaaggaaaaagtggacaccaggacaccccggagtatgccgggtactcgcagagtaatgggcataaccgccgagtggctgtggaggacgttggggcgaaataagaaacctcggctctgtacccgtgaggaatttacaaagaaggtgagaactaacgctgccatgggagcggtcttcaccgaggaaaatcagtgggattctgcaaaagccgctgtggaggacgaagatttttggaagctggttgaccgcgagagggagctacataaacttggcaagtgcggtagctgcgtgtataacatgatggggaaacgggaaaagaaactgggagagttcggcaaggccaagggctcaagagcaatctggtacatgtggctcggggctcgctacctggaatttgaggccttgggattcctgaatgaggatcactggttttccagggaaaacagttatagcggtgtcgagggcgaagggctccataaacttggatacattctgcgagacatctctaagattcccggcggtgctatgtatgccgatgacacagcagggtgggacactcggatcaccgaggatgacttacacaatgaagagaaaataacgcagcagatggatccagagcacagacaactggcgaacgccatcttcaagttgacataccagaataaagtggtaaaggttcagaggcctacccccactggaacagtgatggacattatctcccgcaaggatcagcgtggctcaggccaagtcgggacctatggactcaacacttttaccaatatggaagctcagctgattcggcagatggagggtgaaggcgtgctaagcaaagccgaccttgagaacccacatctgcccgaaaagaaaatcacacagtggctcgagacgaagggggtggagagactgaaaaggatggcaatatcgggagatgactgtgtcgttaagcctattgatgaccgcttcgctaacgccttgttagcactgaatgatatgggcaaggtgcgaaaagacatcccacaatggcagccgtctaagggttggcacgattggcagcaggtacccttttgcagtcatcacttccacgaactcatcatgaaagacgggcggaagcttgtggtcccttgtagaccacaagacgagctgattggaagggcccgcatatcccagggcgcgggctggagcctaagagaaaccgcttgcctggggaaagcctacgcacagatgtggtcactcatgtatttccatcggagggatttgcgtctggcctccaacgctatctgttctgccgtgcccgttcactgggtgcctactagccgaacaacctggagtattcatgcacaccatcaatggatgactacagaggacatgcttaccgtctggaatcgcgtgtggatcgaagataacccatggatggaggacaagacgcccgtaacaacctgggagaatgttccttacctgggaaagagagaagatcagtggtgcggttccctcattggcttaactagccgggctacctgggcccagaacatcccgacagcgatacagcaagtgaggtctctgatcgggaatgaggaatttttggactacatgccatcaatgaaacgcttcagaaaggaggaggaaagtgagggagctatttggtga

SEQ ID NO: 15135 - RNA, 9873 nt, synthetic construct
  misc_feature 1..9873: note = derived and/or modified CDS sequence (opt3) from DENV-3__JF808125__SS-prME
  source 1..9873: mol_type = other RNA
accagcctgtgcctcatgatgatccttcccgccgctctggcattccacttgacctcccgggacggcgagcctaggatgattgtgggggaaaacgagcggggaaagtctttactgtttaagactgcctcaggtataaatcgccgaacgctaatcgcgatggatctcggcgaaatgtgtgaggaaaccgagacatacaagtgcccacatattactgaggtcgaaccggaggacatcgattgttggtgcaacctgaccagtacatgggttacctatgggacttgtaatcaggctggagaacgtagaagggacaagcggagcgtggcccttgcaccccacgtaggcatgggtctggatacacgcacccagacgtggatgtccgccgagggggcttggcggcaagtggagaaggtcgaaacttgggcattgaggcatcctggattcaccattctcgccctgtttctggctcactacatcggcacatctctcactcagaaagtggttatattcatcttactgatgcttgtgaccccatcgatgacaatgcggtgcgtcggcgtggggaaccgcgactttgtagagggattgtcaggtgccacctgggttgatgtggtcctggaacatggcgggtgtgtgacgactatggcgaagaataagcccacactagacattgagctccagaaaaccgaagcaactcagctggccacacttcgaaagctgtgcatcgagggaaaaattaccaacatcacgaccgatagcagatgtcctacacagggcgaggctgtgttgccagaagaacaggaccagaattatgtctgcaagcacacttacgttgataggggttgggggaacggatgtggcctcttcggcaaagggagtctggtgacctgcgccaagtttcaatgcttagaacccatagagggaaaggtagtgcagtatgaaaatctgaaatacacagtcattatcactgtgcacaccggtgaccagcatcaggttggcaacgagacacaaggggtgaccgcagagattactcctcaggcttccacgacagaagccatcctcccagagtatggaacccttggcctggaatgttctccgcggactggtttggatttcaatgagatgatcctactgaccatgaagaacaaagcgtggatggtccaccgtcagtggtttttcgacctccccctgccttggacaagcggggccaccgcagaaactccaacatggaatcgcaaggagcttctggtgacgtttaaaaacgctcatgccaagaaacaagaggtagttgtgttgggctcccaggaaggagctatgcacaccgccctcactggcgcaacagagattcaaaattcagggggaaccagtatattcgccggtcacctgaagtgcagattaaagatggacaaactggaactaaagggcatgagctacgctatgtgtacaaacacttttgtcctcaaaaaggaggtgtctgagacccagcatgggacgatcctgattaaagtcgaatacaagggagaggatgcgccctgcaagatccctttctccaccgaagacggccaaggtaaagcacacaacgggaggcttataacagccaatccagtggttactaagaaagaggaacccgtgaacattgaggctgagccgcctttcggcgaatcaaatatcgtaatcggaattggcgataacgccttgaagatcaattggtataaaaaggggagcagtattggaaagatgtttgaggcaaccgcccggggtgctcgacgcatggccatactgggcgacacagcatgggatttcgggtctgtcggaggcgtgctcaactccctgggtaaaatggttcatcagatctttgggagcgcgtacactgctcttttctcgggcgtgtcttgggtcatgaagattggaatcggcgtgctgttgacctggatcgggctcaattccaaaaacacgtcaatgagttttagctgtattgccataggaatcattacactgtatttaggcgcagtagtgcaggccgacatgggttgcgttatcaattggaaggggaaagaactgaagtgtggatccggcattttcgtcaccaacgaggtgcacacttggacagaacagtacaagtttcaagctgattctcccaaaagactagccaccgcaatcgctggtgcctgggagaatggcgtgtgcgggataaggagcactacccggatggagaacctcctgtggaagcagatcgcgaatgaacttaactatattttgtgggagaataacatcaaactgacagtcgttgtgggagacattatcggcgtgctcgaacaggggaagcgcacgctgaccccacagcctatggagttaaaatactcatggaagacttggggaaaagccaagatagtaacagctgaaacccaaaacagttccttcattatcgatggccccaatacaccagagtgtcccagcgcatctagagcctggaacgtctgggaggtggaagactatggttttggggttttcactaccaatatttggctgaaacttagggaggtgtacacgcagttgtgcgatcatcgtctcatgtcagctgccgtcaaagacgaacgggcagtgcacgcggacatgggatactggatcgagagtcagaagaacggcagctggaaactggagaaggcctccctaatagaagttaaaacatgtacctggcctaagtctcacactctgtggtcgaatggtgtgctcgagagcgatatgatcattccaaagtccctggctggcccgatctcacagcataaccaccgacccgggtatcatacccaaacagccggaccttggcaccttggcaaattggaactggactttaattactgcgaggggactaccgtagtcattacagaaaactgcggaacgagaggcccaagtttaaggaccactacagtgtctggtaagctcatccacgagtggtgttgccgcagctgtaccctgccccctcttcggtatatgggggaggatggatgctggtacggcatggaaataagaccaatttccgagaaagaagagaatatggtgaagtcactggtcagcgcaggttctggcaaagttgacaacttcactatgggggtgttgtgtctcgctatcctgtttgaagaggtaatgaggggaaagttcggcaagaaacatatgatcgccggggtgttctttacattcgtcctactgctctccggacagattacctggcgcgatatggcacacacgctgatcatgattggcagtaatgccagcgaccgaatgggtatgggggtgacttatcttgctttgatagcgacctttaagatccagcccttcctggccttaggatttttcctccggaaactgacatctcgtgagaaccttctgctaggcgttggcctcgcaatggctaccactctgcaattgccggaagatattgagcagatggccaatgggatcgccctgggattaatggctctcaagctgattacacagtttgaaacctaccagctttggacagcactgatctccttgacttgctcaaacaccatgttcacgctcacagtggcctggagaaccgcgactctgatactagctggtgtcagtctgcttcctgtgtgtcaaagctcgtccatgaggaaaaccgactggctcccaatggccgttgcagccatgggcgtgccccctctgcccttgtttatcttctctctgaaggatacattaaagcgccggagctggccactcaatgagggggtcatggctgtaggactggtgtcaattcttgcaagttccctgttgagaaacgacgttcctatggccggccccctcgtggcgggtgggctgctaatcgcttgctatgtcattactggaacctctgccgatctgacggtggaaaaagcagccgacatcacatgggaggaggaagctgagcagaccggcgtaagccataaccttatgataactgtggatgacgacggcacaatgaggattaaggatgacgaaaccgagaatatcctcactgtcctgttgaaaacagccttactgatcgtttccggggtgtttccatactcaattccggcaaccctcctggtgtggcacacgtggcagaagcagactcaacgaagcggagtcctttgggatgtgcctagtcccccagagacccagaaagctgaactggaggaaggtgtttaccgcataaagcagcagggcatcttcgggaaaacacaagtaggagtgggcgtccagaaggagggtgtgtttcataccatgtggcacgttacaagaggggccgtgttgacttataacggaaagagactagaacccaattgggcgtctgtcaaaaaggacctgatttccagcggcggcgggtggaggctctcggcccagtggcaaaaaggagaggaggtgcaggtaatcgcagtcgaacctggtaagaaccccaagaatttccagaccatgcccggcacgttccagacaactaccggggagattggagctatcgccctggattttaagcctggcacatcaggttctccgataatcaaccgtgaagggaaggtggttggactttacggcaatggcgtggtcaccaaaaacgggggatatgtgagtggtattgctcaaactaatgcagagccagacggccccacccctgaattagaggaggaaatgttcaagaaacgcaacctgacaatcatggatctccacccagggtccggaaagacgcggaaatacttgcccgccattgttagagaggccatcaagaggcgactgcggactctcatactggctcctacccgcgtggtcgcggcagaaatggaggaagcccttaagggcctgccgattagatatcagacaaccgctactaaaagcgagcatacaggtagggagatcgtggacttgatgtgtcacgccacctttacgatgcggctactgtctcccgtacgagtgccaaattacaacctcatcattatggatgaagcacatttcactgaccctgccagcatcgctgcgagagggtatatatccacacgcgttggaatgggcgaggccgcagctatttttatgaccgccacaccaccaggcactgcagatgccttccctcagtcaaatgctcccatccaggacgaagagagggatattccagagcgtagttggaacagcgggaatgaatggatcacagactttgccggaaagaccgtctggttcgtgccgtctataaaagcgggtaacgacattgcaaactgcttacggaagaatggcaaaaaggtgatccaactgtccagaaagacatttgatactgagtaccagaaaacgaaacttaacgactgggatttcgtcgtaaccacagacatctcagaaatgggggccaattttaaagctgatagggtgattgaccctcgccgatgtctgaagcccgttatcctcactgatggaccagagagagtgattttggccggccccatgcctgtcaccgctgcaagtgccgctcagcggaggggtcgcgtggggcgtaacccacagaaagaaaatgaccaatacatattcacaggccagcccctgaacaatgatgaggaccacgcccattggaccgaggcaaagatgctcctggataacatcaatactcctgaaggaattatcccggcgcttttcgagccagaaagagaaaagagcgccgctatcgacggcgaatatcggctaaaaggggagtccaggaagacgtttgttgagctgatgcgccgaggagacttgcccgtgtggttagcccacaaagtcgcatctgaaggtattaagtacaccgatagaaaatggtgcttcgacggccagcggaacaatcagatactggaggaaaacatggatgtggagatctggacaaaggaaggggagaaaaagaagctcaggcctcgctggctggacgctagaacttattcggatccccttgccctgaaagagtttaaggacttcgcagccggaaggaaaagcattgctctcgatttggtaaccgaaatcggccgggtgccatcacacctggcgcatcgtacacgcaatgccctagacaacctggttatgctccacacctccgagcatggtgggcgagcatacagacacgctgtcgaagaacttcctgagactatggaaacactgttattgctgaggctcatgattctgcttacgggcggagccatgctgtttctcatcagtggcaaggggataggaaaaacctctatcggtttgatttgcgtgatcgccagctccggcatgctgtggatggcagagattcccttacaatggatcgcttcagccatagtgctagagttctttatgatggtcctgctcattccagagcctgaaaagcagcggactccgcaggataatcaacttgcgtatgttgtgatcgggattctgacattggctgccatcatagcagccaacgagatgggactgctcgagaccaccaagcgcgacctgggcatgtctaaagaacccggtgtagtgagcccaacaagttaccttgatgtcgacctccaccctgcttccgcatggactctgtatgccgtggcgacgaccgttatcacacccatgttgagacatactattgagaatagcaccgctaacgtgtctctggccgcaatcgccaaccaggctgtcgtattaatggggctagataagggctggccaatttcaaaaatggacctgggagtgcctctccttgccctgggctgttactcccaggttaatcccttgacactgaccgcagctgtgctcctgcttatcactcactacgccataattgggccgggattacaggcgaaggccacgagggaagcacaaaaacggacagctgccggcatcatgaagaacccaaccgtcgacggtatcatgactattgatctggaccctgtgatctatgatagtaagttcgagaaacagctcgggcaggtcatgttgctggtgctatgcgcagttcagctgctccttatgcgaaccagctgggctctgtgtgaagccttgacactggccactggacccataaccacactctgggagggctcgccaggtaagttttggaatacgaccattgcggtgtctatggctaacatcttcagaggctcctacctggcaggggccggattagcttttagcattatgaaatcagtaggcactgggaagcgcggaacaggcagtcaaggtgagacccttggggaaaaatggaagaagaaactgaatcagctctctaggaaggagttcgacctatataaaaagtccggaatcactgaagtggatcggacagaggccaaagaaggcctgaagcgtggtgagataacccatcacgcagtcagcagaggctcagccaaattgcagtggtttgttgagaggaacatggtgatccccgaagggcgcgtcattgacctgggatgcggcagagggggatggagttactattgtgctggcctcaagaaggtgacggaggtacgaggttacaccaaagggggacctggccatgaggaaccggtgcccatgagcacatatggctggaatatcgttaaacttatgtccgggaaagatgtgttctacctgccacctgagaagtgcgacactttgctgtgtgatattggagaatctagcccctcccctaccgtcgaggaatcaagaacaatcagggtgctcaaaatggtcgagccatggttaaagaacaatcagttctgcattaaggtgctgaacccctacatgcctactgttatcgaacaccttgagcgcctgcaacggaaacacggtggcatgctagtaagaaatccactctctcgtaacagtacccatgagatgtattggatatcgaatgggacaggaaacattgtggcgagcgtcaatatggtgtccaggctgttgctgaaccggtttaccatgactcaccgccgacccacgatcgaaaaggacgttgatctcggcgccggtacaagacatgtgaacgcagagccggaaacccctaatatggacgtcatcggggagaggattaaacggataaaggaggaacacaactctacttggcactacgatgacgagaatccatataaaacctgggcttaccatggatcatatgaagtgaaggccacaggcagcgcatccagtatgatcaacggcgtagtgaaacttctgacgaaaccctgggacgttgtccctatggtgacccagatggccatgactgatacaaccccattcgggcagcaacgcgtgtttaaggagaaagtcgacactagaacacccaggtctatgccgggaacccgacgggttatgggtattacagctgaatggttatggcgtactctgggcagaaataagaaacctcgcttgtgtaccagggaggagttcacgaagaaggtgcggaccaacgccgcgatgggggcagtatttacagaggagaatcagtgggatagcgccaaagctgccgtggaagacgaggatttctggaagctcgtcgacagagaacgcgagctgcacaaactaggaaagtgcggctcatgtgtgtacaacatgatgggtaaaagggagaagaaacttggggaatttggaaaggcaaagggctcccgagctatctggtatatgtggctgggcgcccggtacctcgagttcgaagctctggggtttttgaatgaggatcattggttcagtagagaaaacagctactctggagttgagggtgagggcctgcacaaactcgggtatattcttagggacatctccaagatacccggaggcgccatgtacgcagatgacactgcgggttgggatacccgcatcacagaagacgacctgcataatgaggagaagattactcagcagatggatccagagcaccgtcaattagccaacgctatctttaagctgacctatcagaataaagtggtcaaggtgcagcggcctacgcccacagggaccgtaatggacattatctcaagaaaggatcagaggggaagcggccaagttggcacttacgggttgaacacattcaccaatatggaagcccagctcatacgccagatggagggagagggtgtgctgtcgaaagcagacctagaaaacccacaccttcccgagaagaaaattactcagtggctggaaaccaagggcgtcgagcgactcaaacggatggctatctctggggatgactgcgtggtgaagcctatcgatgacagatttgccaacgcactgttggccttaaatgatatgggaaaggtcaggaaagacattccacaatggcagccgagtaagggctggcatgattggcagcaggttcccttctgctcccaccatttccacgaactgataatgaaagacggtcgcaagctcgtggtaccttgtagaccacaagatgagcttatcgggcgggcgaggattagccagggagctggctggtcactgcgtgagacagcctgcctaggcaaagcatatgcccagatgtggtccctgatgtactttcaccgacgcgacctcagattggcttctaacgccatctgtagcgcagtgcccgtccattgggtgcctacgagtcggaccacttggtccattcacgctcatcaccaatggatgacaaccgaagacatgctgactgtttggaatagggtgtggatcgaggataacccatggatggaagacaagacacccgtcaccacgtgggagaatgtgccttatcttgggaagcgcgaggatcagtggtgcggaagcctgataggtctcacatctagagccacctgggcgcagaacatcccgactgctattcagcaagtacggtcattaatcggcaatgaagagttcctggactacatgccaagtatgaaaaggtttcgaaaggaagaggaatccgagggggccatttggtga

SEQ ID NO: 15136 - RNA, 9873 nt, synthetic construct
  misc_feature 1..9873: note = derived and/or modified CDS sequence (opt3) from DENV-3__JF808129__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattaccggcgtactcgagcaggggaaaagaactctgacaccacagcctatggagttaaagtactcatggaaaacctggggaaaggcgaagatcgtcacagccgaaactcaaaacagttccttcataattgatggccccaataccccagagtgccccagcgcttctagggcatggaacgtgtgggaagttgaggactatggttttggggtgttcacgacaaatatctggctgaaacttcgggaagtctacacccagttgtgtgaccaccgcctcatgtcagccgctgtgaaggatgagagagccgttcacgcagacatgggatactggattgagagtcagaaaaacggcagctggaagctggaaaaagcgtccctaatcgaggtgaagacttgcacctggcctaagtctcatacactgtggtcgaatggtgtactcgaaagcgatatgataatcccaaaatccctggccggcccgatttcacagcacaaccataggcccgggtatcacactcaaaccgctggaccttggcaccttggcaagttggagctggactttaattactgcgaggggacaacggtcgtgatcaccgaaaactgtggaactcgtggcccaagtttacggacaaccactgtgtctggtaaactcattcatgagtggtgctgtcgaagctgcacactgccccctcttagatatatgggggaagatggatgttggtacggcatggagatcaggccaatatccgaaaaggaggagaatatggtcaaatcactggttagcgccggttctggcaaggtggacaactgcaccatgggggtattgtgtctcgcaattctgttcgaagatgtgatgcgcggaaagtttggcaaaaagcacatgatcgctggggtcttcttcacgtttgtgctactgctctccggacagatcacttggcgggacatggcccataccctgattatgatcggcagtaatgcaagcgatagaatgggtatgggggttacatatcttgccttgattgctaccttcaaaatacagccctttctggcgttaggattctttctcaggaagctgacttctcgcgagaaccttctgctaggcgtgggcctcgccatggcaacaaccctgcaattgccggaagacatcgagcagatggctaatgggattgccctgggattaatggccctcaaactgatcacacagttcgaaacttaccagctttggaccgctctgatttccttgacgtgctcaaacacaatgtttaccctcactgtcgcatggcgaaccgccacactgatcctagcgggtgtgagtctgcttcctgtttgtcaaagctcgtccatgcggaagactgattggctcccaatggctgtggccgcaatgggcgtcccccctctgcccttgttcatattttctctgaaggacaccttaaaacgtagaagctggccactcaatgagggggtaatggccgtgggactggtttcaatccttgctagttccctgttgaggaacgatgtgcctatggcaggccccctcgtcgccggtgggctgctaattgcgtgctatgtgatcacgggaacatctgctgacctgaccgtagagaaggccgcagacattacttgggaagaggaagccgagcagacaggcgtgagccacaaccttatgaccactgtcgatgacgatggcacaatgcgcatcaaagacgatgaaaccgagaatatactcacggttctgttgaagactgctttaaccattgtgtccggggtgttcccatactcaatcccggccacactgctcgtctggcatacctggcagaaacagacacaacggagcggagtgctgtgggacgttcctagtcccccagagactcagaaggcagaacaggaggaaggtgtatacagaatcaaacagcaaggcatttttgggaagacccaggtgggagtcggcgtgcagaaggagggtgttttccacacgatgtggcacgtgacaaggggggctgtccttacttataacggaaaacgactggagcccaattgggcctctgtgaagaaagatttgatatcctacggcggcgggtggcgcctaagcgcgcaatggcagaagggagaagaggtacaggtcatcgccgtggaacctggtaaaaacccaaagaattttcagaccatgcccggcacattccaaaccactaccggggagattggagcaatcgctctggacttcaagcctggcacatcgggttcaccgattatcaaccgggaagggaaagttgtgggactctatggcaatggcgtcgtgacgaagaacgggggatacgtttctggtatagcccagactaatgctgagccagatggccccacccctgagctggaagaggaaatgtttaaaaagagaaaccttacaatcatggacttacatccagggagtggaaaaaccaggaagtatctgcccgcaattgtgcgtgaggccatcaagcgccggctcagaactttgattctggcccctacaagggtcgtggctgcggaaatggaggaggcactcaaaggcctgccgatccgataccagaccacggccactaagtccgaacacacaggtcgggagatagtagatcttatgtgtcatgctaccttcaccatgcgcctgttgagccccgtgagagttccaacttataatctaattatcatggacgaagcccactttacagatcctgcatctatcgccgctagggggtacattagcacccgggtcggaatgggcgaggcggccgcaatcttcatgacagctactcccccaggcacggccgacgcatttcctcagtccaacgcccccatacaagacgaagagcgagatattccagagagatcatggaatagtgggaacgaatggatcaccgacttcgctggaaaaacagtgtggtttgtgccgagcattaaggccggtaatgatatcgcgaactgcctgcgcaaaaacggcaagaaggtcatacagctctctaggaaaactttcgacaccgagtaccagaagacaaaattaaatgattgggactttgtagtgaccactgatatttccgaaatgggggcaaacttcaaggccgaccgtgttatcgatcctcggagatgcctgaaacccgtgatccttacggacggaccagagagggtcattctggctggccccatgcctgtgaccgccgcttcagcagcccagcgccgaggtagagttgggcggaatccacaaaaggagaacgatcagtatatctttacaggccagcccctcaataacgacgaagaccatgctcactggactgaggccaagatgttgctggataatattaacacccctgaaggaataatcccggcactcttcgagccagaaagggagaaaagtgcggccattgacggcgagtaccgcctgaagggggaaagccgtaaaacattcgtggagcttatgagacggggagatctacccgtctggctggctcacaaggtggcctccgaaggtatcaaatataccgacaggaagtggtgttttgatggccagcgcaataaccaaatcttggaggaaaatatggacgtagagatttggactaaagagggggaaaagaagaaattacgacctagatggctggatgcacggacatactctgaccccctcgctctgaaggagttcaaagattttgccgcaggaaggaagtcgatagcccttgacctggtgacggaaatcggccgcgttccaagccatctcgctcacagaaccaggaacgcgttggataatctggtcatgctacatacttcagagcacggtgggcgggcctatcgtcacgcagtggaagagctgcctgagacaatggaaaccctccttctgttaggcttgatgattctgctcaccggaggcgctatgctgttccttatctccgggaaaggaattggtaagacaagtatcggcctgatatgcgtgatcgcctctagcgggatgctctggatggccgagattcccttgcagtggatcgcatccgctattgtcctggaatttttcatgatggttttactaatcccagagcctgagaagcagcgcactccgcaagacaaccagctggcctacgtggtaataggaattctcacgcttgcggctatcattgccgcaaatgaaatgggcctgttggagaccacaaaacgagatctgggtatgtcaaaggaacccggggtggtctctccaactagctatctcgacgtggacctgcatcctgccagtgcttggaccctttacgcagttgccacaaccgtgatcactcccatgctcagacacacgatagagaactccacagcgaatgtcagcctggctgccatcgcaaaccaggccgtagtgttgatgggcctggataaaggatggccaatttctaagatggacttaggcgttcctctactggctctcgggtgttactcacaggtgaacccccttaccctgactgccgcagtcttgctgctcatcacccattatgctattatcggaccgggcctgcaagccaaagcgacaagggaagcccagaagcggactgcagctggtataatgaagaatccaaccgtggatgggattatgacaatcgaccttgatcctgtcatctacgactccaaatttgagaagcagttaggacaggtgatgctgctcgttttgtgcgccgtgcaactgctactgatgcgcacgagttgggcactctgtgaggctcttaccctggccactggccccattacaaccttgtgggaaggtagcccaggcaaattctggaacactacaatcgccgtatcgatggcgaatatatttagagggtcttatctggctggagcaggcctcgccttctccattatgaagagcgtggggaccggaaaaaggggcacgggttcacagggggagaccctgggagaaaagtggaagaaaaagttaaaccagcttagtcggaaagagtttgatctgtacaagaaatctggcatcacagaagtcgaccgaactgaggctaaggagggtctcaaaagaggcgaaattacccaccatgccgtttcccgcgggagcgcaaagctacagtggttcgtggagaggaatatggtcatccccgaaggacgggtgatagatctgggctgcgggcgtggaggctggtcatattactgtgccggtttgaagaaagtaacagaggtgagagggtatactaagggaggccctggccacgaagagccggttcccatgagtacctacgggtggaacatcgtgaaactgatgagcggaaaggacgtcttttacctcccacctgagaaatgcgatacacttctgtgtgacattggtgaatcctctcccagccctaccgtggaggaatccaggactatccgcgtcttgaagatggtggagccatggctgaagaataaccaattctgcattaaagttctcaatccctatatgcctacggtaatcgagcacttagaacggctgcagcgaaagcatggcgggatgcttgtgagaaacccactgtcaaggaattctacacacgagatgtactggattagtaacggaaccggcaatatcgtcgcttcggtgaacatggttagccgcctactcctgaatcggttcactatgacccatagacgtcccacaatagaaaaagatgtggacttgggtgcggggacgaggcacgtcaacgccgagccggaaacccctaacatggacgtgattggagagcggatcaagcgcactaaagaggaacacaattccacatggcattatgatgacgagaacccatacaagacctgggcatatcacggctcttacgaagtaaaggctactggctcagccagctccatgatcaatggggtggttaaactgctcacaaagccctgggatgtcgtgcctatggtgacccagatggcaatgacagacactaccccatttggacaacagcgagtcttcaaagagaaggttgatacgagaacccccaggagtatgccgggtacacggcgcgtgatgggcattactgccgaatggctttggagaaccctggggaggaacaaaaagcctcgattatgtacacgggaggagtttactaagaaagtacgtaccaatgctgccatgggagcggtgttcacggaagagaaccagtgggactctgcaaaggccgctgtcgaagatgaggacttttggaaactggtggatagagaacgcgagttgcataagctcggcaaatgcggtagctgcgtttataatatgatggggaagagggagaaaaagctgggagaattcggcaaggccaaaggctcacgggcaatatggtacatgtggctaggggctagataccttgagtttgaagccctgggattcctcaacgaggaccactggttttcccgcgagaatagttatagcggtgtggaaggcgaggggctgcataagttgggatacatcctgagggatatttctaaaatccccggcggtgctatgtatgccgacgacacagcagggtgggatacccgaattactgaagacgatctccacaacgaggaaaagatcacacagcaaatggacccagagcaccggcagcttgcgaatgccatattcaaactgacctaccagaacaaggtcgtgaaggtacagagacctactcccaccggaacagttatggatatcatttccaggaaagaccaacgcggctcaggccaggtggggacgtatggattaaatacctttactaacatggaggctcagctgatccgtcagatggaaggtgagggcgtcttgagcaaggccgatctcgaaaatccacatctgcccgagaaaaagattacacaatggctagaaaccaaaggggtggagcggcttaagagaatggcaatctcgggagacgattgtgtggtcaagcctatagacgataggttcgctaacgccctgctcgcactgaacgacatgggcaaagttcgcaaggatattccacagtggcagccgtctaaaggttggcacgactggcagcaagtgcccttttgcagtcatcacttccacgagttgatcatgaaggacgggcgaaaattagtagtgccttgtcggccacaggatgaactgatcggaagagccaggatttcccagggcgcgggctggagcctccgcgagactgcttgccttgggaaggcctacgcacaaatgtggtcactgatgtatttccatagacgggacctaaggctggcctccaatgctatatgttctgccgtccccgtgcactgggttcctacaagccgtaccacgtggagtatccatgcacaccatcagtggatgacaaccgaagatatgctcactgtgtggaaccgagtctggattgaggacaatccatggatggaagataagacccccgtgacaacttgggagaacgtaccttacttgggaaaacgcgaggaccagtggtgcggttccctgatcggccttaccagcagagctacatgggcccagaatattccgacggcgatccaacaggttcggtctctgatagggaacgaagagtttctcgattacatgccatcaatgaagaggttccgcaaagaagaggagagtgaaggagctatctggtga

SEQ ID NO: 15137 - RNA, 9873 nt, synthetic construct
  misc_feature 1..9873: note = derived and/or modified CDS sequence (opt3) from DENV-3__JF808123__SS-prME
  source 1..9873: mol_type = other RNA
accagcctgtgcctcatgatgatccttcccgccgctctggcattccacttgacttccagagacggcgagcctaggatgattgtggggaagaacgaacggggtaagtctttactgtttaagactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggggagcgccgacgtgacaagagaagcgtcgcccttgcaccccacgtgggcatgggtctggatacaaggacccagacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcacctggccacacttcggaaactgtgtatcgagggaaagattaccaacatcacgaccgatagccgctgccctacacaaggcgaagctgtcttgccagaggaacaggaccagaattatgtttgtaaacacacttacgtggatcgaggttgggggaacggatgcggcctcttcggcaaggggagtctggtaacctgcgccaagtttcagtgtttaggacccatagagggtaaagtggtccaatatgagaatctgaagtacacagtgattatcactgttcataccggcgaccagcaccaggtggggaacgaaacacagggagtcaccgcagagattactcctcaggcttccacgacagaagccatcctcccagagtatggcacccttggtctggaatgctctccgagaactgggttggacttcaatgagatgatcctactgaccatgaaaaacaaggcgtggatggtgcataggcagtggtttttcgatctccccctgccttggacaagcggcgccaccactgagacaccaacgtggaatcggaaagaacttctggtaacctttaagaacgcacacgctaaaaagcaggaggttgtggtcttgggatcccaagaaggcgccatgcacactgctctcacaggggccaccgagattcaaaattcaggaggtacaagtatattcgcaggccatctgaagtgtcgtttaaaaatggacaagctggaactaaaagggatgagctacgccatgtgcactaacacctttgtgctcaagaaagaggtctctgagacgcagcacggaaccatcctgattaaggtggaatacaagggcgaggatgctccctgtaaaatccctttctccacagaagacggtcaggggaaggcgcataacggccgccttataactgcaaatccagttgtgaccaaaaaggaggagcccgtaaacattgaagccgagccgcctttcggagaatcaaatatcgtcatcggcacaggggataacgctttgaaaattaattggtataagaagggaagcagtatcggtaaaatgtttgaggccactgcaagaggcgccaggcggatggctattctgggggacaccgcctgggatttcggatctgtgggcggtgttctcaactccctggggaagatggtgcaccaaatatttggcagcgcatacacggcgcttttctcgggagtctcttgggtgatgaaaatcggcattggggtactgttgacatggatcggactcaattccaagaacacctcaatgagttttagctgcatcgctattggcataatcactctgtatttaggtgccgtggttcaggcagacatggggtgtgtcattaattggaaaggaaaggaactgaagtgcggctccggtatcttcgtgacaaacgaggtgcatacctggactgagcagtacaaatttcaggccgattctcccaagcgactagctaccgccattgcaggcgcttgggaaaatggggtctgtggaatccgcagcacaacgagaatggagaacctcctgtggaaacaaatagccaatgaacttaactatatcttgtgggagaataacattaagctgaccgttgtggtgggcgacatcattggggtactcgaacagggaaaaaggactctgacaccacagcctatggagttaaagtactcatggaaaacctggggcaaggcgaagatcgtcacagccgagactcagaacagttccttcataattgatggtcccaataccccagaatgccccagcgcttctcgggcatggaacgtgtgggaggttgaagactatgggtttggagtgttcacgacaaatatctggctgaaacttcgcgaggtctacacccaattgtgtgaccacagactcatgtcagccgctgtgaaggatgaaagggccgttcacgcagacatgggctactggattgagagtcagaaaaacggtagctggaagctggagaaagcgtccctaatcgaagtgaagacttgcacctggcctaagtctcatacactgtggtcgaatggcgtactcgagagcgatatgataatcccaaaatccctggccgggccgatttcacagcacaaccatcgtcccggatatcacactcagaccgctggcccttggcaccttgggaagttggaactggactttaattactgcgagggaacaacggtcgtgatcaccgagaactgtggcactcggggtccaagtttacgaacaaccactgtgtctgggaaactcattcatgaatggtgctgtagaagctgcacactgccccctcttaggtatatgggagaggatggctgttggtacggtatggaaatccgcccaatatccgagaaggaagagaatatggtcaaatcactggttagcgccggctctgggaaggtggacaacttcaccatgggagtattgtgcctcgcaattctgtttgaggaagtgatgcggggcaagttcgggaaaaagcacatgatcgctggagtcttctttacgttcgtgctactgctctccggccaaatcacttggagagatatggcccataccctgattatgatcggtagtaatgcaagcgacaggatggggatgggagttacatatcttgccttgattgctacctttaaaatacagcccttcctggcgttaggctttttcctccgcaagctgacttctcgagagaaccttctgctaggcgtggggctcgccatggcaacaaccctgcagttgccggaagatatcgagcaaatggctaatggaattgccctgggtttaatggccctcaaactgatcacacagtttgaaacttaccagctttggaccgctctgatttccttgacgtgttcaaacacaatgttcaccctcactgtcgcatggcggaccgccacactgatcctagcgggcgtgagtctgcttcctgtttgccagagctcgtccatgcgtaagactgactggctcccaatggctgtggccgcaatgggggtaccccctctgcccttgtttatattctctctgaaggataccttaaaaagaaggagctggccactcaatgagggagtaatggccgtgggcctggtttcaatccttgctagttccctgttgcgcaacgacgtgcctatggcaggtcccctcgtcgccgggggactgctaattgcgtgttatgtgatcacgggcacatctgctgatctgaccgtagagaaggccgcagacattacttgggaagaggaagccgagcaaacaggcgtgagccacaaccttatgatcaccgtcgacgatgacgggactatgcggataaaagatgacgaaacagagaatattctcaccgttctgttgaagacggctttactgatcgtgtccggagtgtttccatactcaatcccggccactctcctggtctggcatacctggcagaaacagacacagagaagcggtgtgctttgggatgttcctagtcccccagagacccaaaaggcagaactggaggaaggcgtatacaggattaaacagcaggggatattcggaaagacacaggtgggcgtcggtgtgcaaaaggagggggtttttcacactatgtggcacgtgacccgaggagctgtcttgacgtataacggcaaacgcctagagcccaattgggcctctgtgaagaaagacctgatctcctacggcgggggatggcggctcagcgcgcagtggcagaagggtgaagaggtacaagtcattgccgtggaacctggcaaaaacccaaagaatttccagacaatgcccgggactttccagaccacaaccggagagatcggcgcaattgctctggattttaagcctggtacttcggggtcaccgatcataaacagagaaggaaaagttgtgggcctttatggcaatggggtcgtgaccaagaacggaggttacgtttctggcatcgcccagacaaatgctgagccagacgggcccacgcctgagttagaagaggaaatgttcaaaaagaggaacctgactattatggatctccatccaggaagtggcaaaacccgtaagtatttgcccgcaatcgtgcgcgaggccattaagcggagactgaggacactcatcctggcccctacccgagtcgtggctgcggaaatggaggaggcacttaaaggtctgccgatacggtaccaaactacagccaccaagtccgaacacacggggcgcgagattgtagacttgatgtgccatgctacttttacaatgagactactgagccccgtgagggttccaaattataacctcatcatcatggatgaagcccacttcaccgaccctgcatctattgccgctcggggatacatcagcacccgagtcggcatgggcgaggcggccgcaatatttatgactgctacacccccagggaccgccgatgcattccctcagtccaatgcccccattcaggacgaagagagagacatcccagagcgctcatggaacagtggaaatgaatggattacagattttgctggtaaaactgtgtggttcgtgccgagcatcaaggccggcaacgacatagcgaactgtttaaggaaaaatgggaagaaggtcattcagctgtctcgtaaaacgtttgataccgagtaccaaaagacaaaacttaacgactgggatttcgtagtgactaccgacatctccgaaatgggagcaaattttaaggccgatcgggttatcgaccctagaaggtgcctgaaacccgtgattctcacagatggcccagagcgcgtcatcttggctggtcccatgcctgtgaccgccgcttcagcagcccagcgaagagggcgggttggcaggaacccacagaaggagaatgaccagtatattttcactggacaacccctgaacaatgatgaagaccatgctcactggacggaggccaagatgctcctggacaacataaatacccctgaaggcatcattccggcacttttcgagccagaacgcgagaaaagtgcggccatcgatggggagtaccgtctaaagggagaaagcagaaaaacatttgtggagctgatgcggaggggtgacttgcccgtctggttagctcacaaggtggcctccgaaggcatcaaatatactgatcgcaagtggtgcttcgacgggcagcgaaacaatcagattctggaggaaaacatggatgtagagatatggaccaaagagggagaaaagaagaaactcagacctcggtggctggacgcaaggacatactctgatccccttgctctgaaggagtttaaagacttcgccgcaggccgcaagtcgatcgccctcgatttggtgaccgaaattggtagagttccaagccatctggctcacaggactcggaatgcgctagacaacctggtcatgctccatacatcagagcacgggggccgtgcctatcgccacgcagtggaggaacttcctgagacgatggaaaccctgttattgctgggactcatgatcctgcttactggcggggctatgctgtttctcatttccggaaaaggtatcggcaagacaagtatagggttgatctgtgtgattgcctctagcggaatgctgtggatggccgagatccccttacagtggattgcatccgctatcgtcctagagttctttatgatggttctgctcataccagagcctgagaagcaacgaaccccgcaggataatcagcttgcctacgtggtaattggcatcctgaccttggcggctattatcgccgcaaacgaaatgggtctgctcgagacaactaaaagagacctggggatgtcaaaggaacccggcgtggtctctccaacgagctatcttgatgtggacctccatcctgccagtgcttggaccctgtacgcagttgccacaactgtgataacccccatgttgaggcacacaatcgaaaattccaccgcgaacgtcagcctggctgccattgcaaaccaagccgtagtgttaatgggactagacaaaggctggccaatctctaagatggatctgggggttcctctccttgctctgggatgctactcacaggtgaatcccttgactctgacggccgcagtcctcctgcttattacacattatgctatcataggcccgggtttacaggccaaagcgacccgggaagcccagaagcgcactgcagctgggattatgaagaacccaaccgtggacggaatcatgacaatcgatctggaccctgtcatttacgattccaaattcgagaagcaactcggccaggtgatgttgctggttctatgtgccgtgcagctgctccttatgagaacaagttgggcactgtgcgaggctttgaccctggccacaggtcccatcacgaccctctgggaaggcagcccagggaaattttggaatactacaatagccgtatcgatggcgaacattttcaggggatcttatctggctggcgcagggttagccttttccatcatgaaaagcgtgggaaccggcaaacggggtactgggtcacagggagagacacttggcgaaaagtggaagaaaaagctgaatcaactcagtcgaaaagagttcgacctatacaagaaatctggtattaccgaagtcgatagaacggaggctaaggagggcctgaaacgcggggaaatcacccaccatgccgtttccaggggaagcgcaaagttgcagtggtttgtggagcggaacatggtcatacccgaaggccgtgtgatcgacctggggtgtggaagaggcggttggtcatattactgcgccgggctcaagaaagtaacagaggtgaggggatatactaagggcggccctgggcacgaggaaccggttcccatgagtacctacggatggaatattgtgaaacttatgagcggtaaggatgtcttctacctgccacctgagaaatgtgacacattgctgtgcgatatcggcgaatcctctcccagccctactgtggaggaatcccgcaccattcgggtcctcaagatggtggagccatggttaaagaacaatcagttctgtatcaaagttctgaacccctatatgcctacagtaattgagcaccttgaacgactgcagagaaagcatgggggaatgctagtgaggaatccactctcacgcaactctacccacgagatgtactggatcagtaatggcactggtaacatagtcgcttcggtgaatatggttagccggctgttgctgaacagatttacgatgacacatcgtaggcccaccattgaaaaagacgtggatctcggggcgggaactcggcacgtcaacgccgagccggaaacccctaatatggacgtgatcggcgagcgcatcaagcgaattaaagaggaacacaactccacatggcattatgacgatgagaatccatacaagacgtgggcatatcacggctcttacgaagtaaaggctaccgggtcagccagctccatgataaacggagtggttaaacttctgactaagccctgggacgtcgtgcctatggtgacacaaatggcaatgaccgatactacaccattcggtcagcagagagtctttaaagagaaggttgacaccaggacaccccggagtatgccgggcactcgcagagtgatggggatcaccgccgaatggttatggaggacgctgggacgaaataaaaagcctcggttgtgcacccgtgaggagttcacaaagaaagtaagaactaacgctgccatgggcgcggtgtttaccgaagagaatcaatgggattctgcaaaggccgctgtcgaagacgaggatttctggaaactcgtggaccgcgaaagggagctgcataagctaggtaaatgtgggagctgcgtttataacatgatgggaaagcgggagaagaaacttggcgaatttggcaaagccaaagggtcaagagcaatttggtacatgtggctgggagctcgctacctcgagttcgaagccctgggatttttgaatgaggatcactggttctccagggagaacagttatagcggcgtggaaggggagggactgcataagctcggctacatccttcgagacatttctaaaatccccggtggggctatgtatgccgatgacacagcaggatgggacactcggataaccgaagatgacctgcacaatgaggaaaagatcacgcagcagatggatccagagcacagacagttagcgaacgccatttttaaactgacataccaaaataaggtcgtgaaggtacagaggcctacccccactggcacagttatggacatcatttcccgcaaagatcagcgtggctcaggacaggtgggaacctatggtttgaacactttcaccaatatggaggctcaactcatccggcagatggaaggcgagggggtcctgagcaaggccgacctagaaaacccacatcttcccgagaaaaagataacacagtggctggaaacgaaaggagtggagagactcaagaggatggcaatttcgggcgatgactgcgtggtcaagcctatcgatgaccgctttgctaacgccctgttggcattaaatgatatgggtaaagttcgaaaggacatcccacagtggcaaccgtctaaagggtggcacgattggcaacaggtgcccttctgtagtcatcacttccacgagctgattatgaaggacggacggaaactcgtagtgccttgcagaccacaggacgaacttataggcagggcccgcatctcccaaggcgcggggtggagcctgagagagaccgcttgtctaggaaaggcctacgcacagatgtggtcactgatgtattttcatcggagggatctccgtttggcctccaacgctatttgctctgccgtccccgtgcactgggttcctactagccgaacaacctggagtatccatgcacaccatcagtggatgactacagaagacatgctgaccgtgtggaatcgcgtctggattgaggataacccatggatggaagacaagacgcccgtgacaacctgggagaatgtaccttaccttggtaaaagagaggatcaatggtgtggctccctgatcgggctcactagccgggctacctgggcccagaacataccgacagcgatccagcaggttaggtctttaattggaaatgaagagttcctggactacatgccatcaatgaagcgctttagaaaagaagaggagagtgaaggcgctatctggtga

SEQ ID NO: 15138 - RNA, 9873 nt, synthetic construct
  misc_feature 1..9873: note = derived and/or modified CDS sequence (opt3) from DENV-3__JF808128__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaggaccgaagcaactcaactggccacacttcggaagctgtgtatcgagggaaaaattaccaacatcacgaccgatagccgctgccctacacagggcgaagctgtcttgccagaggaacaggaccagaattatgtttgtaagcacacttacgtggatcgaggttgggggaacggatgcggcctcttcggcaaagggagtctggtaacctgcgccaagtttcaatgtttagagcccatagagggaaaggtggtccagtatgaaaatctgaaatacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaagaacaaagcgtggatggtgcataggcagtggtttctcgatctgccccttccttggacaagcggggccaccactgaaacaccaacgtggaatcggaaggagctgttggtaaccttcaaaaacgcacacgctaagaaacaagaagttgtggtcctcggctcccaggagggagccatgcacactgctctgacaggcgccaccgaaattcagaattcagggggaacaagtatatttgcaggtcatttaaagtgtcgtctgaagatggacaaactagagctcaagggcatgagctacgccatgtgcactaacaccttcgtgctgaaaaaggaggtctctgaaacgcagcacgggaccatccttattaaagtggagtacaagggagaagatgctccctgtaagatccctttttccacagaggacggccaaggtaaagcgcataacgggcgcttgataactgcaaatccagttgtgaccaagaaagaggaacccgtaaacattgaggccgaaccgcctttcggcgagtcaaatatcgtcatcggaattggcgataacgctctgaagatcaattggtataaaaaggggagcagtattggaaagatgttcgaagccacagcaagaggtgccaggcggatggctatactcggcgacactgcctgggattttgggtctgtgggaggcgttctgaactcccttggtaaaatggtgcaccagatcttcgggagcgcatacaccgcgctgttttcgggcgtctcttgggtgatgaagattggaatcggcgtattgctcacgtggatcgggctgaattccaaaaacacatcaatgagtttcagctgcattgctataggaatcattaccttatatctgggcgccgtggttcaggcagacatgggttgtgtcatcaattggaaggggaaagagctaaagtgcggatccggcatttttgtgactaacgaggtgcatacatggaccgaacagtacaagttccaagccgattctcccaaacgactcgctactgccatcgcaggtgcttgggagaatggcgtctgtgggatacgcagcaccacaagaatggaaaacctgctttggaagcagatcgccaatgagttgaactatattctgtgggaaaataacatcaaactcacggttgtggtgggagacattatcggcgtactggagcaggggaagaggaccttaactccacagcctatggagctgaaatactcatggaagacatggggaaaaagtaagatagtcaccgcggaaacacaaaactccagctttattatcgatggccccaatactccagagtgcccctctgcctcacgggcttggaacgtgtgggaagttgaggactatggtttcggggtgtttaccacgaatatttggcttaagttgcgcgaagtctacacacagctctgtgaccacagactgatgagtgcagccgtgaaagatgagagggctgttcacgccgacatgggatactggatcgagagccagaagaacggctcctggaaactagaaaaggcatctctgatagaggtgaaaacctgcacttggcctaagtcgcataccctctggagcaatggtgtactggaatccgatatgatcattccaaagtcacttgcgggcccgatcagtcagcacaaccatcgtcccgggtatcacacacaaactgccggaccttggcacttgggcaaactggagttagacttcaattactgcgaggggaccacagtcgtgattacggaaaactgtggaacccggggcccagctctccgaactacaaccgtgtctggtaagctgatccatgagtggtgctgtagaagctgcactcttccccctctgaggtatatgggggaagatggatgttggtacggcatggagatacgcccaatttccgaaaaagaggagaatatggtcaagtcattggttagcgccggttctggcaaagtggacaactttacaatgggggtactctgcctggcaatcctattcgaagaggtgatgcggggaaagtttggcaagaaacacatgatcgctggggtcttcttcacctttgtgctgctcctgtccggacagattacgtggagagatatggcccatactcttatcatgattggcagtaatgcaagcgacaggatgggtatgggggttacctatttggccctgatagctacattcaagatccagccctttttagcgctcggattctttctgcgcaaacttacctctcgagaaaacctgctactcggcgtgggcctggccatggcaactacattgcaactgccggaggatattgaacagatggctaatgggatcgccttaggactcatggccctgaagcttattacccagttcgagacataccagctgtggactgctttgatctccctcacctgttcaaacacgatgtttacactgaccgtcgcatggcggactgccaccctaatactggcgggtgtgagtcttctccctgtttgccaaagctcgtccatgcgtaaaacagactggctgccaatggctgtggccgcaatgggcgtcccccctttgcccctgttcatcttttctttaaaggatactctcaagagaaggagctggccactgaatgagggggtaatggccgtgggacttgtttcaattctggctagttccttgctccgcaacgacgtgcctatggcaggccccctggtcgccggtgggctactgatcgcgtgttatgtgattaccggaacgtctgctgatcttacagtagaaaaagccgcagacatcacctgggaggaagaggccgaacagactggcgtgagccacaacctcatgataacagtcgacgatgacggcaccatgcggattaaggatgacgagactgagaatatcctgacagttttgttaaaaaccgctctgctcatcgtgtccggggtgttcccatactcaattccggccacgctgcttgtctggcatacttggcagaagcagacccaaagaagcggagtgctgtgggatgttcctagtcccccagaaacacagaaagcagagttggaagagggtgtatacaggataaagcagcagggcatctttgggaaaacccaagtgggagtcggcgtgcagaaggagggtgttttccacacaatgtggcacgtgactcgaggggctgtcctaacctataacggaaagcgcctggaacccaattgggcctctgtgaaaaaggacctcgtatcctacggcggcgggtggcggctgagcgcgcagtggcaaaaaggagaggaagtccaggtgattgccgttgagcctggtaagaacccaaaaaattttcagacgatgcccggcacattccagactaccacaggggaaatcggagcaattgctcttgatttcaagcctggcacctcgggttcaccgatcataaacagagaggggaaggtggtcggattatatggcaatggcgtggttactaaaaacgggggatacgtgtctggtatcgcccaaaccaatgctgagccagacggccccacacctgaactggaggaagagatgtttaagaaaaggaacctcacgattatggatttgcatccagggagtggaaagactcgtaaatatctgcccgcaatcgtccgcgaagccattaagcggagactcaggaccctgatccttgcccctacacgagtggtagctgcggagatggaggaagcactgaagggcttgccgatacggtaccagaccactgccacaaaatccgagcacaccggtcgcgaaattgtggacctaatgtgccatgctacgttcactatgagactgctcagccccgttagggtcccaaattataacttaatcatcatggatgaggcccactttacagaccctgcatctattgccgctcgggggtacatcagcacccgagtgggaatgggcgaagcggccgcaatattcatgaccgctactcccccaggcacagccgatgcatttcctcagtccaatgcccccattcaggacgaggagagagacatcccagaacgctcatggaacagtgggaatgagtggattaccgatttcgctggaaagacagtgtggtttgtcccgagcatcaaagccggtaacgacatagcgaactgtctgaggaagaatggcaaaaaggtaattcaactttctcgtaagactttcgatacggaataccagaaaaccaagctgaacgactgggattttgtggttacaactgacatctccgagatgggggcaaatttcaaagccgatcgggtgatcgaccctagaaggtgcctcaagcccgtcattttgaccgatggaccagagcgcgtgatcctggctggccccatgcctgttacagccgcttcagcagcccagcgaagaggtcgggtggggaggaacccacagaaagaaaatgaccaatatatttttaccggccagcccctcaacaatgatgaggaccatgctcactggactgaagccaagatgctgcttgacaacataaatacgcctgagggaatcattccggcactattcgaaccagagcgcgagaagagtgcggccatcgatggcgaataccgtctgaaaggggagagcagaaagaccttcgtcgaattgatgcggaggggagacttacccgtgtggctggctcacaaagtagcctccgagggtatcaagtatacagatcgccgatggtgctttgacggccagagaaacaatcagattctcgaagagaacatggatgtggagatatggactaaagaaggggagaagaaaaagctgcggcctaggtggcttgacgcacgcacctactctgatcccctggctctcaaggaattcaaagactttgccgcaggaagaaagtcgatcgccttggatctggttacagagattggcagggtcccaagccatctagctcaccggacccgtaatgcgctggacaacctcgtgatgcttcatacttcagaacacggtgggcgcgcctatcgacacgcagtggaggagctgcctgaaacaatggagacgttattgctgctcggcctgatgatccttctgaccggaggcgctatgctcttcttgatttccgggaaaggaatcggtaagactagtataggcctgatctgtgtcattgcctctagaagcatgtcctggatggccgaaatccccttacaatggattgcatcagctatcgttctagagtttttcatgatggtgctgctcataccagagcctgaaaaacagaggacaccgcaggataatcaacttgcctacgtagtgattgggatcctgaccttggcggctattatcgccgcaaacgagatgggactgctcgaaaccacaaagcgggacctgggcatgtctaaggagcccggtgtcgtgagcccaactagttatcttgatgttgacctccatcctgcctccgcttggacgctgtacgcagtggccaccacagtcataactcccatgttgcgccacaccatcgaaaatagcacagcgaacgtatctctggctgccattgcaaaccaggccgtggttttaatggggctagacaaaggctggccaatctcaaagatggatctgggagtgcctctccttgctctgggctgctactcccaggtcaatcccttgaccctgactgccgcagtgctcctgcttattacgcattatgctatcatagggccgggattacaggccaaagcgacaagagaggcccaaaagaggaccgcagctggcattatgaaaaacccaactgtcgacggtatcatgaccatcgatctggaccctgtgatttacgatagtaagtttgagaagcagctcgggcaggttatgttgctggtgctatgtgccgtacagctgctccttatgcggacaagctgggcactgtgcgaagctttgactctggccaccggacccatcacaacgctctgggagggctcgccaggtaaattctggaataccactatagccgtgtctatggcgaacatttttcgaggctcctatctggctggggcaggattagccttcagcatcatgaagtcagtcggcacagggaaaagaggaaccggcagtcaaggtgaaactcttggggagaagtggaaaaagaagctgaatcagctctctcgcaaagaatttgacctatacaagaaatccggaattacagaggttgataggaccgaggctaaggaaggcctgaaacggggtgagatcacgcaccatgccgtgagccgtggctcagcaaagttgcagtggttcgtcgaaagaaacatggtgatacccgaggggagggtaatcgacctgggatgtggccgcgggggatggagttattactgcgccggcctcaaaaaggtgaccgaagttcggggttatacaaaggggggacctggccacgaggagccggtgcccatgagcacttacggctggaatattgtcaaacttatgtccgggaaggatgtgttttacctgccacctgaaaaatgtgacaccttgctgtgcgatatcggagagtctagcccctcccctacagtcgaagagtcacgaactattagagtgctcaagatggttgagccatggttaaaaaacaatcagttctgtatcaaggtactgaacccctatatgcctaccgtgattgaacaccttgagaggctgcaacgcaagcatggtggcatgctagtccggaatccactctctagaaacagtacacacgaaatgtactggatctcgaatgggaccggaaacatagtggctagcgttaatatggtgtcccgtctgttgctgaacaggttcactatgacgcatcggcgccccacaattgagaaagacgtcgatctcggcgcgggtacccgacacgtgaacgccgaaccggagactcctaatatggacgtaatcggggagagaatcaagaggattaaagaagagcacaactctacctggcattatgacgatgaaaatccatacaagacatgggcatatcacggatcatacgaggtgaaagctacgggcagcgcctccagtatgataaacggcgttgtcaagcttctgaccaagccctgggacgtggtgcctatggtcactcagatggcaatgacagataccactccatttgggcagcaacgggttttcaaagaaaaggtggacacacgcacccccagatctatgccgggaacaaggcgagtaatgggtatcactgccgagtggttatggcggaccctgggccgtaataaaaagcctagattgtgcacgcgcgaggaatttaccaaaaaggtgaggacaaacgctgccatgggggcggtcttcactgaggaaaatcagtgggatagcgcaaaggccgctgtggaggacgaagatttttggaaactcgttgaccgggagagagagctgcataagctaggaaaatgtggctcatgcgtgtataacatgatgggtaagcgcgaaaaaaagcttggggagttcggaaaagccaagggctccagggcaatttggtacatgtggctgggcgctcgatacctcgaatttgaggccctggggttcttgaatgaggatcactggtttagtcgggaaaacagctattctggagtcgagggtgaaggcctgcataagctcgggtacatccttagagacatttccaaaatccccggaggcgctatgtatgccgatgacaccgcaggttgggacacaaggataactgaggatgacctgcacaatgaagagaagatcacccagcagatggatccagagcaccgccaattagcgaacgccattttcaaactgacgtaccagaataaggtggtaaaagttcagcgtcctacacccaccgggactgtgatggacatcatttcacggaaggatcagagaggaagcggccaagtcggcacatatgggttgaacacctttactaatatggaagctcagctcatcaggcagatggagggagaaggtgtgctgtcgaaggccgacctagagaacccacatcttcccgaaaaaaagataacccagtggctggagacaaaaggcgtggagcgcctcaagcgaatggcaatttctggggatgactgcgtcgttaaacctatcgatgaccggttcgctaacgccctgttggcattaaatgatatgggaaaggtgagaaaggacatcccacaatggcagccgagtaaaggctggcacgattggcagcaggtacccttttgttcccatcacttccacgaactgattatgaaggacggtaggaaactcgtggtcccttgccgcccacaagacgagcttatagggagagcccggatcagccagggagcgggctggtcactgagggaaacggcttgtctaggcaaggcctacgcacagatgtggtccctgatgtatttccatcgtcgagatctccgcttggcctctaacgctatttgcagcgccgtgcccgttcactgggtgcctaccagtagaactacatggtccatccatgcacaccatcaatggatgaccactgaggacatgctgacagtctggaatcgggtgtggattgaagataacccatggatggaggacaaaacccccgtaacgacatgggagaatgttccttaccttgggaagagggaagatcagtggtgtggaagcctgatcggtctcacctctcgcgctacttgggcccagaacataccgaccgcgatccagcaagtgagatcattaattggcaatgaggaatttctggactacatgccaagtatgaagcggttcaggaaagaggaggaatccgagggggctatctggtga

SEQ ID NO: 15139 - RNA, 9873 nt, synthetic construct
  misc_feature 1..9873: note = derived and/or modified CDS sequence (opt3) from DENV-3__JF808122__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataatcaaatgtacgctaattgcgatggatctcggcgagatgtgcgacgataccgtcacatacaagtgtccacatatcactgaagttgagccggaagacattgattgctggtgtaatctgaccagtacatgggtgacctatgggacttgcaaccaggctggagagcgccgacgtgacaaaagaagcgtagcccttgcaccccacgtgggcatgggtctggatacaaggacccaaacgtggatgtccgccgagggggcttggcggcaggtcgaaaaggtggagacttgggcattgcgccatcctggattcaccatcctcgccctgtttctggctcactacataggcacatctctcactcagaaggttgtgatcttcattttactgatgcttgtcaccccatcgatgacaatgagatgtgtgggcgtagggaatagggactttgttgaaggattgtcaggtgccacctgggtggatgtcgtgctggagcatggcgggtgcgtgacgactatggcgaaaaacaagcccacactagacatcgagctccagaaaaccgaagcacctcacctggccactcttcggaagctgtgtattgagggaaaaatcacaaatataaccacggatagccgctgcccaacccaaggcgaagctgtcttgcccgaggaacaggaccagaactatgtttgtaagcacacatacgtggatcgaggttgggggaatggatgcggcctcttcggcaaggggagtctggtaacttgcgccaaatttcagtgtttagagcctattgagggaaaggtggtccaatatgaaaacctgaaatacaccgtgatcattacagttcatactggtgaccagcaccaggtgggcaatgagacccagggggtcacagcagaaatcaccccacaagcttccactacggaggccatcctcccggaatatggaacacttggcctggagtgctctcccagaaccggtttggacttcaacgagatgattctactgactatgaagaataaagcgtggatggtgcataggcagtggtttttcgatctccctctgccatggaccagcggggccacaaccgaaactcccacatggaaccggaaggagcttctggtaacgtttaaaaatgcacacgctaagaagcaggaagttgtggtcttgggctcccaagagggagccatgcacaccgctctcactggcgccacagaaatacagaactcagggggaaccagtatcttcgcaggtcatctgaaatgtcgtttaaagatggacaaactggagctaaagggcatgagctacgccatgtgcacaaatacttttgtgctcaaaaaggaggtctctgaaacccagcacgggacgattctgatcaaggtggagtacaaaggagaagatgctccttgtaagataccattctccaccgaggacggccagggtaaagcgcataacgggcgccttattacagcaaaccccgttgtgactaagaaagaggaaccggtaaatatcgaggccgaacctcccttcggcgagtcaaacatcgtcattggaaccggcgataatgctttgaagatcaactggtataagaaagggagcagtattggaaagatgtttgaagccacagcaagaggtgccaggcggatggctatactgggcgacactgcctgggatttcgggtctgtgggaggcgttctcaattccctgggtaaaatggtgcaccaaatctttgggagcgcatacaccgcgcttttctcgggcgtctcttgggtgatgaagattggaatcggcgtactgttgacgtggatcgggctcaactccaaaaatacatcaatgagttttagctgcattgctataggaatcattaccctgtatttaggcgccgtggttcaggcagacatgggttgtgtcatcaactggaaggggaaggagctgaaatgcggatccggcattttcgtgactaatgaggtgcatacatggaccgaacagtacaagtttcaggccgattctccaaaacgactagctactgccatcgcaggtgcttgggagaacggcgtctgtgggatacgcagcaccacaagaatggaaaatctcctgtggaagcaaatcgccaacgagcttaattatattttgtgggaaaacaatatcaaactgacggttgtggtgggagacattatcggcgtactcgagcaggggaagaggaccctgactcctcagcccatggagttaaaatactcatggaagacatggggaaaggcgaaaatagtcaccgccgaaacacagaacagttccttcattatcgatggcccaaacactcccgagtgccctagcgcttctcgggcatggaatgtgtgggaagttgaggactatggttttggggtgttcaccacgaacatttggctgaagcttcgcgaagtctacacacaattgtgtgaccacagactcatgtcagccgctgtgaaagatgagagggccgttcacgcagacatgggatactggatcgagagtcagaagaatggcagctggaaactggaaaaggcgtccctaatagaggtgaagacctgcacttggccaaaatctcataccctgtggtcgaacggtgtactcgaaagcgatatgatcattccgaagtccctggccggccccatctcacagcacaatcatcgtcctgggtatcacacacagactgctggaccatggcaccttggcaaattggagctggactttaactactgcgaggggaccacagtcgtgattacggaaaattgtggaacccggggccccagtttacgaactacaaccgtgtctggtaagctcatccatgagtggtgctgtagaagctgcactctgcctccacttaggtatatgggggaagatggatgttggtacggcatggagatacgccccatttccgaaaaagaggagaacatggtcaagtcactggttagcgccggttctggcaaggtggacaatttcacaatgggggtattgtgcctcgcaatcctgtttgaagaggtgatgcggggaaaattcggcaagaaacacatgatcgctggggtcttctttaccttcgtgctactgctctccggacaaattacgtggagagatatggcccatactctgatcatgattggcagtaacgcaagcgacaggatgggtatgggggttacctatcttgccttgatagctacatttaagatccagccgttcctggcgttaggatttttcctccgcaaactgacctctcgagaaaatcttctgctaggcgtgggcctcgccatggcaactacactgcagttgcctgaggatattgaacaaatggctaacgggatcgccctgggattaatggccctcaagctgattacccagtttgagacataccagctttggactgctctgatctccttgacctgttcaaatacgatgttcacactcaccgtcgcatggcggactgccaccctgatactagcgggtgtgagtctgcttccagtttgccagagctcgtccatgcgtaagacagactggctccccatggctgtggccgcaatgggcgtccctcccctgccattgtttatcttctctctgaaagatactttaaagagaaggagctggcctctcaacgagggggtaatggccgtgggactggtttcaattcttgctagttcctttctgcgcaatgacgtgcccatggcaggcccattggtcgccggtgggctcctgatcgcgtgttatgtgattaccggaacgtctgctgatctaacagtagaaaaagccgcagacatcacctgggaggaagaggccgaacaaactggcgtgagccacaacctgatgataacagtcgacgatgacggcaccatgcggattaaggatgacgagactgagaacatccttacagttctcctgaaaaccgctttgttaatcgtgtccggggtgttcccgtactcaattcctgccacgctgctcgtctggcatacttggcagaagcagacccagagaagcggagtgctgtgggatgttcccagtccacccgaaacacaaaaagcagagcttgaagagggtgtatacaggataaagcagcagggcatctttgggaagacccaggtgggagtcggcgtgcaaaaagagggtgttttccacacaatgtggcacgtgactcgaggggctgtcctgacctataatggaaagcgcttggaacctaactgggcctctgtgaaaaaggacctaatttcctacggcggcgggtggcggctgagcgcgcagtggcagaaaggagaggaagtacaagtcatcgccgtggagccaggtaagaatcccaagaacttccagacgatgcctggcacatttcagactaccacaggggaaattggagcaatcgctctcgatttcaaaccgggcacctcgggttcaccaataatcaatagagaggggaaggttgtgggactgtatggcaacggcgtcgtgactaaaaatgggggatacgtttctggtattgcccagaccaacgctgagcccgacggccctacaccagaacttgaggaagagatgtttaagaaaaggaatttaacgatcatggatctgcatcccgggagtggaaagactcgtaagtatctccctgcaattgtgcgcgaagccatcaaacggagattgaggaccctgatactcgccccgacacgagtcgtggctgcggagatggaggaagcactgaagggccttcccattcggtaccaaaccactgccacaaaatccgagcacaccggtcgcgaaatcgtagacctgatgtgccatgctacgttcactatgagattgctaagcccagtgagggttcctaactataatctgatcattatggatgaggcccactttacagaccccgcatctatcgccgctcgggggtacataagcacccgagtcggaatgggcgaagcggccgcaattttcatgaccgctactccacctggcacagccgatgcatttccccagtccaacgccccaatccaggacgaggagagagacattccggaacgctcatggaatagtgggaacgagtggatcaccgatttcgctggaaagacagtgtggtttgtgcctagcataaaagccggtaatgacattgcgaactgtctcaggaagaacggcaagaaagtcatccagttatctcgtaagactttcgatacggaataccaaaaaaccaagctgaatgactgggattttgtagtgacaactgacatctccgagatgggggcaaacttcaaagccgatcgggttattgaccccagaaggtgccttaagccagtgatcctgaccgatggacccgagcgcgtcattctcgctggccctatgccagtgacagccgcttcagcagcccagcgaagaggtcgggttgggaggaatccccagaaggaaaacgaccagtatatattcaccggccaacctttgaataacgatgaggaccatgctcactggactgaagccaaaatgctgctcgacaatatcaacacgccggagggaattatcccagcactgtttgaacccgagcgcgagaagagtgcggccatcgatggcgaataccgtcttaaaggggagagcagaaagaccttcgtggaactaatgcggaggggagacctgcctgtctggttggctcacaaagtggcctccgagggtattaagtatacagatcgcaaatggtgctttgacggccagcgaaataaccagatattagaagagaatatggatgtagagatctggactaaggaaggggagaagaaaaagctgagaccccggtggctcgacgcaaggacctactctgatccactggctcttaaagaattcaaggactttgccgcaggacgcaaatcgattgccctggatctcgtgacagagatcggcagagttcctagccatttggctcacaggacccggaacgcgctggacaatctagtcatgctgcatacttcagaacacggtgggcgtgcctatcgccacgcagtggaggagctccccgaaacaatggagacgcttctgttattgggcctgatgattctcctgaccggaggcgctatgcttttcctgatctccgggaagggaataggtaagactagtatcggcctcatttgtgtgatcgcctctagcgggatgtcctggatggccgaaattccattgcagtggatcgcatcagctatagtcctggagtttttcatgatggttttactaattcctgagccggaaaaacaacgaacaccccaggataaccagctggcctacgtggtaatcggaattctcacccttgcggctatcatagccgcaaatgagatgggcctgttggaaaccacaaagagagacctgggtatgtctaaagagccaggggtggtcagccctactagttatctcgatgtggacctgcatcccgcctccgcttggacgctttacgcagttgccaccacagtgatcactccaatgctcaggcacaccattgaaaacagcacagcgaatgtctctctggctgccatcgcaaaccaagccgtagtgttgatgggcctggacaagggatggcctatttcaaaaatggatttaggcgttcccctactggctctcgggtgctactcccaggtgaacccgcttaccctgactgccgcagtcttgctgctcatcacgcattatgctataattggaccaggcctgcaggccaaggcgacacgggaggcccagaagcgcaccgcagctggtatcatgaaaaatcctactgtggacgggatcatgaccattgatcttgaccccgtcatctacgatagtaagtttgagaaacaattaggacaggtgatgctgctcgttttgtgtgccgtgcagctgctactgatgagaacaagctgggcactctgcgaagctcttactctggccaccggcccaataacaacgttgtgggagggttcgcccggcaagttctggaacaccactattgccgtatctatggcgaatatctttagggggtcctatctggctggagcaggcctcgccttcagcattatgaaatcagtggggacaggaaagcggggcaccggtagtcagggggaaactctgggagagaagtggaaaaagaaattaaaccaactttctcgaaaggaatttgacctgtacaaaaagtccggcatcacagaggtcgatagaaccgaggctaaagaaggtctcaagcgcggcgagataacgcaccatgccgttagcagggggtcagcaaagctacagtggttcgtggaacggaatatggtcatccctgagggacgtgtgattgacctgggctgtgggagaggaggctggagttattactgcgccggtttgaaaaaggtaaccgaagtgagggggtatacaaaaggaggcccgggccacgaggagcccgttccaatgagcacttacgggtggaacatcgtgaagctgatgtccggaaaagatgtcttctacctccctcccgaaaagtgtgacacccttctgtgcgatattggtgagtctagcccttccccaacagtggaagagtcacgcactatccgggtcttgaagatggtggagccctggctgaaaaataaccagttttgtattaaggttctcaatccttatatgccaaccgtaatcgaacacttagagcgactgcagagaaaacatggcgggatgcttgtgaggaaccccctgtctcgcaatagtacacacgaaatgtactggatatcgaacggaaccggcaatattgtcgctagcgtgaacatggtttcccggctactcctgaatagattcactatgacgcatcgtaggccgacaatcgagaaggacgtggatttgggtgcggggacccggcacgtcaacgccgaacctgagactccaaacatggacgtgatcggagagcgcattaaacgaataaaggaagagcacaattctacctggcattatgacgatgaaaacccctacaagacatgggcatatcacggctcatacgaggtaaaagctacgggcagcgcctccagtatgatcaatggggtggttaagctgctcaccaaaccttgggacgtcgtgccaatggtgactcaaatggcaatgacagataccactccctttggacagcagagagtcttcaaggaaaaagttgacacaaggaccccgcggtctatgcctggtacacgcagagtgatgggcattactgccgagtggctttggaggaccctggggcgaaacaagaagccccggttatgcacgcgtgaggaatttaccaaaaaggtaagaacaaatgctgccatgggagcggtgttcactgaggaaaaccaatgggatagcgcaaaagccgctgtcgaggacgaagatttttggaagctggtggaccgcgagagggagttgcataaactcggcaagtgtggttcatgcgtttataatatgatggggaaacgggaaaagaagctgggagagttcggcaaagccaacggctccagagcaatctggtacatgtggctaggggctcgctaccttgaatttgaggccctgggattcctcaaggagtatcactggtttagtagggaaaatagctactctggtgtggagggcgaagggctgcataaattgggatatattctgcgagatatctccaagataccaggcggtgctatgtacgccgacgataccgcagggtgggacacacggatcactgaggacgatctccacaacgaagagaaaattacccagcagatggaccctgagcacagacagcttgcgaatgccatcttcaagctgacgtatcaaaacaaggtcgtgaaagtacagaggcccacaccaaccggaactgttatggatattatctcacgcaaggaccagcgtggcagcggccaggtggggacatacggattaaatacctttactaacatggaagctcaactgatacggcagatggagggtgaaggcgtcttgtcgaaagccgatctcgagaatccccatctgcctgaaaagaaaattacccagtggctagagacaaagggggtggagagacttaagaggatggcaatctctggagacgattgcgtggtcaaaccaatcgacgatcgcttcgctaacgccctgctcgcactgaacgacacgggcaaggttcgaaaagatattccgcagtggcaacccagtaagggttggcacgactggcagcaggtgcctttctgttcccatcactttcacgaattgataatgaaagatgggcggaagttagtagtgccatgcagaccccaggacgagctgatcggaagggcccgcattagccaaggcgcgggctggtcactcagagaaaccgcttgtcttgggaaggcctatgcacagatgtggtccctgatgtacttccatcggagggacctacgtctggcctctaatgctatctgcagcgccgtccctgtgcactgggttccaactagtcgaacaacctggtccattcatgcacaccatcagtggatgactacagaggatatgctcaccgtgtggaaccgcgtctggatcgaagacaatccctggatggaggataaaacgcctgtgacaacctgggagaacgtaccgtacttgggaaagagagaagaccaatggtgtggtagcctgataggccttacttctcgggctacctgggcccagaatatcccaacagcgattcagcaggttaggtcactgatcgggaacgaggaatttctcgattatatgcccagtatgaaacgcttcagaaaggaggaggaatccgagggagctatttggtga

SEQ ID NO: 15140 - RNA, 9873 nt, synthetic construct
  misc_feature 1..9873: note = derived and/or modified CDS sequence (opt3) from DENV-3__GQ466079__SS-prME
  source 1..9873: mol_type = other RNA
accagcctgtgcctcatgatgatccttcccgcagctctggcattccacttgacatcccgggacggcgaacctaggatgattgtggggaagaacgaacggggaaaatctttactgtttaagactgcctcaggtattaatatgtgtacgctaatcgcgatggatctcggcgagatgtgcgacgataccgtcacctacaaatgtccacacattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgccggtgcttgggagaatggcgtctgtgggatacgaagcaccacacgcatggaaaacctcctgtggaaacagatcgccaatgagcttaactatattttgtgggaaaataacatcaagctgacggttgtggtgggagacaccattggcgtactcgagcaggggaaaagaactctgacaccacagcctatggagttaaagtactcatggaaaacctggggaaaggcgaagatcgtcacagccgaaactcaaaacagtttctttataattgatggccccaataccccagagtgcccctccgctagcagggcatggaacgtgtgggaagttgaggactatggtttcggggtgtttacgacaaatatctggctgaaacttcgggaagtctacacccagttgtgtgaccaccgcctcatgtctgccgctgtgaaggatgagagagccgttcacgcagacatgggatactggattgagtcacagaaaaacggcagttggaagctggaaaaagcgagcctaatcgaggtgaagacttgcacctggcctaagtcccatacactgtggtctaatggtgtactcgaatcggatatgataatcccaaaaagcctggccggcccgatttcccagcacaaccataggcccgggtatcacactcaaaccgctggaccttggcaccttgagaatttggagctggacttcacatactgcgaaggcacgaccgtcgtgatcactgagaactgtgggacacgtggaccatcattacggaccactacagtgagtggcaagctcattcatgaatggtgctgtcgatcttgcaccctgccccctcttagatatatgggtgaggatgggtgttggtacggaatggaaatcaggccaataagcgagaaagaggaaaatatggtcaagtccctggtttcagccggcagcggtaaagtggacaactttacgatgggcattttgtgcctcgcaatcctgttcgaggaagtaatgcgcgggaagttcggaaagaaacacatgatcgctggcgtgtttttcacttttgtcctactgctctctgggcagattacctggcgggatatggcccatacactgatcatgattggatccaatgcaagtgacagaatgggcatgggtgtgacctatcttgccttgatagctactttcaagatccagccctttctggcgttagggttctttctcaggaaactgacaagccgcgagaaccttctgctaggagttggcctcgccatggcaaccacactgcaattgccggaagatattgagcagatggctaatggcatcgccctggggttaatggccctcaagctgattactcagttcgagacctaccagctttggacggctctgatctctttgacatgttccaacaccatatttactctcaccgtggcatggcgaacagccactctgatcctagcgggagtctcactgcttcctgtgtgccaaagtagctcgatgcggaaaaccgactggctcccaatgacggttgctgccatgggtgtgccccctctgcccttgttcatattttccctgaaggatacattaaagcgtagatcttggccactcaatgaaggcgtcatggcagtagggctggtgagcatccttgcctcaagtctgttgaggaacgacgttcctatggctggacccctcgtggcaggcggtctgctaattgcctgttatgtcatcaccgggacttccgcggatctgacagtggagaaagctgccgacgtaacctgggaagaggaagcagagcagactggagtgtctcacaaccttatgataacagtcgacgatgacggcaccatgcgcattaaggatgacgagacggaaaatatcctcactgttctgttgaaaaccgccttactgatcgtgagcggcattttcccatactccataccggctacactcctggtgtggcatacctggcagaagcagacacaacggtcaggggtcctttgggatgtgcctagcccaccagagactcagaaagccgaactggaggagggagtttacagaatcaagcagcagggtattttgggcaaaacccaagtaggggtgggagtccagaaggaaggcgtgtttcacacgatgtggcacgttacaaggggtgcagtgctaactcataacgggaagcgactggagcccaattgggctagtgtcaaaaaggacctcatctcttatggaggcggctggcgcctgtccgcccagtggcaaaaaggggaagaggtgcaggtaattgcggtcgaacctggaaagaaccccaaaaatttccagaccatgcccggtacattccagaccactaccggcgagatcggggccatagcacttgattttaagcctggaacaagcggctcgccgatcattaaccgggagggtaaggtggttgggttatacggaaatggcgtggtcacgaaaaacggcgggtatgtgtcaggaatcgctcaaactaatgccgaaccagacggtcccacccctgagctggaagaggaaatgttcaagaaaagaaacctcacaattatggatttgcacccaggctctgggaagaccaggaaatacctgcccgctatcgttcgtgaggcaataaagcgccggctcagaactctgattcttgcccctacaagggtggtcgccgctgagatggaagaggcgctgaagggattgccgatccgatatcagaccacggcaactaaaagtgaacatacaggccgggagatcgtggacctaatgtgccacgccacctttaccatgcgcctgctctcccccgtaagagtgccaaattacaacttaattatcatggatgaagctcatttcactgaccctgccagcatagcagccaggggttatatttctacacgggttgggatgggagaggctgcggccatctttatgagcgcaacacccccaggcacagctgatgccttccctcagtccaatgcacccattcaggacgaggaacgagacatcccagagagatcatggaacagtggcaatgaatggataactgattttgccgggaagacggtctggttcgtgccgagcattaaagctggaaacgacatcgccaactgtctgcgcaagaatggtaaaaaggtgatccaactttctaggaagacctttgatacagagtaccagaaaactaagctgaacgactgggatttcgtcgtaaccacagacatttccgagatgggcgcgaattttaaagcagatcgtgtgatcgaccctcggagatgcctcaagcccgttattttgaccgatgggccagaaagggtgatactggccggacccatgcctgtcactgctgcctcagctgcacagcgccgaggcagagtgggtcggaacccacagaaagagaatgaccaatacatcttcacggggcagcccctcaacaatgatgaagaccacgcccactggaccgaggctaagatgctgcttgacaacattaatacacctgaaggcatcatcccggccctattcgagccagagagggaaaagagtgcagcgattgatggagagtatcgcctgaaaggcgaaagccgtaagacttttgttgagttgatgagaagaggggacttacccgtgtggctggcccataaagtcgcttccgaaggaataaagtacaccgataggaaatggtgcttcgacggtcagcgcaacaatcagatcctcgaggagaacatggatgtggaaatttggacaaaggagggcgagaaaaagaagctgcgacctagatggcttgacgcccggacctattctgatcccctggcactcaaagagtttaaggacttcgctgccgggaggaaatcgatcgcattggatctggtaactgaaattggacgcgtgccaagccacctagcccatagaacaaggaatgctctggacaacctcgttatgcttcacacgtcagagcacggcggtcgggcgtaccgtcatgccgtcgaggaactgcctgagaccatggaaactttattgctgctcgggctgatgatccttctgacaggcggagcaatgctctttttgatatccggcaaggggatcggaaaaaccagtattggtctgatctgtgtgattgcttctagcggcatgttatggatggccgagatccccctacaatggatagcctccgcaattgtgctggagttctttatgatggtcctccttatcccagaacctgagaagcagcgcaccccgcaggataatcaactggcttatgttgtgattgggatcttgacactggccgcgataatcgctgccaacgaaatgggactcctggagactacgaagcgagaccttggcatgtcaaaagaacccggtgtagtgtctccaaccagctacctcgatgtcgacctgcaccctgcaagtgcctggacattgtatgctgtggcaactaccgttattacacccatgctgagacataccatcgaaaattccactgccaacgtgagcttagcggctattgccaaccaggcagtcgtactaatggggctggacaagggctggccaatctctaaaatggatctcggagtgcctcttctggccttgggctgctactcacaggttaatcccctgacgctcacagctgccgtgctgcttttaataacccactacgcaattatcgggccgggactgcaggctaaggccactagggaggcgcaaaaacggaccgccgcaggcatcatgaagaacccaacagtcgacggtattatcactatagatctcgaccctgtgatttatgattccaagttcgagaaacagttggggcaggtcatgctgctagtgctgtgtgctgttcagctccttctgatgcgcaccagttgggccttgtgcgaggcactgacactcgctacgggacccatcaccactctgtgggaaggcagcccaggtaagttttggaatacaaccattgccgtgtcgatggccaacatcttcagaggctcttacttagcgggggctggacttgcattttccataatgaaaagcgtaggcactgggaagaggggaacaggctcacaaggtgagaccctgggggaaaaatggaagaagaaactcaatcagctaagtcggaaggagttcgacctgtataaaaagtctggaatcacggaggtggatcgaaccgaagccaaagagggcttgaagagaggtgaaacaactcatcacgctgtctcccgcggcagcgccaaactgcagtggctcgttgagaggaacatggtgattcccgaagggcgggtcatcgaccttggatgtggccgtgggggatggtcatactattgcgcaggcctgaagaaggtgaccgaggtaagaggttacacaaaagggggacctggccacgaggaaccggtgcccatgagtacttatggctggaatattgttaagttgatgagcgggaaagatgtgttttacctgccacctgagaagtgtgacaccctcttatgcgatatcggagaatcctctcccagccctacagtcgaggagtccaggaccattcgcgtgctgaaaatggtcgaaccatggcttaagaacaatcagttctgtatcaaggtgctgaacccctacatgcctgccgttatagagcatctagaacggctccaacgaaaacacggtggcatgctggtaagaaatccattgtcaaggaactctactcatgagatgtattggattagtaatgggacgggaaacatcgtgtcgagcgtcaatatggtgtcccgcctgctccttaaccggttcacaatgacccacagacgtcccactatcgaaaaggacgttgatctgggcgctggtaccaggcacgtgaacgcggagccggagacacctaatatggacgtcattggggaacggataaaacgcatcaaggaggaacataactctacgtggcactacgacgatgagaatccatataaaacctgggcctaccatggatcatatgaagtgaaggcaactggcagcgcttccagtatgattaacggcgtagtgaagttactgacaaaaccctgggacgttgtccctatggtgacccagatggccatgactgatacaaccccatttgggcagcaacgagtgttcaaggagaaagtcgacacaagaactcccaggccgatgcctggaacccggaaggttatggagatcacggcagaatggttgtggcgcaccctcggtagaaataaaaggccccgactgtgcacacgggaggaatttactaagaaggtgcgtaccaacgccgctatgggcgccgtattcacagaggaaaatcagtgggattctgcgaaagcagccgtggaggacgaggaattttggaagctagtcgatagagagcgcgaacttcacaaactggggaagtgtggaagctgcgtgtacaacatgatgggcaaaagggagaagaaactcggtgagttcgggaaggctaagggatcacgggccatttggtatatgtggctgggctccagatacttggaatttgaggcactgggcttcctcaatgaagaccattggtttagtcgcgagaacagctactctggggttgaaggagagggtcttcacaaactgggctatatcttaagggatatatccaagatcccagggggagctatgtacgccgacgatactgctggctgggacacccgaattacggaggacgatctgcacaatgaagagaaaatcacacagcagatggaccctgaacatcggttgctcgccaacgcaattttcaagctgacctatcaaaataaagtggtcaaggtgcagagacccactccaacaggtaccgtaatggatatcatatcaaggaaggaccagcgcgggagcggacaggttggcacttacggcctaaacacctttacaaatatggaggcgcaacttgtgcgtcagatggaaggggagggagtcctgtcgaaagccgatctcgagaacccccatctgcctgaaaagaaaattacgcagtggttggagaccaagggtgtggaacggttaaaaagaatggctatctctggcgacgattgcgtggtcaagccaatcgacgataggttcgccaacgcactgctcgctcttaatgacatggggaaggttcgcaaagatattccgcagtggcaacccagtaagggatggcatgactggcaacaggtgcctttttgttcccaccacttccatgagctgataatgaaagatggccgaaagctagtagtgccatgccggccccaggacgaactgatcggtagagccaggattagccaaggggcaggatggtcactccgcgagactgcctgtttgggcaaagcgtatgctcagatgtggtccctgatgtacttccacagacgggaccttaggctggcctctaacgcaatctgcagcgccgtccctgtgcattgggttccaacaagtcgtaccacttggtccattcacgctcatcaccagtggatgacaaccgaggatatgctcacggtgtggaatcgagtctggatcgaagacaacccctggatggaggataagacacctgtgaccacttgggaaaatgtaccgtatttaggcaagcgcgaggaccaatggtgtgggagcctgataggattgacctctagagccacatgggcacagaacatcccaactgctattcagcaggttcggtcactgatcggtaatgaggaatttctcgattacatgcccagtatgaaaaggttccgcaaggaggaagagtccgaaggcgccatttggtga

SEQ ID NO: 15141 - RNA, 9873 nt, synthetic construct
  misc_feature 1..9873: note = derived and/or modified CDS sequence (opt3) from DENV-3__FJ898462__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgcttctagggcatggaacgtgtgggaagttgaggactatggttttggggtgttcaccacgaatatttggctgaaacttcgggaagtctacacacagttgtgtgaccaccgcctcatgtcagccgctgtgaaggatgagagagccgttcacgcagacatgggatactggatcgagagtcagaaaaacggcagctggaagctggaaaaagcgtccctaatagaggtgaagacctgcacttggcctaagtctcataccctgtggtcgaatggtgtactcgaaagcgatatgatcattccaaaatccctggccggcccgatctcacagcacaaccataggcccgggtatcacacacaaactgctggaccttggcaccttggcaagttggagctggactttaattactgcgaggggaccacagtcgtgattacggaaaactgtggaacccgtggcccaagtttacggactacaaccgtgtctggtaaactcatccatgagtggtgctgtcgaagctgcactctgccccctcttagatatatgggggaagatggatgttggtacggcatggagataaggccaatttccgaaaaggaggagaatatggtcaaatcactggttagcgccggttctggcaaggtggacaacttcacaatgggggtattgtgcctcgcaatcctgtttgaagaggtgatgcgcggaaagttcggcaaaaagcacatgatcgctggggtcttctttaccttcgtgctactgctctccggacagattacgtggcgggatatggcccatactctgatcatgattggcagtaatgcaagcgacagaatgggtatgggggttacctatcttgccttgatagctacatttaaaatccagcccttcctggcgttaggatttttcctcaggaagctgacctctcgcgaaaaccttctgctaggcgtgggcctcgccatggcaactacactgcaattgccggaggatattgaacagatggctaatgggatcgccctgggattaatggccctcaaactgattacccagtttgagacataccagctttggactgctctgatctccttgacctgttcaaacacgatgttcacactcaccgtcgcatggcgaactgccaccctgatactagcgggtgtgagtctgcttcctgtttgccaaagctcgtccatgcggaagacagactggctcccaatggctgtggccgcaatgggcgtcccccctctgcccttgtttatcttctctctgaaggatactttaaaacgtagaagctggccactcaatgagggggtaatggccgtgggactggtttcaattcttgctagttccctgttgaggaacgacgtgcctatggcaggccccctcgtcgccggtgggctgctaatcgcgtgttatgtgattaccggaacgtctgctgatctgacagtagaaaaggccgcagacatcacctgggaggaagaggccgaacagactggcgtgagccacaaccttatgataacagtcgacgatgacggcaccatgcgcattaaagatgacgagactgagaatatcctcacagttctgttgaagaccgctttactgatcgtgtccggggtgtttccatactcaattccggccacgctcctggtctggcatacttggcagaaacagacccaacggagcggagtgctttgggatgttcctagtcccccagaaacacagaaggcagagctggaagagggtgtatacagaataaaacagcagggcatcttcgggaagacccaagtgggagtcggcgtgcagaaggagggtgtttttcacacaatgtggcacgtgactaggggggctgtcttgacctataacggaaaacgactagaacccaattgggcctctgtgaagaaagacctgatttcctacggcggcgggtggcgcctcagcgcgcagtggcaacggggagaggaagtacaggtcatcgccgtggagcctggtaagaacccaaaaaatttccagacgatgcccggcacattccagactaccacaggggaaattggagcaatcgctctggattttaagcctggcacctcgggttcaccgataatcaacagagaggggaaggttgtgggactttatggcaatggcgtcgtgactaaaaacgggggatacgtttctggtattgcccaaaccaatgctgagccagacggccccacacctgaattagaggaagagatgttcaagaaaaggaacctgacgatcatggatctccatccagggagtggaaagactcgtaaatatttgcccgcaattgtgcgcgaagccatcaagcggagactgaggaccctcatactggcccctacacgagtcgtggctgcggagatggaggaagcacttaagggcctgccgattcggtaccagaccactgccacaaaatccgagcacaccggtcgcgaaatcgtagacttgatgtgccatgctacgtttactatgagactactgagccccgtgagggttccaaattataacctcatcattatggatgaggcccacttcacagaccctgcatctatcgccgctcgggggtacataagcacccgagtcggaatgggcgaagcggccgcaatttttatgaccgctactcccccaggcacagccgatgcattccctcagtccaatgcccccatccaggacgaggagagagacattccagaacgctcatggaacagtgggaatgagtggatcaccgattttgctggaaagacagtgtggttcgtgccgagcataaaagccggtaacgacattgcgaactgtttaaggaagaatggcaaaaaggtcatccaactgtctcgtaagacttttgatacggaataccagaaaaccaagcttaacgactgggatttcgtagtgacaactgacatctccgagatgggggcaaattttaaagccgatcgggttattgaccctagaaggtgcctgaagcccgtgatcctcaccgatggaccagagcgcgtcattttggctggccccatgcctgtgacagccgcttcagcagcccagcgaagaggtcgggttgggaggaacccacagaaagaaaatgaccaatatatattcaccggccagcccctgaacaatgatgaggaccatgctcactggactgaagccaagatgctcctggacaacatcaatacgcctgagggaattatcccggcacttttcgaaccagagcgcgagaagagtgcggccatcgatggcgaataccgtctaaaaggggagagcagaaagacctttgtggaactgatgcggaggggagacttgcccgtctggttagctcacaaagtggcctccgagggtattaagtatacagatcgcaaatggtgcttcgacggccagcgaaacaatcagatactggaagagaacatggatgtagagatctggactaaggaaggggagaaaaagaagctcagacctcggtggctggacgcaaggacctactctgatccccttgctctgaaagaatttaaggacttcgccgcaggacgcaaatcgattgccctcgatttggtgacagagatcggcagagttccaagccatctggctcacaggacccggaatgcgctagacaacctggtcatgctccatacttcagaacacggtgggcgtgcctatcgccacgcagtggaggagcttcctgaaacaatggagacgctgttattgctgggcctcatgattctgcttaccggaggcgctatgctgtttctcatctccgggaagggaataggtaaaactagtatcggcttgatttgtgtgatcgcctctagcgggatgctgtggatggccgaaattcccttacaatggatcgcatccgctatagtcctagagttctttatgatggttctgctcattccagagcctgaaaagcagcgaacaccgcaggataatcaacttgcctacgtggtaatcggaattctgaccttggcggctatcatagccgcaaacgagatgggcctgctcgaaaccacaaagagagacctgggtatgtcaaaagagcccggggtggtctctccaactagctatcttgatgtggacctccatcctgccagtgcttggacgctgtacgcagttgccaccacagtgatcactcccatgttgaggcacaccattgaaaattccacagcgaacgtcagcctggctgccatcgcaaaccaggccgtagtgttaatgggcctagacaagggatggccaatttctaaaatggatctgggcgttcctctccttgctctggggtgctactcacaggtgaatcccttgaccctgactgccgcagtcctcctgcttatcacgcattatgctataattggaccgggcttacaggccaaggcgacacgggaggcccaaaaacgcaccgcagctggtatcatgaagaacccaactgtggacgggatcatgaccattgatctggaccctgtcatctacgattccaagttcgagaaacagctcggacaggtgatgttgctggttctatgtgccgtgcagctgctccttatgagaacaagttgggcactgtgcgaagctttgactctggccaccggccccataacaacgctctgggagggtagcccaggcaagttttggaataccactattgccgtatcgatggcgaacatcttcagggggtcttatctggctggagcaggcttagccttttccattatgaaaagcgtggggacaggaaagcggggcaccggttcacaaggggaaactcttggagagaaatggaagaagaaactgaatcagctcagtcgaaaggaattcgacctatacaaaaagtctggcatcacagaggtcgatagaaccgaggctaaagaaggtctgaagcgcggcgagacgacccaccatgccgtttccagggggagcgcaaaattgcagtggtttgtggaacggaacatggtcatacccgagggacgtgtgatcgacctgggctgtgggagaggaggctggtcatattactgcgccggtctcaagaaggtaacagaagtgagggggtatactaaaggaggccctggccacgaggagccggttcccatgagtacctacgggtggaatattgtgaagcttatgagcggaaaagatgtcttctacctgccacctgaaaagtgtgacacattgctgtgcgatatcggtgagtcctctcccagccctattgtggaagagtcccgcactatccgggtcctcaaaatggtggagccatggttaaagaacaatcagttctgtattaaggttctgaacccctatatgcctaccgtaatcgaacaccttgagcgactgcaaagaaaacatggcgggatgctagtgaggaatccactctcacgcaactctacacacgaaatgtactggataagtaatggaaccggcaacattgtcgcttcggtgaatatggttagccggctgttgctgaacagatttactatgacgcatcgtaggcccacaatcgagaaggacgtggatctcggtgcggggacccggcacgtcaacgccgaaccggagactcctaatatggacgtgatcggagagcgcattaaacgaataaaggaagagcacaactccacctggcattatgacgatgaaaatccatacaaaacatgggcatatcacggctcttacgaggtaaaggctacgggctcagccagctccatgatcaacggggtggttaagcttctgaccaaaccctgggacgtcgtgcctatggtgactcagatggcaatgacagataccactccattcggacagcaaagagtctttaaggaaaaagttgacacaaggaccccccggagtatgccgggtacacgcagagtgatgggcattactgccgagtggttatggaggaccctggggcgaaataagaaacctcggttgtgcacgcgtgaggaattcaccaagaaggtaagaacaaacgctgccatgggagcggtgtttactgaggaaaatcagtgggattctgcaaaagccgctgtcgaggacgaagatttctggaagctcgtggaccgcgagagggagctgcataaactaggcaagtgtggtagctgcgtttataacatgatggggaaacgggaaaagaaacttggagagtttggcaaggccaagggctcaagagcaatctggtacatgtggctgggggctcgctacctcgaattcgaggccctgggatttttgaatgaggatcactggttctccagggaaaacagttatagcggtgtggagggcgaagggctgcataaactcggatacattcttcgagacatctctaagatacccggcggtgctatgtatgccgatgacaccgcagggtgggacacacggatcactgaggatgacctgcacaatgaagagaaaattacccagcagatggatccagagcacagacaattagcgaacgccatctttaagctgacgtaccagaataaagtcgtgaaggtacagaggcctacacccaccggaactgttatggacattatctcccgcaaggatcagcgtggctcaggccaagtggggacatatggattgaacaccttcactaatatggaagctcagctcatacggcagatggagggtgaaggcgtcctgagcaaagccgacctagagaacccacatcttcccgaaaagaaaattacccagtggctggagacaaagggggtggagagactcaaaaggatggcaatctcgggagatgactgcgtggtcaagcctatcgatgaccgctttgctaacgccctgttggcattaaatgatatgggcaaggttcgaaaagacattccacaatggcagccgtctaagggttggcacgattggcagcaggtgcccttctgtagtcatcacttccacgaactgataatgaaagacgggcggaagctcgtagtgccttgcagaccacaagacgagcttatcggaagggcccgcatttcccagggcgcgggctggagcctgagagaaacggcttgtctagggaaagcctacgcacagatgtggtcactgatgtattttcatcggagggatctccgtttggcctccaacgctatctgctctgccgtccccgtgcactgggttcctaccagccgaactacatggagtattcatgcacaccatcaatggatgaccactgaggacatgctgacagtgtggaatcgcgtctggatcgaagataacccatggatggaggacaagacccccgtgacgacatgggagaatgtaccttaccttggaaagagagaagatcagtggtgtggttccctgataggcctcaccagccgggctacttgggcccagaacatcccgaccgcgattcagcaagttaggtctttaatcgggaatgaggaattcctggactacatgccatcaatgaaacgctttagaaaggaggaggaaagtgagggagctatttggtga

SEQ ID NO: 15142 - RNA, 9873 nt, synthetic construct
  misc_feature 1..9873: note = derived and/or modified CDS sequence (opt3) from DENV-3__KF955473__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccatccttaggaaactgtgtattgagggaaagatcacaaacataaccacggatagccggtgccctacccagggcgaagctgtcttgccagaggaacaggaccagaattatgtttgtaaacacacatacgtggatcgcggttgggggaacggatgcggcctcttcggcaaggggagtctggtaacttgcgccaagtttcaatgtttagagcccattgagggaaaagtggtccagtatgaaaatctgaagtacaccgtgatcattacagttcatactggtgaccagcaccaggtgggcaacgagacccaaggggtcacagcagaaatcacccctcaggcttccactacggaggccatcctcccagaatatggaacacttggcctggagtgctctccgcgaaccggtttggacttcaatgagatgattctactgactatgaaaaacaaggcgtggatggtgcatagacagtggtttttcgatctccccctgccttggaccagcggggccacaaccgaaactccaacatggaataggaaagagcttctggtaacgtttaagaacgcacacgctaaaaagcaagaagttgtggtcttgggctcccaggagggagccatgcacaccgctctcactggcgccacagaaatacagaattcagggggaaccagtatcttcgcaggtcatctgaagtgtcggttaaaaatggacaagctggagctaaaaggcatgagctacgccatgtgcacaaacacttttgtgctcaagaaagaggtctctgaaacccagcacgggacgattctgatcaaggtggagtacaagggagaagatgctccctgtaaaatacctttctccaccgaggacggccaaggtaaggcgcataacgggcgtcttattacagcaaatccagttgtgactaaaaaggaggaacccgtaaacatcgaggccgaaccgcctttcggcgagtcaaatatcgtcattggaatcggcgataacgctttgaaaattaattggtataagaaggggagcagtataggaaaaatgtttgaagccaccgcacgcggtgccagaaggatggctatcctgggcgacacagcctgggatttcgggtctgtgggaggcgttctcaactccctgggtaagatggtgcaccagatttttgggagcgcatacactgcgcttttctcgggcgtctcttgggtgatgaaaatcggaatcggcgtactgttgacctggattgggctcaattccaagaacacgtcaatgagttttagctgcatagctatcggaattatcacactgtatttaggcgccgtggttcaggcagacatgggttgtgtcattaattggaaagggaaggagctgaagtgcggatccggcatcttcgtgaccaacgaggtgcatacttggacagaacagtacaaatttcaagccgattctcccaagcggctagctaccgccatagcaggtgcttgggagaatggcgtctgtgggatccgaagcactacccgcatggaaaacctcctgtggaaacagattgccaatgagcttaactatatcttgtgggaaaataacattaagctgacagttgtggtgggagacatcataggcgtactcgagcaggggaaaagaacgctgaccccacagcctatggagttaaagtactcatggaaaacttggggaaaggcgaagattgtcacagccgaaacccaaaacagttccttcatcattgatggccccaatacaccagagtgccccagcgcttctagggcatggaacgtgtgggaagttgaggactatggttttggggtgttcactaccaatatctggctgaaacttcgggaagtctacacgcagttgtgtgaccaccgcctcatgtcagccgctgtgaaggatgagagagccgttcacgcagacatgggatactggatagagagtcagaaaaacggcagctggaagctggaaaaagcgtccctaatcgaggtgaagacatgcacctggcctaagtctcatactctgtggtcgaatggtgtactcgaaagcgatatgattatcccaaaatccctggccggcccgatttcacagcacaaccataggcccgggtatcacacccaaacagctggaccttggcaccttggcaagttggagctggactttaattactgcgaggggactaccgtcgtgatcacagaaaactgtggaacgcgtggcccaagtttacggaccactacagtgtctggtaaactcatacatgagtggtgctgtcgaagctgcaccctgccccctcttagatatatgggggaagatggatgttggtacggcatggagattaggccaatctccgaaaaggaggagaatatggtcaaatcactggttagcgccggttctggcaaggtggacaacttcactatgggggtattgtgcctcgcaatcctgtttgaagaggtgatgcgcggaaagttcggcaaaaagcacatgattgctggggtcttctttacattcgtgctactgctctccggacagatcacctggcgggatatggcccatacgctgattatgataggcagtaatgcaagcgacagaatgggtatgggggttacttatcttgccttgatcgctacctttaaaattcagcccttcctggcgttaggatttttcctcaggaagctgacatctcgcgaaaaccttctgctaggcgtgggcctcgccatggcaaccactctgcaattgccggaggatatcgaacagatggctaatgggattgccctgggattaatggccctcaaactgatcacacagtttgagacctaccagctttggacagctctgatatccttgacttgttcaaacaccatgttcacgctcacagtcgcatggcgaaccgccactctgatcctagcgggtgtgagtctgcttcctgtttgccaaagctcgtccatgcggaagaccgactggctcccaatggctgtggccgcaatgggcgtcccccctctgcccttgtttattttctctctgaaggatacattaaaacgtagaagctggccactcaatgagggggtaatggccgtgggactggtttcaatccttgctagttccctgttgaggaacgacgtgcctatggcaggccccctcgtcgccggtgggctgctaattgcgtgttatgtgatcactggaacctctgctgatctgacggtagaaaaggccgcagacataacatgggaggaagaggccgaacagaccggcgtgagccacaaccttatgattactgtcgacgatgacggcacaatgcgcatcaaagatgacgagaccgagaatatcctcactgttctgttgaagacagctttactgattgtgtccggggtgtttccatactcaataccggccaccctcctggtctggcatacgtggcagaaacagactcaacggagcggagtgctttgggatgttcctagtcccccagaaacccagaaggcagagctggaagagggtgtatacagaatcaaacagcagggcattttcgggaagacacaagtgggagtcggcgtgcagaaggagggtgtttttcacaccatgtggcacgtgacaaggggggctgtcttgacttataacggaaaacgactagaacccaattgggcctctgtgaagaaagacctgatctcctacggcggcgggtggcgcctcagcgcgcagtggcaaaagggagaggaagtacaggtcattgccgtggagcctggtaaaaacccaaagaatttccagaccatgcccggcacgttccagacaactaccggggaaatcggagcaatagctctggattttaagcctggcacatcgggttcaccgatcattaaccgggaggggaaagttgtgggactttatggcaatggcgtcgtgaccaagaacgggggatacgtttctggtatcgcccaaactaatgctgagccagacggccccacccctgaattagaggaagagatgttcaaaaagagaaacctgacaattatggatctccatccagggagtggaaaaacgaggaagtatttgcccgcaatcgtgcgtgaagccataaagcgccggctgagaactctcattctggcccctaccagggtcgtggctgcggagatggaggaagcacttaaaggcctgccgatccgataccagacaaccgccactaagtccgagcacacaggtcgggaaatcgtagacttgatgtgccatgctacctttacgatgcgcctactgagccccgtgagagttccaaattataacctcattatcatggatgaggcccacttcactgaccctgcatctatagccgctagggggtacattagcacacgggtcggaatgggcgaagcggccgcaatctttatgaccgctacccccccaggcactgccgatgcattccctcagtccaatgcccccattcaggacgaggagcgagacatcccagaaagatcatggaacagtgggaatgagtggataacagattttgctggaaaaaccgtgtggttcgtgccgagcattaaggccggtaacgacatcgcgaactgtttacgcaaaaatggcaagaaggtcatccaactgtctaggaaaacatttgatactgaataccagaagacgaaacttaacgactgggatttcgtagtgaccacagacatttccgagatgggggcaaattttaaggccgatcgtgttatcgaccctcggagatgcctgaaacccgtgattctcactgatggaccagagagggtcatattggctggccccatgcctgtgaccgccgcttcagcagcccagcgccgaggtagagttgggcggaacccacagaaggaaaatgaccaatatatcttcacaggccagcccctgaacaatgatgaggaccatgctcactggaccgaagccaagatgctcctggacaacattaatactcctgagggaatcatcccggcacttttcgaaccagagagggagaaaagtgcggccattgatggcgaataccgcctaaagggggagagccgtaaaacgtttgtggaactgatgagacggggagacttgcccgtctggttagctcacaaggtggcctccgagggtataaaatataccgataggaagtggtgcttcgacggccagcgcaacaatcagatcctggaagagaacatggatgtagagatttggacaaaagaaggggagaagaagaaactccgacctagatggctggacgcacggacttactctgatccccttgctctgaaggaatttaaagacttcgccgcaggaaggaagtcgatcgccctcgatttggtgaccgagattggccgcgttccaagccatctggctcacagaacaaggaatgcgctagacaacctggtcatgctccatacctcagaacacggtgggcgggcctatcgtcacgcagtggaggagcttcctgaaactatggagacactgttattgctgggcctcatgatcctgcttacgggaggcgctatgctgtttctcatatccgggaaaggaatcggtaagaccagtattggcttgatctgtgtgattgcctctagcgggatgctgtggatggccgaaatccccttacaatggatagcatccgctattgtcctagagttctttatgatggttctgctcatcccagagcctgaaaagcagcgcactccgcaggataatcaacttgcctacgtggtaattggaatcctgacattggcggctataatcgccgcaaacgagatgggcctgctcgaaaccaccaaacgagacctgggtatgtcaaaggagcccggggtggtctctccaacaagctatcttgatgtggacctccatcctgccagtgcttggactctgtacgcagttgccacgaccgtgattacacccatgttgagacacactatcgaaaattccaccgcgaacgtcagcctggctgccattgcaaaccaggccgtagtgttaatgggcctagacaaaggatggccaatctctaagatggatctgggcgttcctctccttgctctggggtgctactcacaggtgaatcccttgacactgaccgccgcagtcctcctgcttataactcattatgctattatcggaccgggcttacaggccaaagcgacgagggaggcccaaaagcggacagcagctggtatcatgaagaacccaaccgtggacgggattatgactatcgatctggaccctgtcatatacgattccaaattcgagaagcagctcggacaggtgatgttgctggttctatgtgccgtgcagctgctccttatgcgcaccagttgggcactgtgcgaagctttgacactggccactggccccattaccacactctgggagggtagcccaggcaaattttggaatacgaccatcgccgtatcgatggcgaacattttcagagggtcttatctggctggagcaggcttagccttttccatcatgaagagcgtggggactggaaaaaggggcacaggttcacaaggggaaacccttggagagaagtggaagaaaaagctgaatcagctcagtcggaaagaattcgacctatacaagaaatctggcataactgaggtcgatcgaacagaggctaaggaaggtctgaaaagaggcgagaccacgcaccatgccgtttcccgcgggagcgcaaagttgcagtggtttgtggaaaggaacatggtcatccccgagggacgggtgattgacctgggctgtgggcgtggaggctggtcatattactgcgccggtctcaagaaagtaaccgaagtgagagggtatacaaagggaggccctggccacgaggagccggttcccatgagtacttacgggtggaatatcgtgaaacttatgagcggaaaggatgtcttctacctgccacctgaaaaatgtgacaccttgctgtgcgatattggtgagtcctctcccagccctacagtggaagagtccaggactatccgcgtcctcaagatggtggagccatggttaaagaacaatcagttctgtattaaagttctgaacccctatatgcctaccgtaatcgaacaccttgagcggctgcaacgaaagcatggcgggatgctagtgagaaatccactctcaaggaactctacacacgaaatgtactggataagtaatggaaccggcaacattgtcgcttcggtgaatatggttagccgcctgttgctgaaccggtttactatgacgcatagacgtcccacaatcgagaaagacgtggatctcggtgcggggaccaggcacgtcaacgccgaaccggagactcctaatatggacgtgatcggagagcggattaagcgcataaaagaagagcacaactccacctggcattatgacgatgaaaatccatacaagacatgggcatatcacggctcttacgaggtaaaggctacgggctcagccagctccatgatcaacggggtggttaaacttctgaccaagccctgggacgtcgtgcctatggtgactcagatggcaatgacagataccactccattcggacagcaacgagtctttaaagaaaaggttgacacaagaacccccaggagtatgccgggtacacggcgcgtgatgggcattactgccgagtggttatggagaaccctggggaggaataaaaagcctcgattgtgcacgcgggaggaattcaccaagaaagtacgtacaaacgctgccatgggagcggtgtttactgaggaaaatcagtgggattctgcaaaggccgctgtcgaggacgaagatttctggaaactcgtggacagagagcgcgagctgcataagctaggcaaatgtggtagctgcgtttataacatgatggggaagagggaaaaaaagcttggagagtttggcaaggccaaaggctcacgggcaatctggtacatgtggctgggggctagatacctcgaattcgaggccctgggatttttgaatgaggatcactggttctcccgcgaaaacagttatagcggtgtggagggcgaagggctgcataagctcggatacattcttagggacatctctaaaatacccggcggtgctatgtatgccgatgacaccgcagggtgggacacacgaatcactgaggatgacctgcacaatgaagagaagattacccagcagatggatccagagcaccggcaattagcgaacgccatctttaaactgacgtaccagaataaggtcgtgaaggtacagagacctacacccaccggaactgttatggacattatctccaggaaagatcagcgcggctcaggccaagtggggacatatggattgaacaccttcactaatatggaagctcagctcatacgtcagatggagggtgaaggcgtcctgagcaaggccgacctagagaacccacatcttcccgaaaaaaagattacccagtggctggagacaaaaggggtggagcggctcaagagaatggcaatctcgggagatgactgcgtggtcaagcctatcgatgacaggtttgctaacgccctgttggcattaaatgatatgggcaaagttcgcaaggacattccacaatggcagccgtctaaaggttggcacgattggcagcaggtgcccttctgtagtcatcacttccacgaactgataatgaaggacgggcgaaaactcgtagtgccttgccggccacaagacgagcttatcggaagagccaggatttcccagggcgcgggctggagcctgcgcgaaacggcttgtctagggaaggcctacgcacagatgtggtcactgatgtattttcatagacgggatctcaggttggcctccaacgctatctgctctgccgtccccgtgcactgggttcctaccagccgtactacatggagtattcatgcacaccatcaatggatgaccactgaggacatgctgacagtgtggaatcgagtctggatcgaagataacccatggatggaggacaagacccccgtgacgacatgggagaatgtaccttaccttggaaaacgcgaagatcagtggtgtggttccctgataggcctcaccagcagagctacttgggcccagaacatcccgaccgcgattcagcaagttcggtctttaatcgggaatgaggaattcctggactacatgccatcaatgaagaggtttcgcaaagaggaggaaagtgagggagctatttggtga

SEQ ID NO: 15143 - RNA, 9873 nt, synthetic construct
  misc_feature 1..9873: note = derived and/or modified CDS sequence (opt3) from DENV-3__FJ850079__SS-prME
  source 1..9873: mol_type = other RNA
accagcctgtgcctcatgatgatccttcccgccgctctggcattccacttgacctccagagacggcgaacctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacgtggaggcagaaccgcctttcggcgagtcaaatattgttatcggaatcggcgataacgccttgaaaattaattggtataagaaggggagcagtatcggaaaaatgtttgaagctacagcccgcggtgcaagaaggatggccattctgggcgacactgcttgggatttcgggtctgtgggaggcgtcctcaactccctgggtaagatggtgcaccagatatttgggagcgcctacaccgcacttttctcgggcgtatcttgggtgatgaaaatcggaattggcgttctgttgacgtggatcgggctcaattccaagaacacatcaatgagttttagctgcatcgcgattggaataatcaccctgtatttaggcgctgtcgtgcaggccgacatgggttgtgtgattaattggaaagggaaggagctgaagtgcggatccggcatcttcgtcactaacgaggttcatacatggaccgaacagtacaaatttcaagcagattctcccaagcggctagccactgctattgccggtgcatgggagaatggcgtgtgtgggatccgaagcaccacacgcatggaaaacctcctgtggaaacagatagctaatgagcttaactatatcttgtgggaaaataacattaagctgacggtggtagtcggagacatcaccggcgtgctcgagcaggggaaaagaactctgacaccacagcctatggagttaaagtactcatggaaaacctggggaaaggccaagattgttacagcggaaactcaaaacagttccttcatcatagatggccccaataccccagagtgccccagcgcctctagggcttggaacgtgtgggaagtcgaggactatggttttggggtgttcacgacaaatatttggctgaaacttcgggaagtttacacccagttgtgtgaccaccgcctcatgtcagcagccgtgaaggatgagagagctgtacacgccgacatgggatactggatcgagagtcagaaaaacggcagctggaagctggaaaaagcatccctaattgaggtcaagacttgcacctggcctaagtctcatacactgtggtcgaatggtgtgctcgaaagcgatatgatcataccaaaatccctggcgggcccgatctcacagcacaactataggcccgggtaccatactcaaaccgccggaccttggcaccttggcaagttggagctggactttaattattgcgaggggacaacggtggtcattaccgaaaactgtggaactcgtggcccaagtttacggacaaccactgtttctggtaaactcatccacgagtggtgctgtcgaagctgcacactgccccctcttagatacatgggggaagatggatgttggtatggcatggagattaggccaatctccgaaaaggaggagaatatggtgaaatcactggtaagcgctggttctggcgaagtggacaacttcaccatgggggtcttgtgcctcgccatactgtttgaggaagtgatgcgcggaaagttcggcaagaaacatatgattgcaggggttttctttacgttcgtgctactgctctccggacagatcacttggcgggatatggctcacaccctgatcatgattggcagtaatgccagcgacagaatgggtatgggggtcacataccttgcattgatcgccacctttaagattcagcccttcctggctttaggatttttcctcaggaaactgacttctcgcgagaaccttctgctaggcgtgggcctcgcgatggccacaaccctgcaattgccggaagatatagagcagatggcaaatgggatcgctctgggattaatggccctcaagctgattacacagtttgagacttatcagctttggaccgccctgatctccttgacgtgttcaaacacaattttcaccctcactgttgcttggcgaaccgcaacactgatcctagccggtgtgagtctgcttcctgtctgccaaagctcgtccatgcggaaaactgactggctcccaatgaccgtagcggctatgggcgtgccccctctgcccttgtttatattctctctgaaggatacgttaaagcgtagaagctggccactcaatgaaggggttatggccgtgggactggtctcaatccttgcaagttccctgttgaggaacgacgtgcctatggccggccccctcgtagctggtgggctgctaattgcatgttacgtgatcacaggaacctctgccgatctgactgtcgagaaagcggctgacgttacatgggaagaggaagccgagcagaccggcgtgagccataaccttatgattactgtggacgatgacggcacaatgcgcatcaaggatgacgagaccgaaaatatactcacggtcctgttgaaaactgcattactgattgtgtccgggatctttccatactcaatcccggccaccctcctggtttggcacacatggcagaagcagacccaacggagcggagtactttgggatgtgcctagtcccccagagacacagaaagctgaactggaggagggtgtctatagaattaagcagcagggcatattcgggaaaactcaagtgggagttggcgtgcagaaggaaggtgtctttcataccatgtggcacgtgacgagaggggccgtattgacatacaacggaaagcgactagagcccaattgggcatctgtcaaaaaggacctgatctcctatggcggcgggtggcgcctcagcgctcagtggcaaaaaggagaagaggtgcaggttattgccgtggaacctggtaagaaccccaagaatttccagactatgcccggcaccttccagacaaccactggggagatcggagcgattgccctggattttaagcctggcacctcgggttcaccgatcataaaccgggaggggaaggtcgtgggactttacggcaatggcgttgtgaccaagaacgggggatatgtctctggtatcgcacaaacgaatgctgaaccagacggccccactcctgagttagaagaggaaatgttcaagaaaagaaacctgaccattatggatctccacccagggagtggaaagacaaggaaatacttgcccgccatcgtgcgtgaggctattaagcgccggctgagaaccctcatcctggcacctactagggtagtggccgccgagatggaagaggctcttaagggcctgccgatacgatatcagacaaccgcgacgaaatccgaacatactggtcgggagattgttgacttgatgtgccacgcaacatttaccatgcgcctactgagccccgtcagagtgccaaattacaacctcatcatcatggatgaagcccatttcaccgaccctgcttctattgccgcaagggggtacatcagcactcgggtgggaatgggcgaggccgctgcgatatttatgacagccacaccaccaggcacagcagatgctttccctcagtccaatgcccccattcaggacgaggaacgagacatcccagagagatcatggaacagtgggaatgaatggattactgattttgcaggaaagacggtctggttcgtaccgagcatcaaagccggtaacgacatagctaactgtttacgcaagaatggcaaaaaggtgattcaactgtctaggaagacctttgatacagagtatcagaaaactaaacttaacgactgggatttcgttgtgaccacagacatctccgagatgggggccaattttaaagcggatcgtgtcatcgaccctcggagatgcctgaagcccgtgattctcaccgatggaccagaaagggttatcttggcaggccccatgcctgtgactgccgcttcagccgctcagcgccgaggtagagtcgggcggaacccacagaaagagaatgaccaatacattttcacgggccagcccctgaacaatgatgaagaccacgcacattggaccgaggccaagatgctcctggacaacataaatacacctgaaggaatcattccggctcttttcgagccagagagggaaaagagtgccgcaatcgatggcgagtatcgcctaaaaggggaaagccgtaagacttttgtggagctgatgagacggggagacttgcccgtatggttagcgcacaaagtggcctccgaaggtatcaagtacaccgataggaaatggtgcttcgacggccagcgcaacaatcagattctggaggagaacatggatgttgaaatatggacaaaggagggggagaaaaagaagctccgacctagatggctggacgctcggacctattctgatccccttgccctgaaagagtttaaggacttcgcagctggaaggaaatcgatcgccctcgatttggtcactgaaattggccgcgtgccaacacacctggcacatagaacgaggaatgccctagacaacctggtgatgctccacaccagcgagcatggtgggaaggcttaccggcacgcggtcgaggaacttcctgagactatggaaacactgttattgctgggcctcatgatcctgcttaccggaggcgccatgctgtttctcatttcagggaaaggaatcggtaagacctccataggcttgatctgtgttattgcaagttctgggatgctgtggatggctgagatccccttacaatggattgccagcgccatcgtgctagagttctttatgatggtactgctcataccagaacctgagaagcagcgtacaccgcaggataatcaacttgcatatgtggtcattggaatcctgactttggctgccattatcgcggctaacgaaatgggcctgctcgagacgaccaaacgcgacctgggtatgtccaaggaacccggggtggtttcaccaacatcttaccttgatgtggacctccaccctgccagcgcatggactctgtacgccgtcgctaccacagtaataacccccatgttgcgacatactatcgagaatagtacggcaaacgtgtccctggccgcgattgctaaccaggccgttgtgttaatgggcctagacaaaggatggccaatcagcaagatggatctgggcgtccctctccttgcactggggtgctattctcaggtgaatcccttgacactgaccgccgctgtcctcctgcttattactcactacgccatcataggaccgggcttacaggcaaaagctaccagagaggcccaaaagaggacagcggccggtattatgaagaacccaactgtggacgggatcatgaccatcgatctggaccctgttatttatgattcaaaattcgaaaagcagctcggacaggtgatgttgctggtactatgtgcagtgcagctgctccttatgcggacatcctgggctctgtgcgaggccttgacgctggcaaccggccccatcactacactctgggaaggtagtccaggcaaattttggaataccactatagctgtcagcatggccaacattttccgcgggtcgtacctggccggagcgggcttagctttttctatcatgaagtccgttgggacaggaaaaagaggcaccggtagccaaggggagacgcttggagaaaagtggaagaaaaagctgaatcagctctcaaggaaagagttcgacctatataagaaaagtggcattaccgaggtggatcggacagaagcaaaggagggtctgaaacgaggcgaaatcactcatcacgccgtctctagagggtccgctaagttgcagtggtttgtggagcgcaacatggtaatacccgaaggaagggtgatcgacctgggctgtgggcggggaggctggagctactattgcgccggtctcaagaaagttaccgaggtgcgtgggtacacaaagggaggccctggccatgaggaaccggtccccatgtcaacttacgggtggaatattgtgaaacttatgagtggaaaggatgtcttctatctgccacctgagaaatgtgacaccttgctgtgcgatatcggtgaaagctccccctctcctacagtggaggagagcagaaccattagggttctcaagatggtagaaccatggttaaagaacaatcagttctgtatcaaagtgctgaacccctacatgcctactgtcattgagcaccttgaacgcctgcaacggaagcacggcgggatgctagtgcgaaatccactctccagaaactcaacgcatgagatgtattggatctctaatggaacaggcaacatagttgcaagtgtgaatatggtctcgaggctgttgctgaaccgctttaccatgactcaccggagacccaccattgaaaaagacgtggatctcggtgccgggacacgtcatgtaaacgctgagccggagacgcctaatatggacgtgatcggagaaaggatcaagcggattaaagaggaacacgacagcacctggcactacgatgacgagaacccatataagacttgggcgtaccatggctcctatgaagttaaggccacaggctctgcatcaagcatgataaatggggtcgtgaaacttctgaccaagccctgggatgtggtccctatggttactcagatggctatgacagacaccacaccattcggacagcaacgcgtgtttaaagagaaggtagatactcgaacccccagatccatgccgggtacgaggcgggtgatgggcatcaccgccgagtggttatggcgcacactggggagaaacaaaaagcctaggttgtgcactcgagaagagttcaccaagaaagtccggacaaatgcagccatgggagctgtgtttactgaagagaaccagtgggacagtgccaaggcggcagttgaagatgaggacttctggaaactcgtggatcgtgagagagaactgcacaagctaggcaaatgtggttcttgcgtctacaatatgatggggaagcgcgagaagaaacttggagaatttggcaaagccaaaggcagcagggctatttggtacatgtggctgggggcccggtatctcgagttcgaggcactgggatttttgaacgaagaccattggttctcaagagaaaattcctacagtggtgtggagggcgaggggctgcacaagctcggatatatccttcgcgatattagcaaaatccccggcggtgctatgtacgccgacgacaccgctgggtgggatacgaggataacagaagacgatctgcataacgaggagaagatcacccagcagatggacccagaacaccgacaattagccaatgcaatttttaaactgacttatcagaacaaggtagttaaggtgcagcggcctacacccaccggaactgtcatggatatcatttctagaaaagaccagaggggctccggccaagtggggacctacggattgaatacattcacgaacatggaggcgcagctcatccgccagatggaaggtgagggcgtgctgtcaaaggccgatctagaaaatccacaccttcccgagaaaaagataacccagtggctggagactaaaggggtcgaacgtctcaagcggatggctattagcggagacgattgcgttgtgaagcctatcgacgatagatttgccaacgcactgttggctttaaacgacatgggcaaagtaaggaaggatatcccacaatggcagccgtcgaaaggttggcatgactggcaacaggtgcccttctgttctcaccatttccacgagctgattatgaaggacgggcgcaaactcgtcgtgccttgccgaccacaagatgaacttataggacgggccagaatcagtcagggcgcaggctggtccctgagggagacagcctgtctagggaaggcgtatgctcagatgtggagcctgatgtactttcaccgcagagacctccggttggcctcaaatgcaatttgctccgccgttcccgtgcattgggtccctacctctaggactacatggagcatccacgctcatcaccaatggatgaccacggaagatatgctgacagtgtggaaccgtgtatggattgaggacaatccatggatggaggataagacccccgttactacctgggaaaacgtgccttaccttggaaaacgagaggaccagtggtgtggtagtctgatcggcctcacatcccgcgccacttgggcacagaatataccgaccgctatccagcaagtcaggagcttaattgggaacgaagagttcctggattatatgccatctatgaagcggtttaggaaagaggaagagtcagaaggagccatctggtga

SEQ ID NO: 15144 - RNA, 9873 nt, synthetic construct
  misc_feature 1..9873: note = derived and/or modified CDS sequence (opt3) from DENV-3__FJ850080__SS-prME
  source 1..9873: mol_type = other RNA
accagcctgtgcctcatgatgatccttcccgccgctctggcattccacttgacatccagagacggcgagcctaggatgattgtggggaagaacgaacggggaaagtctttactgtttaagactgcctcaggtataaatatgtgtacgctaatcgcgatggatctcggcgagatgtgcgacgataccgtcacctacaagtgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggatgagcccgtaaacattgaagccgagccgcctttcggcgaatcaaatatcgtcatcggaattggcgacaacgctttgaaaatcaattggtataagaaggggagcagtattggaaaaatgtttgaggccacagcacgcggtgccagaaggatggctatactgggcgatactgcctgggacttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagatatgggttgtgtcatcaattggaaagggaaggaactgaagtgcggatccggcattttcgtgactaacgaggtgcatacatggaccgagcagtacaaatttcaagccgactctcccaagcggctagctactgccatcgccggtgcttgggaaaatggcgtctgtgggatacgaagcaccacacgcatggagaacctcctgtggaaacaggttgccaatgaacttaactatatcttgtgggagaataacattaagctgacggtggtggtaggagatatcattggcgtcctcgaacaggggaaaagaaccctgactccacagcctatggagttaaagtactcatggaaaacatggggaaaggcgaagatcgtgaccgccgagacacaaaacagttccttcataattgacggccccaatactccagaatgccccagcgcttctagggcatggaacgtttgggaggtggaagactatggttttggggtcttcaccacgaatatctggctgaaacttcgggaggtgtacacacagttgtgtgatcaccgcctcatgtcagccgctgttaaggacgaaagagccgtgcacgcagatatgggatactggattgagagtcagaaaaacggcagctggaagctggagaaagcgtccctaatcgaagtaaagacctgcacttggcctaagtctcataccctgtggtcgaatggtgtcctcgagagcgacatgataatcccaaaatccctggccggcccgatttcacagcacaaccataggcccgggtatcacacacaaactgctggaccttggcaccttggcaagttggaactggattttaattactgcgaggggaccacagtggtgatcacggagaactgtggaacccgtggcccaagtttacggactacaaccgtctctggtaaactcattcatgaatggtgctgtcgaagctgcactctgccccctcttagatatatgggggaggacggatgttggtacggcatggaaatcaggccaatatccgagaaggaagagaatatggttaaatcactggtgagcgccggttctggcaaggtagataacttcacaatgggggtgttgtgcctcgcaattctgtttgaggaagtcatgcgcggaaagttcggcaaaaagcacatgatcgctggggtgttctttatgttcgttctactgctctccggacagatcacctggcgggacatggcccatacgctgattatgatcggcagtaatgcaagcgatagaatgggtatgggggtgacttatcttgccttgattgctacctttaaaatacagcccttcctggcgttaggatttttcctcaggaagctgacatctcgcgagaaccttctgctaggcgtcggcctcgccatggcaaccactctgcaattgccggaagacatcgagcagatggctaatgggattgccctgggattaatggccctcaaactgatcacacagtttgaaacctaccagctttggacagctctgatttccttgacttgttcaaacaccatgttcacgctcacagtggcatggcgaaccgccactctgatcctagcgggtgttagtctgcttcctgtgtgccaaagctcgtccatgcggaagaccgattggctcccaatggctgtcgccgcaatgggcgtaccccctctgcccttgtttatattctctctgaaggacacattaaaacgtagaagctggccactcaatgagggggtgatggccgttggactggtgtcaatccttgctagttccctgttgaggaacgatgtccctatggcaggccccctcgtggccggtgggctgctaattgcgtgttatgtaatcactggaacctctgctgacctgacggtggagaaggccgcagacattacatgggaagaggaagccgagcagaccggcgtcagccacaaccttatgatcactgttgatgacgatggcacaatgcgcataaaagacgatgaaaccgagaatattctcactgtgctgttgaagacagctttactgatcgtgtccggggtctttccatactcaatcccggccaccctcctggtgtggcatacgtggcagaaacagactcaacggagcggagttctttgggacgtacctagtcccccagagacccagaaggcagaactggaggaaggtgtgtacagaattaaacagcagggcatattcgggaagacacaagtcggagtgggcgttcagaaggagggtgtgtttcacaccatgtggcacgtcacaagaggggctgtgttgacttataacggaaaacgactagagcccaattgggcctctgtaaagaaagatctgatctcctacggcggcgggtggcgcctcagcgcgcagtggcaaaagggagaagaggtccaggtgattgccgttgaacctggtaaaaacccaaagaatttccagaccatgcccggcacgttccagacaactaccggggagatcggagcaattgctctggactttaagcctggcacatcgggttcaccgatcataaaccgggaagggaaagtggtcggactttatggcaatggcgtggttaccaagaacgggggatacgtgtctggtatcgcccaaactaatgctgagccagatggccccacccctgagttagaagaggaaatgttcaaaaagagaaacctgacaattatggacctccatccagggagtggaaaaacgaggaagtatttgcccgcaatcgtccgtgaggccattaagcgccggctgagaactctcatcctggcccctaccagggtggtagctgcggaaatggaggaggcacttaaaggcctgccgatacgataccagacaaccgccactaagtccgaacacacaggtcgggagattgtggatttgatgtgccatgctacctttacgatgcgcctactgagccccgttagagtcccaaattataacctcatcatcatggacgaagcccacttcactgatcctgcatctattgccgctagggggtacatcagcacacgggtgggaatgggcgaggcggccgcaatatttatgaccgctacacccccaggcactgccgacgcattccctcagtccaatgcccccattcaggacgaggaacgagatatcccagagagatcatggaacagtgggaatgaatggattacagactttgctggaaaaaccgtgtggttcgtcccgagcatcaaggccggtaacgatatagcgaactgtttacgcaaaaatggcaagaaggtaattcaactgtctaggaaaacatttgacactgagtaccagaagacgaaacttaacgattgggacttcgtggttaccacagatatctccgaaatgggggcaaattttaaggccgaccgtgtgatcgatcctcggagatgcctgaaacccgtcattctcactgacggaccagagagggtgatcttggctggccccatgcctgttaccgccgcttcagcagcccagcgccgaggtagagtggggcggaacccacagaaggagaatgatcaatatattttcacaggccagcccctgaacaatgacgaagaccatgctcactggaccgaggccaagatgctcctggataacataaatactcctgaaggaatcattccggcacttttcgagccagaaagggagaaaagtgcggccatcgacggcgagtaccgcctaaagggggaaagccgtaaaacgtttgtcgagctgatgagacggggagatttgcccgtgtggttagctcacaaggtagcctccgaaggtatcaaatataccgacaggaagtggtgcttcgatggccagcgcaacaatcagattctggaggaaaacatggacgtggagatatggacaaaagagggggaaaagaagaaactccgacctagatggctggatgcacggacttactctgacccccttgctctgaaggagtttaaagatttcgccgcaggaaggaagtcgatcgccctcgacttggttaccgaaattggccgcgtcccaagccatctggctcacagaacaaggaatgcgctagataacctggtgatgctccatacctcagagcacggtgggcgggcctatcgtcacgcagtggaggaacttcctgagactatggaaacactgttattgctgggcctcatgatcctgcttacgggaggcgctatgctgtttctcatttccgggaaaggaatcggtaagaccagtataggcttgatctgtgtcattgcctctagcgggatgctgtggatggccgagatccccttacaatggattgcatccgctatcgttctagagttctttatgatggtgctgctcataccagagcctgagaagcagcgcactccgcaggacaatcaacttgcctacgtagtgattggaatcctgacattggcggctattatcgccgcaaacgaaatgggcctgctcgagaccaccaaacgagatctgggtatgtcaaaggaacccggggtcgtgtctccaacaagctatcttgacgttgacctccatcctgccagtgcttggactctgtacgcagtggccacgaccgtcataacacccatgttgagacacactatcgaaaattccaccgcgaacgtaagcctggctgccattgcaaaccaggccgtggttttaatgggcctagataaaggatggccaatctctaagatggacctgggcgtgcctctccttgctctggggtgctactcacaggtcaatcccttgacactgaccgccgcagtgctcctgcttattactcattatgctatcataggaccgggcttacaggccaaagcgacgagggaagcccaaaagcggacagcagctggtattatgaagaacccaaccgtcgatgggatcatgactatcgacctggatcctgtgatttacgactccaaattcgagaagcagctcggacaggttatgttgctggtgctatgtgccgtacagctgctccttatgcgcaccagttgggcactgtgcgaggctttgacactggccactggccccatcaccacactctgggaaggtagcccaggcaaattttggaatacgaccatagccgtgtcgatggcgaacattttcagagggtcttatctggctggagcaggcttagccttttccatcatgaaaagcgtcgggactggaaaaaggggcacaggttcacaaggggagacccttggagaaaagtggaagaaaaagctgaatcagctcagtcggaaagagttcgatctatacaagaaatctggcattactgaagttgaccgaacagaggctaaggagggtctgaaaagaggcgaaaccacgcaccatgccgtgtcccgcgggagcgcaaagttgcagtggtttgtcgagaggaacatggtgatccccgaaggacgggtaatagatctgggctgtgggcgtggaggctggtcatattactgcgccggtctcaagaaagtgaccgaggttagagggtatacaaagggaggccctggccacgaggaaccggtgcccatgagtacttacgggtggaatatcattaaacttatgagcggaaaggacgtcttctacctgccacctgagaaatgtgataccttgctgtgcgacatcggtgaatcctctcccagccctacagtggaggaatccaggactattcgcgtcctcaagatggtggagccatggttaaagaacaatcagttctgtatcaaaattctgaacccctatatgcctaccgttatcgagcaccttgaacggctgcaacgaaagcatggcgggatgctagtaagaaatccactctcaaggaactctacacacgagatgtactggataagtaatggaaccggcaacattgtggcttcggtcaatatggtgagccgcctgttgctgaaccggtttactatgacgcatagacgtcccacaatcgaaaaagatgttgacctcggtgcggggaccaggcacgtgaacgccgagccggaaactcctaatatggacgtcatcggagagcggattaagcgcataaaagaggaacacaactccacctggcattatgatgacgagaatccatacaagacatgggcatatcacggctcttacgaagtgaaggctacgggctcagccagctccatgatcaacggggtagtgaaacttctgaccaagccctgggatgttgtccctatggtgactcagatggcaatgacagacaccactccattcggacagcaacgagtgtttaaagagaaggtcgatacaagaacccccaggagtatgccgggtacacggcgcgttatgggcattactgccgaatggttatggagaaccctggggaggaataaaaagcctcgattgtgcacgcgggaggagttcaccaagaaagtgcgtacaaacgctgccatgggagcggtatttactgaagagaatcagtgggactctgcaaaggccgctgtggaagatgaggacttctggaaactcgtcgatagagaacgcgagctgcataagctaggcaaatgtggtagctgcgtgtataacatgatggggaagagggagaagaaacttggagaatttggcaaagccaaaggctcacgggcaatctggtacatgtggctgggggctagatacctcgagttcgaagccctgggatttttgaatgaggaccactggttctcccgcgagaacagttatagcggtgttgaaggcgaggggctgcataagctcggatacattcttagggatatctctaaaatacccggcggtgctatgtatgccgacgacaccgcagggtgggatacacgaatcactgaagacgatctgcacaatgaggaaaagattacccagcagatggacccagagcaccggcaattagcgaacgccatctttaaactgacgtaccagaataaggtggtcaaggtgcagagacctacacccaccggaactgtaatggatattatctccaggaaagaccagcgcggctcaggccaagttgggacatatggattgaacaccttcactaatatggaggctcagctcatacgtcagatggaaggtgagggcgtgctgagcaaggccgatctagaaaacccacatcttcccgagaaaaagattacccagtggctggaaacaaaaggggtcgagcggctcaagagaatggcaatctcgggagacgattgcgtggtgaagcctatcgacgataggtttgctaacgccctgttggcattaaatgacatgggcaaagtccgcaaggatattccacaatggcagccgtctaaaggttggcacgactggcagcaggttcccttctgtagtcatcacttccacgagctgataatgaaggacgggcgaaaactcgtggtaccttgccggccacaagatgaacttatcggaagggcaaggatttcccagggcgcgggctggagcctgcgcgagacggcttgtctagggaaggcctacgcacagatgtggtcactgatgtattttcatagacgggacctcaggttggcctccaacgctatctgctctgccgtgcccgtccactgggtgcctaccagccgtactacatggagtattcatgcacaccatcaatggatgaccactgaagatatgctgacagtttggaatcgagtgtggatcgaggacaacccatggatggaagataagacccccgtcacgacatgggaggacgtgccttaccttggaaaacgcgaggatcagtggtgtggttccctgataggcctcaccagcagagctacttgggcccagaatatcccgaccgcgattcagcaagtacggtctttaatcgggaacgaagagttcctggactacatgccatcaatgaagaggtttcgcaaagaagaggagagtgaaggagctatttggtga

SEQ ID NO: 15145 - RNA, 9873 nt, synthetic construct
  misc_feature 1..9873: note = derived and/or modified CDS sequence (opt3) from DENV-3__FJ850083__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagcatgaaaatctgaagtatacagtgattatcactgttcacaccggtgaccagcatcaggtgggcaacgagacacaaggggtcaccgcagaaattactcctcaggcttccacgacagaggccatcctcccagaatacggaacccttggcctggagtgctctccgcgaactggtttggacttcaatgagatgatcctactgaccatgaaaaacaaggcgtggatggtgcacagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcatactgctctcacaggcgccaccgaaattcagaattcagggggaacaagtatattcgcaggtcacctgaagtgtcggttaaaaatggacaagctggagctaaaaggcatgagctatgccatgtgcactaacacctttgtgctcaagcgtgaggtctctgaaacgcagcatgggaccatcctgattaaagtggagtacaagggagaagatgctccctgtaagatccctttctccacagaggacggccaaggtaaagcgcacaacgggcgccttataactgcaaatccagttgtgaccaagaaagatgagcccgtaaacattgaagccgagccgcctttcggcgaatcaaatatcgtcatcggaattggcgacaacgctttgaagatcaattggtacaaaaaggggagcagtattggaaagatgtttgaggccacagcaagaggtgccaggcggatggctatactgggcgatactgcctgggacttcgggtctgtgggaggcgttctcaactccctgggtaaaatggtgcatcagatctttgggagcgcatataccgcgcttttctcgggcgtctcttgggtgatgaagattggaatcggcgtactgttgacgtggatcgggctcaattccaaaaacacatcaatgagttttagctgcattgctataggaaccatcactctgtacttaggcgccgtggttcaggcagatatgggttgtgtcattaattggaaggggaaagaactgaagtgcggatccggcatcttcgtgacaaacgaggtgcacacctggactgagcagtataagtttcaagccgactctcccaaacgactagctaccgccattgcaggtgcttgggaaaatggcgtctgtgggatccgcagcacaacgagaatggagaacctcctgtggaagcagatagccaatgaacttaactacatcttgtgggagaataacattaaactgaccgttgtggtgggagatatcattggcgtactcgaacaggggaagaggactctgacaccacagcctatggagttaaaatattcatggaagacctggggaaaagcgaagatcgtcacagccgagactcaaaacagttccttcataattgacggccccaataccccagaatgccccagcgcttctcgggcatggaacgtgtgggaggttgaagactacggttttggggtgttcacgacaaatatctggctgaagcttcgcgaggtctatacccagttgtgtgatcacagactcatgtcagccgctgtgaaagacgaaagggccgttcatgcagatatgggatactggattgagagtcagaagaacggcagctggaaactggagaaggcgtccctaatcgaagtgaaaacttgcacctggcctaagtctcacacactgtggtcgaatggtgtactcgagagcgacatgataatcccaaagtccctggccggcccgatttcacagcataaccaccgtcccgggtaccacactcaaaccgctggaccttggcatcttggcaaattggaactggattttaattattgcgaggggacaacggtcgtgatcaccgagaactgtggaactcggggcccaagtttacgaacaaccactgtgtctggtaagctcattcacgaatggtgctgtagaagctgcacactgccccctcttaggtacatgggggaggacggatgttggtatggcatggaaatccgcccaatatccgagaaagaagagaatatggtcaagtcactggttagcgccggttctggcaaagtggataacttcaccatgggggtattgtgcctcgcaattctgtttgaggaagtgatgcggggaaagttcggcaagaaacatatgatcgctggggtcttctttacgttcgtgctactgctctccggacagatcacttggagagacatggcccacaccctgattatgatcggcagtaatgcaagcgataggatgggtatgggggttacataccttgccttgattgctacctttaagatacagcccttcctggcgttaggatttttcctccgcaaactgacttctcgagagaaccttctgctaggcgtgggcctcgccatggcaacaaccctgcaattgccggaagacatcgagcagatggctaatgggattgccctgggattaatggccctcaagctgatcacacagtttgaaacttatcagctttggaccgctctgatttccttgacgtgttcaaacacaatgttcaccctcactgtcgcatggcggaccgccacactgatcctagcgggtgtgagtctgcttcctgtttgccaaagctcgtccatgcgtaaaactgattggctcccaatggctgtggccgcaatgggcgtcccccctctgcccttgtttatattctctctgaaggacaccttaaagagaaggagctggccactcaatgagggggtaatggccgtgggactggtttcaatccttgctagttccctgttgcgcaacgatgtgcctatggcaggccccctcgtcgccggtgggctgctaattgcgtgttacgtgatcacgggaacatctgctgacctgaccgtagagaaagccgcagacattacttgggaagaggaagccgagcagacaggcgtgagccataaccttatgatcaccgtcgatgacgatggcactatgcggataaaggacgatgaaacagagaatattctcaccgttctgttgaaaacggctttactgatcgtgtccggggtgtttccatattcaatcccggccactctcctggtctggcacacctggcagaagcagacacaaagaagcggagtgctttgggacgttcctagtcccccagagacccagaaagcagaactggaggaaggtgtatacaggattaagcagcagggcatattcgggaaaacacaagtgggagtcggcgtgcagaaggagggtgtttttcacactatgtggcatgtgacccgaggggctgtcttgacgtacaacggaaagcgcctagagcccaattgggcctctgtgaaaaaggatctgatctcctatggcggcgggtggcggctcagcgcgcagtggcaaaaaggagaagaggtacaggtcattgccgtggaacctggtaagaacccaaaaaatttccagacaatgcccggcactttccagaccacaaccggggagatcggagcaattgctctggactttaagcctggcacttcgggttcaccgatcataaacagagaagggaaggttgtgggactttacggcaatggcgtcgtgaccaaaaacgggggatatgtttctggtatcgcccaaacaaatgctgagccagatggccccacgcctgagttagaagaggaaatgttcaagaaaaggaacctgactattatggacctccacccagggagtggaaagacccgtaaatacttgcccgcaatcgtgcgcgaggccattaagcggagactgaggacactcatcctggcccctacccgagtcgtggctgcggaaatggaggaggcacttaagggcctgccgatacggtatcagactacagccaccaaatccgaacatacgggtcgcgagattgtagatttgatgtgccacgctacttttacaatgagactactgagccccgtgagggttccaaattacaacctcatcatcatggacgaagcccatttcaccgatcctgcatctattgccgctcgggggtatatcagcacccgagtcggaatgggcgaggcggccgcaatatttatgactgctacacccccaggcaccgccgacgcattccctcagtccaatgcccccattcaggacgaagagagagatatcccagagcgctcatggaacagtgggaatgaatggattacagactttgctggaaagactgtgtggttcgtgccgagcatcaaagccggtaacgatatagcgaactgtttaaggaagaatggcaaaaaggtcattcaactgtctcgtaagacgtttgacaccgagtaccagaaaacaaagcttaacgattgggacttcgtagtgactaccgatatctccgaaatgggggcaaattttaaagccgaccgggttatcgatcctagaaggtgcctgaagcccgtgattctcacagacggaccagagcgcgtcatcttggctggccccatgcctgtgaccgccgcttcagcagcccagcgaagaggtcgggttgggaggaacccacagaaagagaatgatcaatacattttcactggccagcccctgaacaatgacgaagaccacgctcactggacggaggccaagatgctcctggataacataaatacccctgaaggaatcattccggcacttttcgagccagaacgcgagaagagtgcggccatcgacggcgagtatcgtctaaaaggggaaagcagaaagacatttgtggagctgatgcggaggggagatttgcccgtctggttagctcataaagtggcctccgaaggtatcaagtacactgaccgcaaatggtgcttcgatggccagcgaaacaatcagattctggaggaaaacatggacgtagagatatggaccaaggagggggaaaaaaagaagctcagacctcggtggctggatgcaaggacatattctgacccccttgctctgaaagagtttaaggatttcgccgcaggacgcaaatcgatcgccctcgacttggtgaccgaaattggcagagttccaagccacctggctcataggactcggaatgcgctagataacctggtcatgctccacacatcagagcacggtgggcgtgcctaccgccatgcagtggaagagcttcctgagacgatggaaaccctgttattgctgggcctcatgatcctgcttactggaggcgctatgctgtttctcatttccgggaagggaatcggtaaaacaagtataggcttgatctgtgtgattgcctctagcgggatgctgtggatggccgagatccccttacaatggattgcatccgctatcgtcctagaattctttatgatggttctgctcataccagagcctgagaagcagcgaaccccgcaggacaatcaacttgcctatgtggtaattggaatcctgaccttggcggctattatcgccgcaaacgaaatgggcctgctcgagacaactaagagagatctgggtatgtcaaaagaacccggggtggtctctccaacgagctaccttgacgtggacctccaccctgccagtgcttggaccctgtatgcagttgccacaactgtgataacccccatgttgaggcatacaatcgagaattccaccgcgaacgtcagcctggctgccattgcaaaccaggccgtagtgttaatgggcctagataagggatggccaatctctaaaatggacctgggcgttcctctccttgctctggggtgctactcacaggtgaatcccttgactctgacggccgcagtcctcctgcttattacacactacgctatcataggaccgggcttacaggccaaggcgacccgggaagcccaaaaacgcactgcagctggtattatgaagaacccaaccgtggatgggatcatgacaatcgacctggatcctgtcatttatgactccaagttcgagaaacagctcggacaggtgatgttgctggttctatgtgccgtgcagctgctccttatgagaactagttgggcactgtgcgaggctttgaccctggccacaggccccatcacgaccctctgggaaggtagcccaggcaagttttggaatactacaatagccgtatcgatggcgaacattttcagggggtcttacctggctggagcaggcttagccttttccatcatgaaaagcgtggggaccggaaagcggggcactggttcacaaggggagacacttggagaaaaatggaagaagaaactgaatcagctcagtcgaaaggagttcgatctatataaaaagtctggcattaccgaagtcgacagaacggaggctaaagagggtctgaagcgcggcgaaaccacacatcacgccgtttccagggggagcgcaaaattgcagtggtttgtggagcggaacatggtcatccccgaaggacgtgtgatagatctgggctgtgggagaggaggctggtcatactattgcgccggtctcaagaaggtaactgaggtgagggggtacaccaaaggaggccctggccacgaagagccggttcccatgagtacatatgggtggaatatcgtgaagcttatgagcggaaaagacgtcttctacctgccacctgagaagtgtgatactttgctgtgcgacattggtgaatcctctcccagccctaccgtggaggaatcccgcacaatccgggtcctcaaaatggtggagccatggttaaagaacaatcagttctgtattaagatcctgaacccctacatgcctaccgttattgagcatcttgaacgactgcaaagaaaacacggcgggatgctagtaaggaatccactctcacgcaactctactcatgagatgtattggatcagtaatggaacgggcaacatagtggcttcggtcaatatggtgagccggctgttgctgaacagatttacaatgacccaccgtaggcccactattgaaaaggatgttgacctcggtgcggggacccggcacgtgaacgccgagccggaaacacctaatatggacgtcatcggagagcgcatcaaacgaattaaggaggaacataactccacgtggcactacgatgacgagaatccatataaaacctgggcataccatggctcttatgaagtgaaggctactggctcagccagctccatgataaacggggtagtgaagcttctgacaaaaccctgggatgttgtccctatggtgacccagatggcaatgactgacacaaccccattcggacagcaaagagtgtttaaggagaaagtcgatacaaggactccccggagtatgccgggtacccgcagagttatgggcatcacggccgaatggttatggaggaccctggggcgaaataagaaacctcggttgtgcacacgtgaggagttcactaagaaggtgagaaccaacgctgccatgggagcggtatttacagaagagaatcagtgggactctgcaaaagccgctgtggaagatgaggacttctggaagctcgtcgatcgcgaaagggagctgcacaaactaggcaagtgtggtagctgcgtgtacaacatgatggggaaacgggagaagaaacttggagaatttggcaaggccaagggctcaagagcaatttggtatatgtggctgggggctcgctacctcgagttcgaagccctgggatttttgaatgaggaccattggttctccagggagaacagttacagcggtgttgaaggcgaggggctgcacaaactcggatatatccttcgagatatttctaagatccccggcggtgctatgtacgccgacgacactgcagggtgggatacccggataacggaagacgatctgcacaatgaggaaaaaatcacacagcagatggacccagagcatagacaattagcgaacgccatttttaagctgacctatcagaataaagtggtcaaggtgcagaggcctactcccacaggaaccgtaatggatatcatttcccgcaaggaccagcgtggctcaggccaagttgggacttacggattgaacaccttcacaaatatggaggctcagctcatccggcagatggaaggtgagggcgtgctgagcaaagccgatctagaaaacccacaccttcccgagaagaaaataacgcagtggctggaaaccaagggggtcgagagactcaaaaggatggcaatttcgggagacgattgcgtggtgaagcctatcgacgatcgctttgctaacgccctgttggcattaaatgacatgggcaaggtccgaaaagatatcccacaatggcagccgtctaagggttggcatgactggcagcaggttcccttctgtagtcaccacttccatgagctgattatgaaagacgggcggaagctcgtggtaccttgcagaccacaagatgaacttataggaagggcccgcatctcccagggcgcgggctggagcctgagagagactgcttgtctagggaaagcctatgcacagatgtggtcactgatgtactttcaccggagggacctccgtttggcctccaacgctatttgctctgccgtgcccgtccattgggtgcctacaagccgaaccacttggagtatccacgcacatcaccaatggatgacaaccgaagatatgctgacggtttggaatcgcgtgtggattgaggacaacccatggatggaagataagacacccgtcaccacttgggaggacgtgccttatcttggaaagagagaggatcagtggtgtggttccctgatcggcctcaccagccgggctacatgggcccagaatataccgactgcgatccagcaagtaaggtctttaattgggaacgaagagttcctggactacatgccatcaatgaaacgctttagaaaggaagaggagagtgaaggagctatctggtga

SEQ ID NO: 15146 - RNA, 9873 nt, synthetic construct
  misc_feature 1..9873: note = derived and/or modified CDS sequence (opt3) from DENV-3__FJ850086__SS-prME
  source 1..9873: mol_type = other RNA
accagcctgtgcctcatgatgatccttcccgccgctctggcattccacttgacatccagagacggcgagcctaggatgattgtggggaagaacgaacggggaaagtctttactgtttaagactgcctcaggtataaatatgtgtacgctaatcgcgatggatctcggcgagatgtgcgacgataccgtcacctacaagtgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgagcgggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcaaaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgcgccctgtaaaatccctttctccaccgaggacggccaaggtaaggcacataacgggcgtcttataacagccaatccagttgtgactaaaaaggatgagcccgtaaacattgaagctgagccgcctttcggcgaatcaaatatcgtcatcggaattggcgacaacgccttgaaaatcaattggtataagaaggggagcagtattggaaaaatgtttgaggcaaccgcccgcggtgctagaaggatggccatactgggcgatacagcatgggacttcgggtctgtgggaggcgttctcaactccctgggtaagactgtgcaccagatctttgggagcgcgtacaccgctcttttctcgggcgtctcttgggtgatgaaaattggaatcggcgtactgttgacgtggatcgggctcaattccaagaacacatcaatgagttttagctgcattgccataggaatcattaccctgtatttaggcgcagtggttcaggccgatatgggttgtgtcatcaattggaaagggaaggaactgaagtgcggatccggcattttcgtgactaacgaggtgcatacatggaccgagcagtacaaatttcaagctgactctcccaagcggctagccactgcaatcgctggtgcctgggaaaatggcgtctgtgggatacgaagcaccacacgcatggagaacctcctgtggaaacaggttgcgaatgaacttaactatatcttgtgggagaataacattaagctgacggtggtggtaggagatatcattggcgtcctcgaacaggggaaaagaaccctgactccacagcctatggagttaaagtactcatggaaaacatggggaaaggccaagatcgtgaccgctgagacacaaaacagttccttcataattgacggccccaatactccagaatgccccagcgcatctagggcctggaacgtttgggaggtggaagactatggttttggggtcttcaccacgaatatctggctgaaacttcgggaggtgtacacacagttgtgtgatcaccgcctcatgtcagctgccgttaaggacgaaagagcagtgcacgcggatatgggatactggattgagagtcagaaaaacggcagctggaagctggagaaagcctccctaatcgaagtaaagacctgcacttggcctaagtctcataccctgtggtcgaatggtgtcctcgagagcgacatgataatcccaaaatccctggctggcccgatttcacagcacaaccataggcccgggtatcacacacaaactgccggaccttggcaccttggcaagttggaactggattttaattactgcgaggggaccacagtggtgatcacggagaactgtggaacccgtggcccaagtttacggactacaaccgtctctggtaaactcattcatgaatggtgctgtcgaagctgcactctgccccctcttagatatatgggggaggacggatgttggtacggcatggaaatcaggccaatatccgagaaggaagagaatatggttaaatcactggtgagcgcaggttctggcaaggtagataacttcacaatgggggtgttgtgcctcgctattctgtttgaggaagtcatgcgcggaaagttcggcaaaaagcacatgatcgccggggtgttctttatgttcgttctactgctctccggacagatcacctggcgggacatggcacatacgctgattatgatcggcagtaatgccagcgatagaatgggtatgggggtgacttatcttgctttgattgcgacctttaaaatacagcccttcctggccttaggatttttcctcaggaagctgacatctcgcgagaaccttctgctaggcgtcggcctcgcaatggctaccactctgcaattgccggaagacatcgagcagatggccaatgggattgccctgggattaatggctctcaaactgatcacacagtttgaaacctaccagctttggacagcactgatttccttgacttgttcaaacaccatgttcacgctcacagtggcctggcgaaccgcgactctgatcctagctggtgttagtctgcttcctgtgtgccaaagctcgtccatgcggaagaccgattggctcccaatggccgtcgcagccatgggcgtaccccctctgcccttgtttatattctctctgaaggacacattaaaacgtagaagctggccactcaatgagggggtgatggctgttggactggtgtcaatccttgcaagttccctgttgaggaacgatgtccctatggccggccccctcgtggcgggtgggctgctaattgcttgttatgtaatcactggaacctctgccgacctgacggtggagaaggcagccgacattacatgggaagaggaagctgagcagaccggcgtcagccacaaccttatgatcactgttgatgacgatggcacaatgcgcataaaagacgatgaaaccgagaatattctcactgtgctgttgaagacagccttactgatcgtgtccggggtctttccatactcaatcccggcaaccctcctggtgtggcatacgtggcagaaacagactcaacggagcggagttctttgggacgtacctagtcccccagagacccagaaggctgaactggaggaaggtgtgtacagaattaaacagcagggcatattcgggaagacacaagtcggagtgggcgttcagaaggagggtgtgtttcacaccatgtggcacgtcacaagaggggccgtgttgacttataacggaaaacgactagagcccaattgggcgtctgtaaagaaagatctgatctcctacggcggcgggtggcgcctcagcgcccagtggcaaaagggagaagaggtccaggtgattgcagttgaacctggtaaaaacccaaagaatttccagaccatgcccggcacgttccagacaactaccggggagatcggagctattgccctggactttaagcctggcacatcgggttcaccgatcataaaccgggaagggaaagtggtcggactttatggcaatggcgtggttaccaagaacgggggatacgtgtctggtatcgctcaaactaatgcagagccagatggccccacccctgagttagaagaggaaatgttcaaaaagagaaacctgacaattatggacctccatccagggagtggaaaaacgaggaagtatttgcccgccatcgtccgtgaggccattaagcgccggctgagaactctcatcctggctcctaccagggtggtagcggcagaaatggaggaggcccttaaaggcctgccgatacgataccagacaaccgctactaagtccgaacacacaggtcgggagattgtggatttgatgtgccatgccacctttacgatgcgcctactgagccccgttagagtcccaaattataacctcatcatcatggacgaagcacacttcactgatcctgcctctattgctgcgagggggtacatcagcacacgggtgggaatgggcgaggccgcagctatatttatgaccgccacacccccaggcactgcagacgccttccctcagtccaatgctcccattcaggacgaggaacgagatatcccagagagatcatggaacagtgggaatgaatggattacagactttgccggaaaaaccgtgtggttcgtcccgagcatcaaggcgggtaacgatatagcaaactgtttacgcaaaaatggcaagaaggtaattcaactgtctaggaaaacatttgacactgagtaccagaagacgaaacttaacgattgggacttcgtggttaccacagatatctccgaaatgggggccaattttaaggctgaccgtgtgatcgatcctcggagatgcctgaaacccgtcattctcactgacggaccagagagggtgatcttggccggccccatgcctgttaccgctgcatcagccgctcagcgccgaggtagagtggggcggaacccacagaaggagaatgatcaatatattttcacaggccagcccctgaacaatgacgaagaccatgcccactggaccgaggcaaagatgctcctggataacataaatactcctgaaggaatcattccggcgcttttcgagccagaaagggagaaaagtgccgctatcgacggcgagtaccgcctaaagggggaaagccgtaaaacgtttgtcgagctgatgagacggggagatttgcccgtgtggttagcccacaaggtagcatccgaaggtatcaaatataccgacaggaagtggtgcttcgatggccagcgcaacaatcagattctggaggaaaacatggacgtggagatatggacaaaagagggggaaaagaagaaactccgacctagatggctggatgctcggacttactctgacccccttgccctgaaggagtttaaagatttcgcagccggaaggaagtcgatcgctctcgacttggttaccgaaattggccgcgtcccaagccatctggcgcacagaacaaggaatgccctagataacctggtgatgctccatacctcagagcacggtgggcgggcatatcgtcacgctgtggaggaacttcctgagactatggaaacactgttattgctgggcctcatgatcctgcttacgggaggcgccatgctgtttctcatttccgggaaaggaatcggtaagaccagtataggcttgatctgtgtcattgcctctagcgggatgctgtggatggcagagatccccttacaatggattgcttccgccatcgttctagagttctttatgatggtgctgctcataccagagcctgagaagcagcgcactccgcaggacaatcaacttgcgtacgtagtgattggaatcctgacattggctgccattatcgcagccaacgaaatgggcctgctcgagaccaccaaacgagatctgggtatgtcaaaggaacccggggtcgtgtctccaacaagctatcttgacgttgacctccatcctgctagtgcatggactctgtacgccgtggcgacgaccgtcataacacccatgttgagacacactatcgaaaattccaccgctaacgtaagcctggccgcaattgccaaccaggctgtggttttaatgggcctagataaaggatggccaatctctaagatggacctgggcgtgcctctccttgccctggggtgctactcacaggtcaatcccttgacactgaccgcagctgtgctcctgcttattactcattatgccatcataggaccgggcttacaggcgaaagccacgagggaagcacaaaagcggacagctgccggtattatgaagaacccaaccgtcgatgggatcatgactatcgacctggatcctgtgatttacgactccaaattcgagaagcagctcggacaggttatgttgctggtgctatgtgcagtacagctgctccttatgcgcaccagttgggctctgtgcgaggccttgacactggccactggccccatcaccacactctgggaaggtagcccaggcaaattttggaatacgaccatagcggtgtcgatggctaacattttcagagggtcttatctggcaggagccggcttagctttttccatcatgaaaagcgtcgggactggaaaaaggggcacaggttcacaaggggagacccttggagaaaagtggaagaaaaagctgaatcagctcagtcggaaagagttcgatctatacaagaaatctggcattactgaagttgaccgaacagaggccaaggagggtctgaaaagaggcgaaaccacgcaccatgcagtgtcccgcgggagcgccaagttgcagtggtttgtcgagaggaacatggtgatccccgaaggacgggtaatagatctgggctgtgggcgtggaggctggtcatattactgcgctggtctcaagaaagtgaccgaggttagagggtatacaaagggaggccctggccacgaggaaccggtgcccatgagtacttacgggtggaatatcattaaacttatgagcggaaaggacgtcttctacctgccacctgagaaatgtgataccttgctgtgcgacatcggtgaatcctctcccagccctacagtggaggaatccaggactattcgcgtcctcaagatggtggagccatggttaaagaacaatcagttctgtatcaaaattctgaacccctatatgcctaccgttatcgagcaccttgaacggctgcaacgaaagcatggcgggatgctagtaagaaatccactctcaaggaactctacacacgagatgtactggataagtaatggaaccggcaacattgtggcgtcggtcaatatggtgagccgcctgttgctgaaccggtttactatgacgcatagacgtcccacaatcgaaaaagatgttgacctcggtgccgggaccaggcacgtgaacgcagagccggaaactcctaatatggacgtcatcggagagcggattaagcgcataaaagaggaacacaactccacctggcattatgatgacgagaatccatacaagacatgggcttatcacggctcttacgaagtgaaggccacgggctcagcaagctccatgatcaacggggtagtgaaacttctgaccaagccctgggatgttgtccctatggtgactcagatggccatgacagacaccactccattcggacagcaacgagtgtttaaagagaaggtcgatacaagaacccccaggagtatgccgggtacacggcgcgttatgggcattactgctgaatggttatggagaaccctggggaggaataaaaagcctcgattgtgcacgcgggaggagttcaccaagaaagtgcgtacaaacgccgcgatgggagcagtatttactgaagagaatcagtgggactctgccaaggctgccgtggaagatgaggacttctggaaactcgtcgatagagaacgcgagctgcataagctaggcaaatgtggtagctgcgtgtataacatgatggggaagagggagaagaaacttggagaatttggcaaagcaaaaggctcacgggctatctggtacatgtggctgggggccagatacctcgagttcgaagctctgggatttttgaatgaggaccactggttctcccgcgagaacagttatagcggtgttgaaggcgaggggctgcataagctcggatacattcttagggatatctctaaaatacccggcggtgccatgtatgcagacgacaccgcggggtgggatacacgaatcactgaagacgatctgcacaatgaggaaaagattacccagcagatggacccagagcaccggcaattagccaacgctatctttaaactgacgtaccagaataaggtggtcaaggtgcagagacctacacccaccggaactgtaatggatattatctccaggaaagaccagcgcggctcaggccaagttgggacatatggattgaacaccttcactaatatggaggcccagctcatacgtcagatggaaggtgagggcgtgctgagcaaggcagatctagaaaacccacatcttcccgagaaaaagattacccagtggctggaaacaaaaggggtcgagcggctcaagagaatggctatctcgggagacgattgcgtggtgaagcctatcgacgataggtttgccaacgcactgttggccttaaatgacatgggcaaagtccgcaaggatattccacaatggcagccgtctaaaggttggcacgactggcagcaggttcccttctgtagtcatcacttccacgagctgataatgaaggacgggcgaaaactcgtggtaccttgccggccacaagatgaacttatcggaagggcgaggatttcccagggcgctggctggagcctgcgcgagacggcctgtctagggaaggcatacgcccagatgtggtcactgatgtattttcatagacgggacctcaggttggcttccaacgccatctgctctgcagtgcccgtccactgggtgcctaccagccgtactacatggagtattcatgctcaccatcaatggatgaccactgaagatatgctgacagtttggaatcgagtgtggatcgaggacaacccatggatggaagataagacccccgtcacgacatgggaggacgtgccttaccttggaaaacgcgaggatcagtggtgtggttccctgataggcctcaccagcagagccacttgggcgcagaatatcccgaccgctattcagcaagtacggtctttaatcgggaacgaagagttcctggactacatgccatcaatgaagaggtttcgcaaagaagaggagagtgaaggagccatttggtga

SEQ ID NO: 15147 - RNA, 9873 nt, synthetic construct
  misc_feature 1..9873: note = derived and/or modified CDS sequence (opt3) from DENV-3__FJ850089__SS-prME
  source 1..9873: mol_type = other RNA
accagcctgtgcctcatgatgatccttcccgcagctctggcattccacttgacttccagagacggagagcctaggatgattgtggggaagaacgaacggggaaagtctttactgtttaagactgcatcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagcatgaaaatctgaagtatacagtgattatcactgttcacaccggtgaccagcatcaggtgggcaacgagacacaaggggtcaccgcagaaattactcctcaggcttccacgacagaggtgatcctcccagaatacggaacccttggcctggagtgctctccgcgaactggtttggacttcaatgagatgatcctactgaccatgaaaaacaaggcctggatggtacacagacagtggtttttcgatctccccctgccttggacaagcggggcgaccactgaaacaccaacgtggaataggaaagagcttctggttacctttaagaacgcccacgccaagaagcaagaagtggtcgtgttgggctcccaggagggagctatgcatactgccctcacaggcgctaccgaaattcaaaattcagggggaacaagtatattcgccggtcacctgaagtgtcggttaaaaatggacaagctggagctaaaaggcatgagctatgcaatgtgcactaacacctttgtcctcaagaaagaggtgtctgaaacgcagcatgggaccatcctgattaaggttgagtacaagggagaagatgccccctgtaaaatccctttctccacagaggacggccaaggtaaggctcacaacgggcgtcttataactgcgaatccagtggtaaccaaaaaggatgagcccgtcaacattgaagcagagccgcctttcggcgaatcaaatatcgtgatcggaattggcgacaacgccttgaaaatcaattggtacaagaaggggagcagtattggaaaaatgtttgaggctacagcccgcggtgcaagaaggatggccatactgggcgatactgcttgggacttcgggtctgttggaggcgtgctcaactccctgggtaagatggtccatcagatctttgggagcgcctataccgcacttttctcgggcgtgtcttgggtaatgaaagtgggaattggcgttctgttgacgtggatcgggctcaattccaagaacacatcaatgagttttagctgcatcgcgattggaataatcaccctgtacttaggcgctgtcgtgcaggccgatatgggttgtgtgattaattggaaagggaaggaactgaagtgcggatccggcatcttcgtcactaacgaggttcacacatggaccgagcagtataaatttcaagcagactctcccaagcggctagccactgctattgccggtgcatgggaaaatggcgtgtgtgggatccgaagcaccacacgcatggagaacctcctgtggaaacagatagctaatgaacttaactacatcttgtgggagaataacattaagctgacggtggtagtcggagatatcattggcgtgctcgaacaggggaaaagaaccctgactccacagcctatggagttaaagtattcatggaaaacatggggaaaggccaagatcgttaccgcggagacacaaaacagttccttcataattgacggccccaatactccagaatgccccagcgcctctagggcttggaacgtgtgggaggtcgaagactacggttttggggtgttcaccacgaatatctggctgaaacttcgggaggtttatacacagttgtgtgatcaccgcctcatgtcagcagccgtgaaggacgaaagagctgtacatgccgatatgggatactggattgagagtcagaaaaacggcagctggaagctggagaaagcatccctaatcgaagtcaagacctgcacttggcctaagtctcacaccctgtggtcgaatggtgtgctcgagagcgacatgataatcccaaaatccctggcgggcccgatttcacagcataaccacaggcccgggtaccacacacaaactgccggaccttggcatcttggcaagttggaactggattttaattattgcgaggggaccacagtggtcatcacggagaactgtggaacccgtggcccaagtttacggactacaaccgtttctggtaaactcattcacgaatggtgctgtcgaagctgcactctgccccctcttagatacatgggggaggacggatgttggtatggcatggaaatcaggccaatatccgagaaggaagagaatatggtgaaatcactggtaagcgctggttctggcaaggtggataacttcacaatgggggtcttgtgcctcgccattctgtttgaggaagtgatgcgcggaaagttcggcaaaaagcatatgatcgcaggggttttctttaccttcgtgctactgctctccggacagatcacgtggcgggacatggctcacactctgattatgatcggcagtaatgccagcgatagaatgggtatgggggtcacctaccttgcattgattgccacatttaaaatacagcccttcctggctttaggatttttcctcaggaagctgacctctcgcgagaaccttctgctaggcgtgggcctcgcgatggccactacactgcaattgccggaagacatcgagcagatggcaaatgggattgctctgggattaatggccctcaaactgatcacccagtttgaaacatatcagctttggactgccctgatttccttgacctgttcaaacacgatgttcacactcaccgttgcttggcgaactgcaaccctgatcctagccggtgtgagtctgcttcctgtctgccaaagctcgtccatgcggaagacagattggctcccaatggcggtagctgccatgggcgtgccccctctgcccttgtttatattctctctgaaggacactttaaaacgtagaagctggccactcaatgagggggttatggcagtgggactggtctcaatccttgccagttccctgttgaggaacgatgtgcctatggctggccccctcgtagccggtgggctgctaattgcctgttacgtgatcaccggaacgtctgcggacctgacagtcgagaaggctgccgacattacctgggaagaggaagcagagcagactggcgttagccataaccttatgatcacagtggatgacgatggcaccatgcgcataaaagacgatgaaactgagaatattctcacagtgctgttgaagaccgccttactgatcgtctccggggtgtttccatattcaatcccggctacgctcctggtttggcacacttggcagaaacagacccaacggagcggagtactttgggacgtgcctagtcccccagagacacagaaggccgaactggaggaaggtgtctacagaattaaacagcagggcatattcgggaagacccaagtgggagttggcgtgcagaaggagggtgtctttcacacaatgtggcatgtgactagaggggcagtattgacctacaacggaaaacgactagagcccaattgggcttctgtcaagaaagatctgatctcctatggcggcgggtggcgcctcagcgcccagtggcaaaagggagaagaggtgcagattatcgcggttgaacctggtaaaaacccaaagaatttccagacgatgcccggcacattccagactaccacaggggagattggagccatcgcactggactttaagcctggcacctcgggttcaccgataatcaaccgggaagggaaagtggtcggactttacggcaatggcgtggttactaagaacgggggatatgtgtctggtattgctcaaaccaatgccgagccagatggccccacacctgagttagaagaggaaatgttcaaaaagagaaacctgacgatcatggacctccacccagggagtggaaaaactaggaagtacttgcccgctattgtccgtgaggcaatcaagcgccggctgagaaccctcatactggcccctacaagggtggtagccgctgaaatggaggaggcgcttaaaggcctgccgattcgatatcagaccactgcaacaaagtccgaacataccggtcgggagatcgtggatttgatgtgccacgccacgtttactatgcgcctactgagccccgttagagtcccaaattacaacctcatcattatggacgaagctcatttcacagatcctgcctctatcgcagccagggggtatataagcacccgggtgggaatgggcgaggctgcggccatttttatgaccgcaactcccccaggcacagctgacgccttccctcagtccaatgcacccatccaggacgaggaacgagatattccagagagatcatggaacagtgggaatgaatggatcaccgactttgccggaaaaacagtgtggttcgtcccgagcataaaggctggtaacgatattgccaactgtttacgcaaaaatggcaagaaggtaatccaactgtctaggaaaacttttgacacggagtaccagaagaccaaacttaacgattgggacttcgtggttacaactgatatctccgaaatgggggcgaattttaaggcagaccgtgtgattgatcctcggagatgcctgaaacccgtcatcctcaccgacggaccagagagggtgattttggccggccccatgcctgttacagctgcctcagctgcacagcgccgaggtagagtggggcggaacccacagaaggagaatgatcaatacatattcaccggccagcccctgaacaatgacgaagaccacgcccactggactgaggctaagatgctcctggataacatcaatacgcctgaaggaattatcccggcccttttcgagccagaaagggagaaaagtgcagcgatcgacggcgagtatcgcctaaagggggaaagccgtaaaacctttgtcgagctgatgagacggggagatttgcccgtgtggttagcccataaggtagcttccgaaggtattaaatacacagacaggaagtggtgcttcgatggccagcgcaacaatcagatactggaggaaaacatggacgtggagatctggactaaagagggggaaaagaagaaactccgacctagatggctggatgcccggacctattctgacccccttgcactgaaggagtttaaagatttcgctgccggaaggaagtcgattgcactcgacttggttacagaaatcggccgcgtcccaagccacctggcccatagaaccaggaatgctctagataacctggtgatgctccacacttcagagcacggtgggcgggcgtaccgtcatgccgtggaggaacttcctgagacaatggaaacgctgttattgctgggcctcatgattctgcttaccggaggcgcaatgctgtttctcatctccgggaaaggaataggtaagacaagtatcggcttgatttgtgtcatcgcttctagcgggatgctgtggatggccgagattcccttacaatggatcgcctccgcaatagttctagagttctttatgatggtgctgctcattccagagcctgagaagcagcgcacaccgcaggacaatcaacttgcttatgtagtgatcggcattctgaccttggccgcgatcatagctgccaacgaaatgggcctgctcgagaccacaaaacgagatctgggtatgtcaaaggaacccggggtcgtgtctccaactagctaccttgacgttgacctccaccctgcaagtgcctggacgctgtatgctgtggcaaccacagtcatcactcccatgttgagacataccattgaaaattccacagccaacgtaagcctggcggctatcgccaaccaggcagtggttttaatgggcctagataaaggatggccaatttctaagatggacctgggcgtgcctctccttgccctggggtgctactcacaggtcaatcccttgaccctgactgctgccgtgctcctgcttatcacgcactacgcaataattggaccgggcttacaggctaaagccacaagggaagcgcaaaagcggaccgccgcaggtatcatgaagaacccaactgtcgatgggatcatgaccattgacctggatcctgtgatctatgactccaaattcgagaagcagctcggacaggttatgttgctggtgctatgtgctgtacagctgctccttatgcgcacaagttgggccctgtgcgaggcattgactctggctaccggccccataacaacgctctgggaaggtagcccaggcaaattttggaataccactattgccgtgtcgatggccaacatcttcagagggtcttacctggcgggagctggcttagcattttccattatgaaaagcgtcgggacaggaaaaaggggcaccggttcacaaggggagactcttggagaaaagtggaagaaaaagctgaatcagctcagtcggaaagagttcgatctatataagaaatctggcatcacagaagttgaccgaaccgaggccaaggagggtctgaaaagaggcgaaacgacccatcacgctgtgtcccgcgggagcgccaagttgcagtggtttgtcgagaggaacatggtgatacccgaaggacgggtaatcgatctgggctgtgggcgtggaggctggtcatactattgcgcaggtctcaagaaagtgacagaggttagagggtacactaagggaggccctggccacgaggaaccggtgcccatgagtacctatgggtggaatattgtcaaacttatgagcggaaaggacgtgttctacctgccacctgagaaatgtgatacattgctgtgcgacatcggtgaatcctctcccagccctactgtcgaggaatccaggaccattcgcgtgctcaagatggttgagccatggttaaagaacaatcagttctgtatcaaaattctgaacccctacatgcctacagtaatcgagcatcttgaacggctgcaacgaaagcacggcgggatgctagtgagaaatccactctcaaggaactctacccatgagatgtattggataagtaatggaactggcaacattgtcgcctcggtgaatatggttagccgcctgttgctgaaccggtttacgatgacacacagacgtcccaccatcgaaaaagatgtggacctcggtgctgggactaggcacgtcaacgcggagccggaaacccctaatatggacgtgatcggagagcggattaagcgcataaaagaggaacataactccacatggcactacgatgacgagaatccatataagacgtgggcctaccatggctcttatgaagtaaaggcaaccggctcagctagctccatgatcaacggggtggttaaacttctgactaagccctgggatgtcgtgcctatggtgacacagatggccatgaccgacactacaccattcggacagcaacgagtctttaaagagaaggttgataccagaacacccaggagtatgccgggtactcggcgcgtgatgggcattaccgcagaatggttatggagaacgctggggaggaataaaaagcctcgattgtgcacccgggaggagttcacaaagaaagtacgtactaacgccgctatgggagccgtgtttaccgaagagaatcagtgggactctgcgaaggcagccgtcgaagatgaggacttctggaaactcgtggatagagaacgcgagctgcacaagctaggcaaatgtggtagctgcgtttacaacatgatggggaagagggagaagaaacttggagaatttggcaaagctaaaggctcacgggccatctggtatatgtggctgggggcaagatacctcgagttcgaagctctgggatttttgaatgaggaccattggttctcccgcgagaacagttacagcggtgtggaaggcgaggggctgcacaagctcggatatattcttagggatatctctaaaatacccggcggtgccatgtacgctgacgacacagccgggtgggatactcgaatcaccgaagacgatctgcacaatgaggaaaagattacgcagcagatggacccagagcatcggcaattagcaaacgcgatctttaaactgacatatcagaataaggtcgtgaaggtacagagacctacccccactggaacagttatggatattatctccaggaaagaccagcgcggctcaggccaagtggggacctacggattgaacactttcaccaatatggaggcccagctcatacgtcagatggaaggtgagggcgtcctgagcaaggctgatctagaaaacccacaccttcccgagaaaaagattacacagtggctggaaacgaaaggggtggagcggctcaagagaatggccatctcgggagacgattgcgtggtcaagcctatcgacgataggtttgcaaacgctctgttggccttaaatgacatgggcaaagttcgcaaggatattccacaatggcagccgtctaaaggttggcatgactggcaacaggtgcccttctgtagtcaccacttccatgagctgataatgaaggacgggcgaaaactcgtagtgccttgccggccacaagatgaacttatcggaagggcaaggatttcccagggcgccggctggagcctgcgcgagaccgcgtgtctagggaaggcttatgcccagatgtggtcactgatgtactttcacagacgggacctcaggttggcatccaacgccatctgctctgctgtccccgtgcattgggttcctactagccgtacaacctggagtattcacgcccatcaccaatggatgactacagaagatatgctgaccgtgtggaatcgagtctggatcgaggacaacccatggatggaagataagacgcccgtgacaacctgggaggacgtaccttatcttggaaaacgcgaggatcagtggtgtggttccctgataggcctcactagcagagcaacctgggctcagaatatcccgacagccattcagcaagttcggtctttaatcgggaacgaagagttcctggactacatgccatcaatgaagaggtttcgcaaagaagaggagagtgaaggagcgatttggtga

SEQ ID NO: 15148 - RNA, 9873 nt, synthetic construct
  misc_feature 1..9873: note = derived and/or modified CDS sequence (opt3) from DENV-3__FJ850092__SS-prME
  source 1..9873: mol_type = other RNA
accagcctgtgcctcatgatgatccttcccgccgctctggcattccacttgacatccagagacggagagcctaggatgattgtggggaagaacgaacggggaaagtctttactgtttaagactgcctcaggtataaatatgtgtacgctaatcgcgatggatctcggcgagatgtgcgacgataccgtcacctacaagtgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagcatgaaaatctgaagtatacagtgattatcactgttcacaccggtgaccagcatcaggtgggcaacgagacacaaggggtcaccgcagaaattactcctcaggcttccacgacagaggtgatcctcccagaatacggaacccttggcctggagtgctctccgcgaactggtttggacttcaatgagatgatcctactgaccatgaaaaacaaggcctggatggtacacagacagtggtttttcgatctccccctgccttggacaagcggggttaccactgaaacaccaacgtggaataggaaagagcttctggtgacctttaagaacgcgcacgccaaaaagcaagaagtcgtggtcttgggctcccaggagggagcaatgcatactgctctcacaggcgccaccgaaattcaaaattcagggggaacaagtatattcgctggtcacctgaagtgtcggttaaaaatggacaagctggagctaaaaggcatgagctatgccatgtgcactaacacctttgtgctcaagaaagaggtttctgaaacgcagcatgggaccatcctgattaaggtggagtacaagggagaagatgcaccctgtaaaatccctttctccacagaggacggccaaggtaaggcccacaacgggcgtcttataactgctaatccagtagtcaccaaaaaggatgagcccgtgaacattgaagcggagccgcctttcggcgaatcaaatatcgttatcggaattggcgacaacgcattgaaaatcaattggtacaagaaggggagcagtattggaaaaatgtttgaggccacagctcgcggtgccagaaggatggcaatactgggcgatactgcctgggacttcgggtctgtgggaggcgtcctcaactccctgggtaagatggtgcatcagatctttgggagcgcttataccgcccttttctcgggcgtatcttgggtgatgaaagttggaattggcgtcctgttgacgtggatcgggctcaattccaagaacacatcaatgagttttagctgcatcgcaattggaataatcaccctgtacttaggcgcggtggtgcaggctgatatgggttgtgtcattaattggaaagggaaggaactgaagtgcggatccggcatcttcgttactaacgaggtgcacacatggaccgagcagtataaatttcaagccgactctcccaagcggctagcaactgccattgctggtgcctgggaaaatggcgtgtgtgggatccgaagcaccacacgcatggagaacctcctgtggaaacagatagcaaatgaacttaactacatcttgtgggagaataacattaagctgacggtagtcgtgggagatatcattggcgttctcgaacaggggaaaagaaccctgactccacagcctatggagttaaagtattcatggaaaacatggggaaaggctaagatcgtgaccgccgagacacaaaacagttccttcataattgacggccccaatactccagaatgccccagcgcgtctagggcctggaacgtctgggaggtggaagactacggttttggggttttcaccacgaatatctggctgaaacttcgggaggtgtatacacagttgtgtgatcaccgcctcatgtcagctgcagtaaaggacgaaagagccgtccatgctgatatgggatactggattgagagtcagaaaaacggcagctggaagctggagaaagcctccctaatcgaagtgaagacctgcacttggcctaagtctcacaccctgtggtcgaatggtgtgctcgagagcgacatgataatcccaaaatccctggcaggcccgatttcacagcataaccacaggcccgggtaccacacacaaactgcgggaccttggcatcttggcaagttggaactggattttaattattgcgaggggaccacagtcgttatcacggagaactgtggaacccgtggcccaagtttacggactacaaccgtgtctggtaaactcattcacgaatggtgctgtcgaagctgcactctgccccctcttagatacatgggggaggacggatgttggtatggcatggaaatcaggccaatatccgagaaggaagagaatatggtaaaatcactggtgagcgccggttctggcaaggtcgataacttcacaatgggggtgttgtgcctcgctattctgtttgaggaagttatgcgcggaaagttcggcaaaaagcatatgatcgccggggtgttctttaccttcgtcctactgctctccggacagatcacgtggcgggacatggcacacactctgattatgatcggcagtaatgctagcgatagaatgggtatgggggtgacctaccttgccttgattgcaacatttaaaatacagcccttcctggccttaggatttttcctcaggaagctgacctctcgcgagaaccttctgctaggcgttggcctcgctatggcgactacactgcaattgccggaagacatcgagcagatggccaatgggattgcactgggattaatggctctcaaactgatcacccagtttgaaacatatcagctttggactgccctgatttccttgacctgttcaaacacgatgttcacactcaccgtggcctggcgaactgctaccctgatcctagccggtgtcagtctgcttcctgtatgccaaagctcgtccatgcggaagacagattggctcccaatggccgtggcggctatgggcgttccccctctgcccttgtttatattctctctgaaggacactttaaaacgtagaagctggccactcaatgagggggtgatggccgtcggactggtgtcaatccttgcaagttccctgttgaggaacgatgtacctatggccggccccctcgtggctggtgggctgctaattgcatgttacgtcatcaccggaacgtctgccgacctgattgttgagaaggcggctgacatcacatgggaagaggaagccgagcagaccggcgtgagccataaccttatgataactgtggatgacgatggcacaatgcgcattaaagacgatgaaaccgagaatatcctcactgtcctgttgaagacagcattactgatcgtgtccggggtttttccatattcaattccggccaccctcctggtatggcacacgtggcagaaacagactcaacggagcggagtgctttgggacgtccctagtcccccagagacccagaaggctgaactggaggaaggtgtgtacagaataaaacagcagggcatcttcgggaagacacaagttggagtgggcgtccagaaggagggtgtgtttcacaccatgtggcatgtaacaagaggggcagtcttgacttacaacggaaaacgactagagcccaattgggcatctgtgaagaaagatctgatttcctatggcggcgggtggcgcctcagcgctcagtggcaaaagggagaagaggttcaggtgatcgccgtcgaacctggtaaaaacccaaagaatttccagaccatgcccggcacgttccagacaactaccggggagattggagcgatcgccctggactttaagcctggcacatcgggttcaccgataatcaaccgggaagggaaagtggttggactttacggcaatggcgtggtcaccaagaacgggggatatgtgtctggtattgcacaaactaatgctgagccagatggccccacccctgagttagaagaggaaatgttcaaaaagagaaacctgacaatcatggacctccacccagggagtggaaaaacgaggaagtacttgcccgccattgtacgtgaggctatcaagcgccggctgagaactctcatactggcacctaccagggtggttgccgccgaaatggaggaggctcttaaaggcctgccgattcgatatcagacaaccgcgactaagtccgaacatacaggtcgggagatcgtcgatttgatgtgccacgcaacctttacgatgcgcctactgagccccgtgagagtgccaaattacaacctcatcattatggacgaagcccatttcactgatcctgcttctatcgccgcaagggggtatataagcacacgggtcggaatgggcgaggccgctgcgatttttatgaccgccacacccccaggcactgcagacgctttccctcagtccaatgcccccatccaggacgaggaacgagatattccagagagatcatggaacagtgggaatgaatggatcacagactttgcaggaaaaaccgtatggttcgtgccgagcataaaggccggtaacgatattgctaactgtttacgcaaaaatggcaagaaggttatccaactgtctaggaaaacatttgacactgagtaccagaagacgaaacttaacgattgggacttcgtggtcaccacagatatctccgaaatgggggccaattttaaggcggaccgtgtgattgatcctcggagatgcctgaaacccgttatcctcactgacggaccagagagggtgattttggcaggccccatgcctgtcaccgccgcttcagccgctcagcgccgaggtagagtggggcggaacccacagaaggagaatgatcaatacatattcacaggccagcccctgaacaatgacgaagaccacgcacactggaccgaggccaagatgctcctggataacatcaatactcctgaaggaattatcccggctcttttcgagccagaaagggagaaaagtgccgcaatcgacggcgagtatcgcctaaagggggaaagccgtaaaacgtttgtagagctgatgagacggggagatttgcccgtgtggttagcgcataaggttgcctccgaaggtattaaatacaccgacaggaagtggtgcttcgatggccagcgcaacaatcagatactggaggaaaacatggacgtcgagatctggacaaaagagggggaaaagaagaaactccgacctagatggctggatgctcggacttattctgacccccttgccctgaaggagtttaaagatttcgcagctggaaggaagtcgattgccctcgacttggtgaccgaaatcggccgcgtgccaagccacctggcacatagaacaaggaatgccctagataacctggtcatgctccacacctcagagcacggtgggcgggcttaccgtcatgcggttgaggaacttcctgagactatggaaacactgttattgctgggcctcatgattctgcttacgggaggcgccatgctgtttctcatctccgggaaaggaataggtaagaccagtatcggcttgatttgtgtgatcgcatctagcgggatgctgtggatggctgagattcccttacaatggatcgcctccgccatagtactagagttctttatgatggtgctgctcattccagagcctgagaagcagcgcactccgcaggacaatcaacttgcatatgtcgtgatcggcattctgacattggctgccatcatagcggctaacgaaatgggcctgctcgagaccaccaaacgagatctgggtatgtcaaaggaacccggggttgtgtctccaacaagctaccttgacgtcgacctccaccctgccagtgcatggactctgtatgccgtagctacgaccgtgatcacacccatgttgagacatactattgaaaattccaccgcaaacgttagcctggccgcgatcgctaaccaggccgtggtcttaatgggcctagataaaggatggccaatttctaagatggacctgggcgtgcctctccttgcactggggtgctactcacaggtcaatcccttgacactgaccgccgctgtgctcctgcttatcactcactacgccataattggaccgggcttacaggcaaaagctacgagggaagcccaaaagcggacagcggccggtatcatgaagaacccaaccgttgatgggatcatgactattgacctggatcctgtgatctatgactccaaattcgagaagcagctcggacaggtaatgttgctggtgctatgtgcagtccagctgctccttatgcgcaccagttgggctctgtgcgaggccttgacactggcaactggccccataaccacactctgggaaggtagcccaggcaaattttggaatacgaccattgctgtttcgatggccaacatcttcagagggtcttacctggccggagcgggcttagctttttccattatgaaaagcgtggggactggaaaaaggggcacaggttcacaaggggagacccttggagaaaagtggaagaaaaagctgaatcagctcagtcggaaagagttcgatctatataagaaatctggcatcactgaagtcgaccgaacagaggcaaaggagggtctgaaaagaggcgaaaccacgcatcacgccgtgtcccgcgggagcgctaagttgcagtggtttgtagagaggaacatggtgatacccgaaggacgggttatcgatctgggctgtgggcgtggaggctggtcatactattgcgccggtctcaagaaagtgaccgaggtcagagggtacacaaagggaggccctggccacgaggaaccggtgcccatgagtacttatgggtggaatattgtcaaacttatgagcggaaaggacgtgttctacctgccacctgagaaatgtgataccttgctgtgcgacatcggtgaatcctctcccagccctacagttgaggaatccaggactattcgcgtactcaagatggtggagccatggttaaagaacaatcagttctgtatcaaaattctgaacccctacatgcctaccgtcatcgagcatcttgaacggctgcaacgaaagcacggcgggatgctagtgagaaatccactctcaaggaactctacacatgagatgtattggataagtaatggaaccggcaacattgttgcatcggtgaatatggtcagccgcctgttgctgaaccggtttactatgacgcacagacgtcccacaatcgaaaaagatgtggacctcggtgccgggaccaggcacgtaaacgctgagccggaaactcctaatatggacgtgatcggagagcggattaagcgcataaaagaggaacataactccacctggcactacgatgacgagaatccatataagacatgggcgtaccatggctcttatgaagttaaggccacgggctcagcaagctccatgatcaacggggtcgtgaaacttctgaccaagccctgggatgtggtccctatggttactcagatggctatgacagacaccactccattcggacagcaacgagtgtttaaagagaaggtagatacaagaacccccaggagtatgccgggtacacggcgcgtgatgggcattactgccgaatggttatggagaaccctggggaggaataaaaagcctcgattgtgcacgcgggaggagttcaccaagaaagtccgtacaaacgcagccatgggagctgtgtttactgaagagaatcagtgggactctgccaaggcggcagttgaagatgaggacttctggaaactcgtggatagagaacgcgagctgcacaagctaggcaaatgtggtagctgcgtctacaacatgatggggaagagggagaagaaacttggagaatttggcaaagccaaaggctcacgggctatctggtatatgtggctgggggccagatacctcgagttcgaagcactgggatttttgaatgaggaccattggttctcccgcgagaacagttacagcggtgtggaaggcgaggggctgcacaagctcggatatattcttagggatatctctaaaatacccggcggtgctatgtacgccgacgacaccgctgggtgggatacacgaatcactgaagacgatctgcacaatgaggaaaagattacccagcagatggacccagagcatcggcaattagccaacgcaatctttaaactgacgtatcagaataaggtagttaaggtgcagagacctacacccaccggaactgtcatggatattatctccaggaaagaccagcgcggctcaggccaagtggggacatacggattgaacaccttcactaatatggaggcgcagctcatacgtcagatggaaggtgagggcgtgctgagcaaggccgatctagaaaacccacaccttcccgagaaaaagattacccagtggctggaaacaaaaggggtcgagcggctcaagagaatggctatctcgggagacgattgcgttgtgaagcctatcgacgataggtttgccaacgcactgttggctttaaatgacatgggcaaagtacgcaaggatattccacaatggcagccgtctaaaggttggcatgactggcaacaggtgcccttctgtagtcaccacttccatgagctgataatgaaggacgggcgaaaactcgtcgtgccttgccggccacaagatgaacttatcggaagggccaggatttcccagggcgcaggctggagcctgcgcgagacggcctgtctagggaaggcgtatgctcagatgtggtcactgatgtactttcacagacgggacctcaggttggcctccaacgcaatctgctctgccgttcccgtgcattgggtccctaccagccgtactacatggagtattcacgctcatcaccaatggatgaccactgaagatatgctgacagtgtggaatcgagtatggatcgaggacaacccatggatggaagataagacccccgttacgacatgggaggacgtgccttatcttggaaaacgcgaggatcagtggtgtggttccctgataggcctcaccagcagagccacttgggcacagaatatcccgaccgctattcagcaagtccggtctttaatcgggaacgaagagttcctggactacatgccatcaatgaagaggtttcgcaaagaagaggagagtgaaggagccatttggtga

SEQ ID NO: 15149 - RNA, 9873 nt, synthetic construct
  misc_feature 1..9873: note = derived and/or modified CDS sequence (opt3) from DENV-3__FJ850094__SS-prME
  source 1..9873: mol_type = other RNA
accagcctgtgcctcatgatgatccttcccgccgctctggcattccacttgacttccagagacggcgaacctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgaaccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactggcacaccaacgtggaataggaaagaacttctggtaacctttaagaacgcacacgctaaaaagcaagaggttgtggtcttgggatcccaggaaggcgccatgcacactgctctcacaggggccaccgagattcaaaattcaggaggtacaagtatattcgcaggccatctgaagtgtcggttaaaaatggacaagctggaactaaaagggatgagctacgccatgtgcactaacacctttgtgctcaagaaagaggtctctgagacgcagcacggaaccatcctgattaaggtggaatacaagggcgaggatgctccctgtaaaatccctttctccacagaagacggtcaagggaaggcgcataacggccgtcttataactgcaaatccagttgtgaccaaaaaggatgagcccgtaaacattgaggccgaaccgcctttcggagagtcaaatatcgtcatcggcattggggacaacgctttgaaaatcaattggtataagaagggaagcagtattggtaaaatgtttgaagccacagcacgcggcgccagaaggatggctatactgggggatactgcctgggacttcggatctgtgggcggtgttctcaactccctggggaagatggtgcaccagatctttggcagcgcatacaccgcgcttttctcgggagtctcttgggtgatgaaaattggcatcggggtactgttgacgtggatcggactcaattccaagaacacatcaatgagttttagctgcattgctataggcatcattaccctgtatttaggtgccgtggttcaggcagatatggggtgtgtcgtgaattggaaaggaaaggagctgaagtgcggctccggtatcttcgtgactaacgaagtccatacatggaccgagcagtacaaatttcaagccgactctcccaagcggctagctactgccattgcaggcgcttgggagaatggggtttgtggaatccgaagcaccacacgcatggaaaacctcctgtggaaacagatagccaatgagcttaactatatcttgtgggaaaataacattaagctgacggtggtggtaggcgataccatcggggtcctcgagcagggaaaaagaactctgacaccacagcctatggaattaaagtactcatggaaaacctggggcaaggcgaagattgtgacagccgagactcaaaacagttccttcatcatagacggtcccaataccccagagtgccccagcgcttctagggcatggaacgtttgggaagtggaggactatgggtttggagtcttcacgacaaatatttggctgaaacttcgggaagtgtacacccagttgtgtgatcaccgcctcatgtcagccgctgttaaggacgagagagccgtgcacgcagatatgggctactggatcgaaagtcagaaaaacggtagctggaagctggagaaagcgtccctaattgaggtaaagacttgcacctggcctaagtctcatacactgtggtcgaatggcgtcctcgaaagcgacatgatcataccaaaatccctggccgggccgatctcacagcacaactataggcccggataccatactcaaaccgctggcccttggcaccttgggaagttggagctggattttaattattgcgaaggaacaacggtggtgattaccgagaactgtggcactcgtggtccaagtttacggacaaccactgtctctgggaaactcatccacgagtggtgctgtcgaagctgcacactgccccctcttagatacatgggagaagacggctgttggtatggtatggagattaggccaatctccgaaaaggaggaaaatatggttaaatcactggtgagcgccggctctgggaaggtagataacttcaccatgggagtgttgtgcctcgcaatactgtttgaggaggtcatgcgcggcaagttcgggaaaaagcatatgattgctggagtgttctttacgttcgttctactgctctccggccagatcacttggcgggacatggcccacaccctgatcatgattggtagtaatgcaagcgatagaatggggatgggagtgacataccttgccttgatcgctacctttaaaattcagcccttcctggcgttaggctttttcctcaggaagctgacttctcgcgaaaaccttctgctaggcgtcgggctcgccatggcaacaaccctgcaattgccggaggacatagaacagatggctaatggaatcgccctgggtttaatggccctcaaactgattacacagtttgagacttatcagctttggaccgctctgatctccttgacgtgttcaaacacaatgttcaccctcactgtggcatggcgaaccgccacactgattctagcgggcgttagtctgcttcctgtgtgccaaagctcgtccatgcggaagactgattggctcccaatggctgtcgccgcaatgggggtaccccctctgcccttgtttatcttctctctgaaggacacctttaaacgtagaagctggccattaaatgaaggagtgatggccgttggcctcgtgtcaatactggctagttcccttctgaggaacgatgtccctatggcaggtcccttggtggccgggggactcctgatcgcgtgttacgtaattacgggcacatctgctgacctaaccgtggagaaggccgcagacatcacttgggaggaagaggccgaacagacaggcgtcagccataacctgatgattaccgttgatgacgatgggactatgcgcatcaaagacgatgagacagaaaatatacttaccgtgctcctgaagacggctttgttaattgtgtccggagtcttcccatactcaatcccggccactctgctcgtgtggcacacctggcagaaacagacacaacggagcggtgttctgtgggacgtacctagtcccccagagacccagaaggcagagcttgaagagggcgtgtatagaatcaaacagcaggggatttttggaaagacacaagtcggcgtgggtgttcagaaggaaggggtgttccatactatgtggcacgtcaccaggggagctgtgctgacgtacaacggcaaacgattggagcccaattgggcctctgtaaagaaagatctaatatcctatggcgggggatggcgcctgagcgcgcagtggcaaaagggtgaggaagtccaggtgatcgccgttgagcctggcaaaaacccaaagaatttccagacaatgcccgggacttttcagaccacaaccggagaaattggcgcaatcgctctcgacttcaagcctggtacttcggggtcaccgattatcaaccgggagggaaaagtggtcggcctgtacggcaatggggtggttaccaagaacggaggttatgtgtctggcatagcccaaacaaatgctgaaccagatgggcccacgcctgagcttgaggaagagatgtttaaaaagagaaacttaactatcatggacctgcacccaggaagtggcaaaaccaggaagtacctccccgcaattgtccgtgaagccatcaagcgccggttgagaacactgattctcgcccctaccagggtggtagctgcggagatggaagaggcactgaaaggtcttccgatccgatatcagactacagccaccaagtccgagcatacggggcgggaaatagtggatctgatgtgccacgctactttcacaatgcgcttgctaagccccgttagagtcccaaattacaacctgattatcatggacgaggcccattttaccgatcctgcatctatcgccgctaggggatacattagcacccgggtgggcatgggcgaagcggccgcaatcttcatgactgctacacccccagggaccgccgacgcatttcctcagtccaatgcccccatacaggacgaggaacgagatattccagagagatcatggaacagtggaaatgagtggatcacagacttcgctggtaaaactgtgtggtttgtcccgagcattaaggccggcaacgggatcgcgaactgtctccgcaaaaatggaaagaaggtaatacaattatctaggaaaacgttcgataccgaatatcagaagacaaaactgaacgactgggattttgtggttactaccgacatttccgagatgggcgcaaatttcaaggccgatcgtgtgatcgaccctcggagatgccttaaacccgtcatcctgacagatggtccagaaagggtgattctcgctgggcccatgcctgttaccgccgcttcagcagcccagcgccgaggcagagtgggacggaacccacagaaggagaatgaccaatacatcttcactggccagcccttgaacaatgatgaggaccacgctcattggacggaagccaagatgctgctcgacaacattaatacccctgaggggataatcccggcactgtttgaaccagagagggagaagagtgcggccattgatggagagtatcgccttaagggtgagagccgtaaaacattcgtcgaactaatgagacggggcgacctgcccgtgtggttggctcacaaggtagcctccgaggggatcaaatacactgataggaagtggtgctttgacggacagcgcaacaatcagatcttagaagagaacatggatgtggaaatttggaccaaagagggcgagaagaagaaactgcgacctagatggctcgacgcacggacatattctgatcccctggctcttaaggagttcaaagactttgccgcaggtaggaagtcgatagccctggatctcgttaccgagatcgggcgcgtcccaagccacttggctcatagaactaggaatgcgctggacaacctagtgatgctgcacacatcagaacatggcggacgggcctaccgtcacgcagtggaggaactccctgagacgatggagacccttctgttattgggcctgatgattctcctgactgggggagctatgcttttcctgatctccggtaaaggcattgggaagacaagtatcggactcatatgtgtcatcgcctctagcggcatgttgtggatggccgaaattcccctgcaatggatcgcatccgctattgttttagagtttttcatgatggtgctactgatcccagaacctgagaagcagcgcaccccgcaggataatcaactcgcctatgtagtgataggtattcttaccctggcggctatcattgccgcaaacgagatggggttgctggaaacaactaaacgagacctcggcatgtcaaaggagcccggagtcgtgtctccaacgagctacctggatgttgaccttcaccctgccagtgcttggaccctctacgcagtggccacaactgtcatcacccccatgctgagacatacaatagaaaattccaccgcgaacgtcagcttggctgccatcgcaaaccaggccgtggttctgatgggcttagacaaagggtggccaatttctaagatggatctaggagtgcctctgctcgctcttggctgctattcacaggtcaatcccctgactttgacggccgcagtgctgctcctgatcacacactacgctattatcggtccggggcttcaggccaaagcgaccagggaggcccaaaagcggactgcagctggaataatgaagaacccaaccgtcgacggcattatgacaatcgatttagaccctgtgatctatgattccaaatttgaaaagcagctgggtcaggttatgctcttggtgctgtgtgccgtacagctactgctcatgcgcacaagttgggcactttgcgaggctctgaccttggccacaggccccattacgaccctgtgggaggggagcccaggaaaattctggaatactacaatcgccgtgtcgatggcgaacatatttagaggctcttacctcgctggggcaggactggccttctccattatgaaaagcgtcggcaccggtaaaagggggactggatcacaaggcgaaacattaggtgagaagtggaagaagaaacttaatcagctgagtcggaaagaatttgacctctataagaaatctggcatcaccgaggttgatcgaacggaagctaaagaggggctaaaaagaggagagaccacacatcacgccgtgtcccgcggcagcgcaaagctgcagtggttcgtcgaaaggaacatggtgattcccgaggggcgggtaatcgacttgggatgtggccgtggtgggtggtcatactattgcgccggactgaagaaagtgactgaagttagaggctacaccaagggcgggcctggacatgaggaaccggtgcccatgagtacatacggttggaatatagtcaaactcatgagcggcaaggatgtgttctatcttccacctgagaaatgtgacactctgttgtgcgatatcggggagtcctctcccagccctaccgtcgaagagtccaggacaattcgcgtgctgaagatggttgaaccatggctcaagaacaatcagttttgtatcaaaattttaaacccctacatgcctaccgtaatcgagcacctggagcggcttcaacgaaagcacggaggcatgctggtgagaaatccactatcaaggaactctactcatgaaatgtattggattagtaatggtacggggaacatcgtcgcttcggtgaatatggttagccgcctcctgttgaaccggttcacaatgacccacagacgtcccactatagagaaagacgtggatctgggagcgggcaccaggcatgtcaacgccgaaccggagacacctaatatggacgtgattggcgaacggatcaagcgcatcaaagaggagcacaactccacgtggcactacgacgatgaaaatccatataagacctgggcataccatgggtcttatgaggtaaaggctactggatcagccagctccatgattaacggtgtggttaaactccttacaaagccctgggacgtcgtgcctatggtgacccagatggcaatgactgatacaaccccatttggccagcaacgagtcttcaaagaaaaggttgacacaagaactcccaggagtatgccggggacccggcgcgtgatgggaataacggccgagtggctgtggagaaccttaggcaggaataaaaagcctcgactgtgcacacgggaagagtttactaagaaagtacgtaccaacgctgccatgggtgcggtgttcacagaggaaaatcagtgggattctgcaaaggccgctgtcgaggacgaagatttttggaaattggtggacagagagcgcgaactccacaagctggggaaatgtggaagctgcgtttacaacatgatgggcaagagggagaaaaagctaggcgagttcgggaaggccaaaggatcacgggcaatctggtacatgtggcttggtgctagatatctggaatttgaggccctcggcttcctgaatgaagatcattggttttcccgcgagaacagttacagcggggtggagggagaaggcttgcacaagctgggttatattctcagggacatctctaaaattcccgggggagctatgtacgccgatgacactgcaggctgggacacccgaatcacggaggatgaccttcataatgaagagaagataacacagcagatggatccagaacaccggcaactggcgaacgccatcttcaaattaacctatcagaataaggtcgtgaaggtacagagacctactcccacaggcaccgttatggacattatctccaggaaagatcagcgcgggtcaggacaagtgggtacttacggcctgaacacctttacaaatatggaggctcagttgattcgtcagatggagggggaaggagtcctcagcaaggccgacctggagaacccacacctacccgagaagaagatcacgcagtggcttgagaccaaaggcgtggaacggctgaagagaatggcaatatcgggtgatgactgcgtggtcaagcctattgatgacaggttcgctaacgccctcctggcattgaatgatatggggaaagttcgcaaggacatcccacaatggcagccgtctaaaggatggcatgattggcaacaggtgcccttctgtagtcaccattttcacgagttaatcatgaaggacggccgaaaactggtagtgccttgccggccacaagacgagctcattggcagagccaggatatcccagggggcgggatggagccttcgcgaaactgcttgtctgggtaaggcctatgcacagatgtggtcactaatgtacttccacagacgggatctgaggctcgcctccaacgctatctgctctgccgtccccgtgcattgggttcctacaagccgtaccacttggagtattcacgcacatcaccaatggatgacaaccgaggacatgttgacggtgtggaatcgagtctggatcgaagataacccatggatggaggacaagacacccgtgaccacttgggaagatgtaccttacctgggcaaacgcgaggaccagtggtgtgggtcccttattggactgaccagcagagctacatgggcccagaatatcccgactgcgatacagcaagttcggtctctcatcggcaacgaggaatttttagattatatgccatcaatgaagaggttccgcaaagaggaagagagtgagggtgctatttggtga

SEQ ID NO: 15150 - RNA, 9873 nt, synthetic construct
  misc_feature 1..9873: note = derived and/or modified CDS sequence (opt3) from DENV-3__FJ898446__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagcccatagagggaaaagtggtccagtatgaaaatctgaagtacacagtgattatcactgttcacaccggtgaccagcatcaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaaaaacaaggcgtggatggtgcacaggcagtggtttttcgatctccccctgccttggacaagcggggccaccactgaaacaccaacgtggaatcggaaagagcttctggtaacctttaagaacgcacatgctaaaaagcaagaagttgtggtcttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtgctcaagaaagaggtctctgaaacgcagcatgggaccatcctgattaaggtggagtacaagggagaagatgctccctgtaaaatccctttctccacagaggacggccaaggtaaggcgcacaacgggcgccttataactgcaaatccagttgtgaccaaaaaggaggaacccgtaaacattgaggccgaaccgcctttcggcgagtcaaatatcgtcatcggaacaggcgataacgctttgaaaattaattggtataagaaggggagcagtatcggaaaaatgtttgaaactaccgccagaggtgcaaggcggatggccattctgggcgacacggcttgggatttcgggtctgtgggaggcgttctcaactccctgggtaagatggtgcatcagatatttgggagcgcctacacagcacttttctcgggcgtctcttgggtgatgaaaatcggaattggcgtactgttgacctggatcgggctcaattccaagaacacttcaatgagttttagctgcatcgcgattggaataatcacactgtatttaggcgctgtggttcaggccgacatgggttgtgtcattaattggaaagggaaggagctgaagtgcggatccggcatcttcgtgaccaacgaggtgcacacttggaccgaacagtacaaatttcaagcagattctcccaagcgactagccacagctattgccggtgcatgggagaatggcgtctgtgggatccgcagcacgaccagaatggaaaacctcctgtggaaacagatagctaatgagcttaactatatcttgtgggaaaataacattaagctgactgttgtggtgggagacatcattggcgtactcgagcaggggaaaaggacactgaccccacagcctatggagttaaagtactcatggaaaacatggggaaaggccaagatcgtcactgcggaaacccaaaacagttccttcataattgatggccccaatacgccagagtgccccagcgcctctcgggcttggaacgtgtgggaagttgaggactatggttttggggtgttcacaaccaatatctggctgaaacttcgcgaagtctacactcagttgtgtgaccatagactcatgtcagcagccgtgaaggatgagagggctgttcacgccgacatgggatactggattgagagtcagaaaaacggcagctggaagctggaaaaagcatccctaatcgaggtgaagacctgcacatggcctaagtctcacactctgtggtcgaatggtgtactcgaaagcgatatgataatcccaaaatccctggcgggcccgatttcacagcataaccaccgtcccgggtatcatacccaaacagccggaccttggcaccttggcaagttggagctggactttaattactgcgaggggacgaccgtcgtgatcactgaaaactgtggaacacggggcccaagtttacgaaccactacagtgtctggtaaactcattcacgagtggtgctgtagaagctgcaccctgccccctcttaggtatatgggggaagatggatgttggtacggcatggagatccgcccaatatccgaaaaggaggagaatatggtcaaatcactggttagcgctggttctggcaaggtggacaacttcacgatgggggtattgtgcctcgccattctgtttgaagaggtgatgcggggaaagttcggcaaaaagcatatgatcgcaggggtcttctttactttcgtgctactgctctccggacagatcacctggagagatatggctcacacactgattatgatcggcagtaatgccagcgacaggatgggtatgggggttacctatcttgcattgattgccacttttaaaatacagcccttcctggctttaggatttttcctccgcaagctgacatctcgagaaaaccttctgctaggcgtgggcctcgcgatggccaccacactgcaattgccggaggatatcgaacagatggcaaatgggattgctctgggattaatggccctcaaactgatcactcagtttgagacctaccagctttggacggccctgatttccttgacatgttcaaacaccatgttcactctcaccgtcgcttggcggacagcaactctgatcctagccggtgtgagtctgcttcctgtttgccaaagctcgtccatgcgtaagaccgactggctcccaatggcggtggctgccatgggcgtcccccctctgcccttgtttatattctctctgaaggatacgttaaaaagaaggagctggccactcaatgagggggtaatggcagtgggactggtttcaatccttgccagttccctgttgcgcaacgacgtgcctatggctggccccctcgtcgcaggtgggctgctaattgcctgttatgtgatcacaggaacctctgcggatctgactgtagaaaaggctgccgacattacatgggaggaagaggcagaacagaccggcgtgagccataaccttatgatcactgtcgacgatgacggcacaatgcggataaaagatgacgagaccgagaatattctcacggttctgttgaagactgccttactgatcgtgtccggggtgtttccatactcaatcccggctaccctcctggtctggcacacatggcagaaacagacccaaagaagcggagtgctttgggatgttcctagtcccccagaaacacagaaggccgagctggaagagggtgtatacaggattaaacagcagggcatattcgggaagactcaagtgggagtcggcgtgcagaaggagggtgtttttcataccatgtggcacgtgacgcgaggggcagtcttgacatataacggaaaacgcctagaacccaattgggcttctgtgaagaaagacctgatctcctacggcggcgggtggcggctcagcgcccagtggcaaaagggagaggaagtacaggtcattgcggtggagcctggtaaaaacccaaagaatttccagactatgcccggcaccttccagacaaccactggggaaatcggagccattgcactggattttaagcctggcacctcgggttcaccgatcataaacagagaggggaaagttgtgggactttatggcaatggcgtcgtgacaaagaacgggggatacgtttctggtatcgctcaaacgaatgccgagccagacggccccactcctgaattagaggaagagatgttcaaaaagaggaacctgaccattatggatctccacccagggagtggaaaaacacgtaagtatttgcccgctatcgtgcgcgaagcaattaagcggagactgaggaccctcatcctggcccctactcgagtcgtggccgctgagatggaggaagcgcttaaaggcctgccgatacggtaccagacaaccgcaacgaagtccgagcatactggtcgcgaaattgtagacttgatgtgccacgccacatttaccatgagactactgagccccgtgagggttccaaattataacctcatcatcatggatgaggctcatttcaccgaccctgcctctattgcagcccgggggtacatcagcactcgagtcggaatgggcgaagctgcggccatatttatgacagcaacccccccaggcacagctgatgccttccctcagtccaatgcacccattcaggacgaggagagagacatcccagaacgctcatggaacagtgggaatgagtggattactgattttgccggaaaaacggtgtggttcgtgccgagcatcaaggctggtaacgacatagccaactgtttaaggaaaaatggcaagaaggtcattcaactgtctcgtaaaacctttgatacagaataccagaagactaaacttaacgactgggatttcgtagtgaccacagacatctccgagatgggggcgaattttaaggcagatcgggttatcgaccctagaaggtgcctgaaacccgtgattctcaccgatggaccagagcgcgtcatcttggccggccccatgcctgtgactgctgcctcagctgcacagcgaagaggtcgggttgggaggaacccacagaaggaaaatgaccaatatattttcacgggccagcccctgaacaatgatgaggaccacgcccattggaccgaagctaagatgctcctggacaacataaatacacctgagggaatcattccggcccttttcgaaccagagcgcgagaaaagtgcagcgatcgatggcgaataccgtctaaagggggagagcagaaaaacttttgtggaactgatgcggaggggagacttgcccgtctggttagcccacaaggtggcttccgagggtatcaaatataccgatcgcaagtggtgcttcgacggccagcgaaacaatcagattctggaagagaacatggatgtagagatatggacaaaagaaggggagaagaagaaactcagacctcggtggctggacgccaggacctactctgatccccttgcactgaaggaatttaaagacttcgctgccggacgcaagtcgatcgcactcgatttggtgactgagattggcagagttccaagccacctggcccataggacacggaatgctctagacaacctggtcatgctccacacgtcagaacatggtgggcgtgcgtatcgccacgccgtggaggagcttcctgaaaccatggagactctgttattgctgggcctcatgatcctgcttacaggaggcgcaatgctgtttctcatttccgggaaaggaatcggtaagaccagtataggcttgatctgtgtgattgcttctagcgggatgctgtggatggccgaaatccccttacaatggattgcctccgcaatcgtcctagagttctttatgatggttctgctcataccagagcctgaaaagcagcgaaccccgcaggataatcaacttgcttacgtggtaattggaatcctgacattggccgcgattatcgctgccaacgagatgggcctgctcgaaactacgaaaagagacctgggtatgtcaaaggagcccggggtggtctctccaaccagctatcttgatgtggacctccaccctgcaagtgcctggacactgtacgctgttgcaactaccgtgataacacccatgttgaggcataccatcgaaaattccactgccaacgtcagcctggcggctattgccaaccaggcagtagtgttaatgggcctagacaaaggatggccaatctctaagatggatctgggcgttcctctccttgccctggggtgctactcacaggtgaatcccttgacgctgacagctgccgtcctcctgcttattacccactatgcaatcataggaccgggcttacaggctaaagccactcgggaggcgcaaaagcgcaccgccgcaggtattatgaagaacccaacagtggacgggatcatgactatcgatctggaccctgtcatttacgattccaaattcgagaagcagctcggacaggtgatgttgctggttctatgtgctgtgcagctgctccttatgagaaccagttgggccctgtgcgaagcattgacactggctacgggccccatcaccactctctgggagggtagcccaggcaaattttggaatacaaccatagccgtatcgatggccaacattttcagggggtcttatctggcgggagctggcttagcattttccatcatgaagagcgtggggactggaaaacggggcacaggttcacaaggggaaacccttggagagaagtggaagaaaaagctgaatcagctcagtcgaaaagaattcgacctatacaagaaatctggcattacggaggtcgatagaaccgaggccaaggaaggtctgaaacgcggcgagatcacacatcacgctgtttccagggggagcgccaagttgcagtggtttgtggaacggaacatggtcatacccgagggacgtgtgatcgacctgggctgtgggagaggaggctggtcatattactgcgcaggtctcaagaaagtaactgaagtgagggggtataccaagggaggccctggccatgaggagccggttcccatgagtacatacgggtggaatattgtgaaacttatgagcggaaaggatgtcttctacctgccacctgaaaaatgtgacactttgctgtgcgatatcggtgagtcctctcccagccctaccgtggaagagtcccgcacaattcgggtcctcaagatggtggagccatggttaaagaacaatcagttctgtatcaaagttctgaacccctatatgcctaccgtaattgaacaccttgagcgactgcaaagaaagcacggcgggatgctagtgaggaatccactctcacgcaactctactcatgaaatgtactggatcagtaatggaacgggcaacatagtcgcctcggtgaatatggttagccggctgttgctgaacagatttacaatgacccaccgtaggcccactattgagaaagacgtggatctcggtgctgggacccggcatgtcaacgcggaaccggagacacctaatatggacgtgatcggagagcgcatcaagcgaattaaagaagagcacaactccacgtggcactatgacgatgaaaatccatacaagacctgggcctatcatggctcttacgaggtaaaggcaactggctcagctagctccatgataaacggggtggttaaacttctgacaaagccctgggacgtcgtgcctatggtgacccagatggccatgactgatacaaccccattcggacagcaaagagtctttaaagaaaaggttgacacaaggactccccggagtatgccgggtacccgcagagtgatgggcatcacggcagagtggttatggaggaccctggggcgaaataaaaagcctcggttgtgcacacgtgaggaattcactaagaaagtaagaaccaacgccgctatgggagccgtgtttacagaggaaaatcagtgggattctgcgaaggcagccgtcgaggacgaagatttctggaaactcgtggaccgcgagagggagctgcacaagctaggcaaatgtggtagctgcgtttataacatgatggggaagcgggaaaaaaagcttggagagtttggcaaggctaaaggctcaagagccatttggtacatgtggctgggggcacgctacctcgaattcgaggctctgggatttttgaatgaggatcattggttctccagggaaaacagttatagcggtgtggagggcgaagggctgcacaagctcggatacatccttcgagacatttctaaaatccccggcggtgccatgtatgctgatgacactgccgggtgggacacccggataacggaggatgacctgcataatgaagagaagatcacacagcagatggatccagagcacagacaattagcaaacgcgatttttaaactgacctaccagaataaggtcgtgaaggtacagaggcctactcccacaggaaccgttatggacatcatttcccgcaaagatcagcgtggctcaggccaagtggggacttatggattgaacaccttcacaaatatggaagcccagctcatccggcagatggagggtgaaggcgtcctgagcaaggctgacctagagaacccacaccttcccgaaaaaaagataacgcagtggctggagaccaaaggggtggagagactcaagaggatggccatttcgggagatgactgcgtggtcaagcctatcgatgaccgctttgcaaacgctctgttggccttaaatgatatgggcaaagttcgaaaggacatcccacaatggcagccgtctaaaggttggcatgattggcagcaggtgcccttctgtagtcaccatttccacgaactgattatgaaggacgggcggaaactcgtagtgccttgcagaccacaagacgagcttataggaagggcacgcatctcccagggcgccggctggagcctgagagaaactgcgtgtctagggaaggcttacgcccagatgtggtcactgatgtattttcaccggagggatctccgtttggcatccaacgccatttgctctgctgtccccgtgcattgggttcctacaagccgaaccacttggagtatccacgcccatcaccaatggatgacaaccgaggacatgctgacggtgtggaatcgcgtctggattgaagataacccatggatggaggacaagacacccgtgaccacttgggagaatgtaccttaccttggaaaaagagaagatcagtggtgtggttccctgatcggcctcaccagccgggcaacatgggctcagaacataccgactgccatccagcaagttaggtctttaattgggaatgaggaattcctggactacatgccatcaatgaagcgctttagaaaagaggaggaaagtgagggagcgatctggtga

SEQ ID NO: 15151 - RNA, 9873 nt, synthetic construct
  misc_feature 1..9873: note = derived and/or modified CDS sequence (opt3) from DENV-3__GU131844__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagctgatagagggaaaagtggtccagtatgaaaatctcaagtacacagtgattatcactgttcacaccggtgaccagcatcaggtgggcaacgagacacaaggggtcaccgcagaaattactccccaggcttccacgacagaggccatccttcctgaatatggaaccctgggcttggagtgctctccaagaactggtctagacttcaatgagatgatcctgctcaccatgaaaaacaaggcgtggatggtgcacaggcagtggtttttcgatctgccgcttccctggacaagcggggccaccactgaaacacctacgtggaatcggaaagagctgttggtaacctttaagaacgcacatgctaaaaagcaagaagttgtggtcctcggctcccaggagggagccatgcacactgctctgacaggcgccaccgaaattcagaattcagggggaacaagtatattcgcaggtcacttaaagtgtcgtctgaaaatggacaagctagagctcaaaggcatgagctacgccatgtgcactaacacctttgtgctgaagaaagaggtctctgaaacgcagcatgggaccatccttattaaggtggagtacaagggagaagatgctccatgtaaaatccccttctccacagaggacggccaaggtaaggcgcacaacgggcgcttgataactgcaaatcctgttgtgaccaaaaaggaggaaccagtaaacattgaggccgaacccccgttcggcgagtcaaatatcgtcatcggaacaggcgataacgctctgaaaattaattggtataagaaggggagcagtatcggaaaaatgtttgaagccactgcaagaggtgccaggcggatggctattctcggcgacaccgcctgggatttcgggtctgtgggaggcgttctgaactcccttggtaagatggtgcatcagatatttgggagcgcatacacggcgctgttctcgggcgtctcttgggtgatgaaaatcggaattggcgtattgctcacatggatcgggctgaattccaagaacacctcaatgagttttagctgcatcgctattggaataatcactttatatctgggcgccgtggttcaggcagacatgggttgtgtcattaattggaaagggaaggagctaaagtgcggatccggcatcttcgtgacaaacgaggtgcacacctggactgaacagtacaaatttcaagccgattctcctaagcgactcgctaccgccattgcaggtgcttgggagaatggcgtctgtgggatccgcagcacaacgagaatggaaaacctgctttggaaacagatagccaatgagttgaactatatcctgtgggaaaataacgttaagctcaccgtggtggtaggagacattatcggcgtcctggagcaggggaaaaggactttaacaccccagccaatggagctgaagtactcatggaaaacctggggaaaggcgaagattgtgacagccgaaactcaaaacagttccttcatcatagatggccctaatacccccgagtgcccaagcgcttctcgggcatggaacgtttgggaagtggaggactatggttttggggtcttcacgacaaatatttggcttaaattgcgcgaagtgtacacccagctctgtgaccatagactgatgtcagccgctgttaaggatgagagggccgtgcacgcagacatgggatactggatcgagagtcagaaaaacggcagctggaagctagaaaaagcgtccctgattgaggtaaagacttgcacctggcccaagtctcacacactctggtcgaatggtgtcctggaaagcgatatgatcatacctaaatcccttgccggcccaatctcacagcataaccaccgtccggggtatcatactcaaaccgctggaccctggcacttgggcaagctggagttagactttaattactgcgaggggacaacggtggtgattaccgaaaactgtggaactcggggccctagtctccgaacaaccactgtctctggtaaactgatccacgagtggtgctgtagaagctgcacacttccacccctgaggtatatgggggaagatggatgttggtacggcatggagattcgccctatctccgaaaaggaggagaatatggttaaatcattggtgagcgccggttctggcaaggtagacaacttcaccatgggggtgctctgcctggcaatactatttgaagaggtcatgcggggaaagttcggcaaaaagcatatgattgctggggtgttctttacgttcgttctgctcctgtccggacagatcacttggagagatatggcccacacccttatcatgattggcagtaatgcaagcgacaggatgggtatgggggtgacatatttggccctgatcgctacctttaaaattcagccattcttagcgctcggatttttcctgcgcaagcttacttctcgagaaaacctgctactcggcgtcggcctggccatggcaacaaccttgcaactgcccgaggatatagaacagatggctaatgggatcgccttaggactcatggccctgaaacttattacacagtttgagacttaccagctgtggaccgctttgatctccctcacgtgttcaaacacaatgttcaccctgactgtggcatggcggaccgccacactaattctggcgggtgttagtcttctcccggtgtgccaaagctcgtccatgcgtaagactgactggctgcctatggctgtcgccgcaatgggcgtaccacccttgcctctgtttatcttctctttaaaggataccctcaaaagaaggagctggcccctgaatgagggggtgatggccgttggacttgtgtcaatactggctagttccttgctccgcaacgacgtcccaatggcaggccctctggtggccggtgggctactgatcgcgtgttatgtaattacgggaacatctgctgatcttaccgtggaaaaggccgcagacatcacttgggaggaagaggccgaacagacaggcgtcagccataacctcatgattaccgttgacgatgacggcactatgcggatcaaagatgacgagacagagaatatactgaccgtgttgttaaagacggctctgctcattgtgtccggggtctttccctactcaatcccagccactctgcttgtgtggcacacctggcagaaacagacacaaagaagcggagttctgtgggatgtaccgagtcctcccgaaacccagaaggcagagttggaagagggtgtgtacaggatcaaacagcagggcattttcgggaagacacaagtcggagtgggcgttcagaaggagggtgtgtttcatactatgtggcacgtcacccgaggggctgtgctaacgtataacggaaaacgcctggaaccaaattgggcctctgtaaagaaagacctcatatcctacggcggcgggtggcggctgagcgcgcagtggcaaaagggagaggaagtccaggtgatcgccgttgagcccggtaaaaaccctaagaatttccagacaatgccaggcactttccagaccacaaccggggaaattggagcaatcgctcttgattttaagcccggcacttcgggttcacctattatcaacagagaggggaaagtggtcggattatatggcaatggcgtggttaccaagaacgggggatacgtgtctggtatagcccaaacaaatgctgagccggacggcccaacgcccgaactggaggaagagatgttcaaaaagaggaacctcactatcatggatttgcaccctgggagtggaaaaacccgtaagtatctgccagcaattgtccgcgaagccatcaagcggagactcaggacactgattcttgcccccacccgagtggtagctgcggagatggaggaagcactgaaaggcttgcctatccggtaccagactacagccaccaagtccgagcatacgggtcgcgaaatagtggacctaatgtgccacgctacttttacaatgagactgctcagcccggttagggtccccaattataacttaattatcatggatgaggcccatttcaccgacccagcatctatcgccgctcgggggtacattagcacccgagtgggaatgggcgaagcggccgcaatctttatgactgctacacctcccggcaccgccgatgcattcccacagtccaatgcccctatacaggacgaggagagagacattcccgaacgctcatggaacagtgggaatgagtggatcacagattttgctggaaaaactgtgtggttcgtcccaagcattaaggccggtaacgacatcgcgaactgtctgaggaaaaatggcaagaaggtaatacaactttctcgtaaaacgtttgataccgaataccagaagacaaaactgaacgactgggatttcgtggttactaccgacatttccgagatgggggcaaattttaaggccgatcgggtgatcgacccgagaaggtgcctcaaacctgtcatcttgacagatggacccgagcgcgtgattctggctggcccaatgcccgttaccgccgcttcagcagcccagcgaagaggtcgggtggggaggaaccctcagaaggaaaatgaccaatatatcttcactggccagccactcaacaatgatgaggaccacgctcattggacggaagccaagatgctgcttgacaacattaatacccccgagggaataatccctgcactattcgaaccggagcgcgagaaaagtgcggccattgatggcgaataccgtctgaagggggagagcagaaaaacatttgtcgaattgatgcggaggggagacttaccagtgtggctggctcacaaggtagcctccgagggtatcaaatatactgatcgcaagtggtgcttcgacggccagcgaaacaatcagatcctcgaagagaacatggatgtggagatttggaccaaagaaggggagaagaagaaactgagaccccggtggcttgacgcaaggacatactctgatcctctggctctcaaggaatttaaagacttcgccgcaggacgcaagtcgatagccttggatctggttaccgagatcggcagagtccccagccacctagctcataggactcggaatgcgctggacaacctcgtgatgcttcacacatcagaacatggtgggcgtgcctatcgccacgcagtggaggagctgccagaaacgatggagaccttattgctgctcggcctgatgattcttctgactggaggcgctatgctctttttgatctccgggaaaggaattggtaagacaagtatcggcctgatatgtgtcatcgcctctagcgggatgttatggatggccgaaattcctctacaatggatcgcatccgctattgttctggagttctttatgatggtgctccttatccccgagccagaaaagcagcgaacccctcaggataatcaactggcctacgtagtgataggaattttgaccctggcggctatcattgccgcaaacgagatgggcctcctggaaacaactaaaagagaccttggtatgtcaaaggagccgggggtcgtgtctcccacgagctatctcgatgttgacctgcacccagccagtgcttggaccttgtacgcagtggccacaactgtcatcacccctatgctgaggcatacaatagaaaattccaccgcgaacgtaagcttagctgccatcgcaaaccaggccgtggttctaatgggcctggacaaaggatggcccatttctaagatggatctcggcgtgccacttctggctttggggtgctactcacaggtcaatcctctgactctcacggccgcagtgctgcttttaatcacacactatgctattatcggacccggcctgcaggccaaagcgacccgggaggcccaaaagcgcactgcagctggtataatgaagaacccgaccgtcgacgggattatgacaatcgatctcgacccagtgatctacgattccaaattcgagaagcagttgggacaggttatgctgctagtgctgtgtgccgcacagctccttctgatgagaactagttgggctttgtgcgaagccctgaccctcgccacaggccctattacgaccctgtgggagggtagccccggcaaattttggaatactacaatcgcggtatcgatggctaacatattcagggggtcttatttagcaggagccggccttgctttttccattatgaagagcgtggggaccggaaaacggggcactggttcacaaggggaaacactgggagagaagtggaagaaaaagctcaatcagctaagtcgaaaagaattcgacctgtacaagaaatctggcatcaccgaggtcgatagaacggaggccaaggaaggtttgaaacgcggcgagattacccatcacgcagtttccagggggagcgccaagctgcagtggtttgtggaacggaacatggtcatcccagagggacgtgtgatagacctcggctgtgggagaggaggctggtcatattactgcgctggtcttaagaaagtaacagaagtgagggggtatactaagggaggccccggccatgaggagcctgttccgatgagtacctacgggtggaatatcgtgaaactgatgagcggaaaggatgtcttctacttgcccccagaaaaatgtgacacactgctctgcgatattggtgagtcctctcctagccccactgtggaagagtcccgcaccatccgggtcttaaagatggtggagccttggctgaagaacaatcagttctgtattaaagttcttaacccatatatgcccacagtaatcgaacacctggagcgactacaaagaaagcacggcgggatgctcgtgaggaatcctctgtcacgcaactctacccatgaaatgtactggattagtaatggaactggcaacatcgtcgcgtcggtgaatatggttagccggttgctgctcaacagatttacgatgacacaccgtaggccaaccatagagaaagacgtggatcttggtgccgggactcggcatgtcaacgcagaacccgagaccccgaatatggacgtgattggagagcgcatcaagcgaatcaaagaagagcacaactccacatggcactatgacgatgaaaatccttacaagacgtgggcttatcatggctcttacgaggtaaaggccaccggctcagcaagctccatgattaacggggtggttaaactgttaactaagccatgggacgtcgtgcccatggtgacacagatggccatgaccgatactacacctttcggacagcaaagagtctttaaagaaaaggttgacaccaggacaccacggagtatgcccggtactcgcagagtgatgggcataaccgctgagtggctgtggaggacgttggggcgaaataaaaagccgcggctctgcacccgtgaggaattcacaaagaaagtaagaactaacgccgcgatgggagcagtgtttaccgaggaaaatcagtgggattctgccaaggctgccgtcgaggacgaagatttctggaaactggtggaccgcgagagggagctacacaagcttggcaaatgtggtagctgcgtttataacatgatggggaagcgggaaaaaaagctgggagagtttggcaaggcaaaaggctcaagagctatctggtacatgtggctcggggcccgctacctggaattcgaggctttgggatttctgaatgaggatcattggttctccagggaaaacagttatagcggtgtggagggcgaagggctccacaagcttggatacattctgcgagacatctctaaaattcctggcggtgccatgtatgcagatgacacagcggggtgggacactcggatcaccgaggatgacttacataatgaagagaagataacgcagcagatggatcccgagcacagacaactggccaacgctatctttaaattgacataccagaataaggtcgtgaaggtacagaggccaacccctactggaacagttatggacattatctcccgcaaagatcagcgtggctcaggccaagtggggacctatggactcaacactttcaccaatatggaagcccagctgattcggcagatggagggtgaaggcgtcctaagcaaggcagaccttgagaacccccacctgccagaaaaaaagatcgctcagtggctcgagacaaaaggggtggagagactgaagaggatggccatatcgggagatgactgcgtggtcaagcccattgatgaccgctttgcaaacgccttgttagcgctgaatgatatgggcaaagttcgaaaggacatccctcaatggcagccatctaaaggttggcatgattggcagcaggtgccgttctgtagtcaccatttccacgaactcatcatgaaggacgggcggaaacttgtagtgccctgcagacctcaagacgagctgattggaagggctcgcatatcccagggcagcggctggtcactaagagaaacggcctgtctggggaaggcatacgcccagatgtggtccctcatgtattttcaccggagggatttgcgtctggcttctaacgccatctgcagcgcagtcccagtgcattgggttcccaccagtcgaactacatggtccattcacgctcatcaccaatggatgaccactgaggacatgcttgccgtgtggaatcgcgtctggatcgaagataacccttggatggaggacaagacaccagtgaccacgtgggagaatgtaccctacctgggaaaaagagaagatcagtggtgtggtagcctcattggcttaacatctcgggcgacctgggctcagaacatccctactgccatacagcaagttaggtcactgatcgggaatgaggaattcttggactacatgccgagtatgaagcgctttagaaaagaggaggaatccgagggagcaatttggtga

SEQ ID NO: 15152 - RNA, 9873 nt, synthetic construct
  misc_feature 1..9873: note = derived and/or modified CDS sequence (opt3) from DENV-3__GU131849__SS-prME
  source 1..9873: mol_type = other RNA
accagcctgtgcctcgtgatgatccttcccgccgctctggcattccacttgacatccagagacggcgagcctaggatgattgtcgggaagaacgaacggggaaaatctttactgtttaagactgcctcaggtataaatatgtgtacgctaatcgcgatggatctcggcgagatgtgcgacgataccgttacatacaaatgtccacatattactgaagtggagccggaagacatcgattgctggtgtaacctgaccagtacatgggtaacctatgggacttgcaatcaggctggagagcgccgacgtgacaagagaagcgtggcccttgcaccccacgtcggcatgggtctggatacaaggacccaaacgtggatgtccgccgagggggcttggcggcaggtggaaaaagttgagacttgggcattgcgccatcctggattcaccattctcgccctgtttctggctcactacatcggcacatctctcactcagaaggtggtcatattcatcttactgatgcttgtgaccccatcgatgacaatgagatgtgtaggcgttgggaacagggactttgtggaaggattgtcaggtgccacctgggtcgatgtggtgctggagcatggcgggtgcgtcacgactatggcgaagaataaacccacactagacattgagctccagaagaccgaagcaactcaactggccacacttcggaaactgtgtatcgagggaaagattaccaacatcacgaccgatagccgctgccctacacagggcgaagctgttttgccagaggaacaggaccagaattatgtgtgtaaacacacttacgtagatcgaggttgggggaacggatgcggcctcttcggcaaggggagtctggtgacctgcgccaagtttcaatgtttagagcccatagagggaaaagtcgtgcagtatgaaaatctgaagtacacagttattatcactgtgcacaccggtgaccagcatcaggtcggcaacgagacacaaggggtgaccgcagaaattactcctcaggcttccacgatcgaggccatcctcccagaatatggaacacttggcctggagtgctctccgagaaccggtttggacttcaatgagatgattctactgactatgaaaaacaaggcgtggatggtacacaggcagtggtttttcgatctccccctgccttggaccagcggggccacaaccgaaactccaacatggaatcggaaagagcttctggttacgtttaagaacgcacatgctaaaaagcaagaagtggtcgtgttgggctcccaggagggagccatgcacaccgctctcactggcgccacagaaatacagaattcagggggaaccagtatcttcgcaggtcacctgaagtgtcgtttaaaaatggacaagctggagctaaaaggcatgagctacgccatgtgcacaaacacttttgtcctcaagaaagaggtgtctgaaacccagcatgggacgattctgatcaaggttgagtaccgcggagaagatgctccctgtaagatacctttctccaccgaggacggccaaggtaaagcgcacaacgggagacttattacagcaaatccagtggtaactaagaaagaggaacccgtcaacatcgaggccgaaccgcctttcggcgagtcaaatatcgtgattggaatcggcgataacgctttgaagattaattggtataaaaaggggagcagtataggaaagatgtttgaagccaccgcaaggggtgcccggcgaatggctatcctgggcgacacagcctgggatttcgggtctgttggaggcgtgctcaactccctgggtaaaatggtccatcagatttttgggagcgcatacactgcgcttttctcgggcgtgtcttgggtaatgaagatcggaatcggcattctgttgacctggatagggctcaattccaaaaacacgtcaatgagttttagctgcatcgctattggaatcattacactgtatttaggcgccgtggttcaggcagacatgggttgtgtcatcaattggaaggggaaagagctgaagtgcggatccggcatattcgtgaccaacgaggtgcacacttggacagaacagtacaagtttcaagccgattctcccaaacgcctagctaccgccatcgcaggtgcttgggagaatggcgtctgtgggattagaagcactaccaggatggaaaacctcctgtggaagcagatcgccaatgagcttaactatattttgtgggaaaataacatcaaactgacagttgtggtgggagacataattggcgtactcgagcaggggaagcggacgctgaccccacagcctatggagttaaaatactcatggaagacttggggaaaagcgaagatcgtcacagccgaaacccaaaacagttccttcattatcgatggccccaatacaccagagtgccccagcgcttctcgcgcatggaacgtgtgggaagttgaggactatggttttggggtgttcactaccaatatatggctgaagcttagagaagtctacacgcagttgtgtgaccataggctcatgtcagccgctgtgaaagatgagcgtgccgttcacgcagacatgggatactggatcgagagtcagaagaacggcagctggaaactggaaaaggcgtccctaattgaggtgaaaacatgcacctggcctaagtctcacactctgtggtcgaatggtgtactcgaaagcgatatgatcattccaaagtccctggccggcccgatctcacagcataaccaccggcccgggtatcatacccaaacagctggaccttggcaccttggcaaattggagctggactttaattactgcgaggggactaccgtcgtgataacagaaaactgtggaacgcgaggcccaagtttaagaaccactacagtgtctggtaagctcattcacgagtggtgctgtaggagctgcaccctgccccctcttcgctatatgggggaagatggatgttggtacggcatggagatccggccaatctccgaaaaagaggagaatatggtcaagtcactggttagcgccggttctggcaaagtggacaacttcactatgggggtattgtgcctcgcaattctgtttgaagaggtgatgagaggaaagttcggcaagaaacatatgatcgctggggtcttctttacattcgtgctactgctctccggacagattacctggagggatatgacgcacactctgataatgatcggcagtaatgccagcgaccgcatgggtatgggggttacctatcttgcattgattgccacatttaagatccagcccttcctggctttaggatttttcctccgaaaactgacctctcgggaaaaccttctgctaggcgtgggcctcgcgatggccactatgctgcaattgccggaggatattgaacagatggcaaatgggatcgctctgggattaatggccctcaagctgataacacagtttgagacctaccagctttggacagccctgatctccttgacttgttcaaacaccatgttcacgctcacagtcgcttggcgtaccgcaactctgattctagccggtgtgagtctgcttcctgtttgccaaagctcgtccatgagaaaaaccgactggctcccaatggcggtggctgccatgggcgtcccccctctgcccttgtttatcttctctctgaaggatacattaaagaggcgcagctggccactcaatgagggggtaatggcagtgggactggtttcaattcttgccagttccctgttgcggaacgacgtgcctatggctggccccctcgtcgcaggtgggctgctaatcgcctgttatgtgataactggaacctctgcggatctgacggtagaaaaagctgccgacattacatgggaggaagaggcagaacagaccggcgtgagccataaccttatgatcactgtcgacgatgacggcacaatgagaatcaaggatgacgagaccgagaatattctcactgttctgttgaaaacagccttactgatagtgtccggggtgtttccatactcaatcccggctaccctcctggtctggcacacgtggcagaagcagactcaaaggagcggagtgctttgggatgttcctagtcccccagaaacccagaaagccgagctggaagagggtgtataccgaattaagcagcagggcatcttcgggaaaacacaagtgggagtcggcgtgcagaaggagggtgtttttcataccatgtggcacgtgacacgcggggcagtcttgacttataacggaaagcggctagaacccaattgggcttctgtgaaaaaggacctgatttcctacggcggcgggtggagactcagcgcccagtggcaaaaaggagaggaagtacaggtcatcgcggtggagcctggtaagaacccaaaaaatttccagaccacgcccggcacattccagactaccacaggggaaataggagccatcgcactggattttaagcctggcacctcgggttcaccgattatcaacagggaggggaaggttgtgggactttatggcaatggcgtcgtgactaaaaacgggggatacgtttctggtattgctcaaaccaatgccgagccagacggccccacacctgaattagaggaagagatgttcaagaaacgtaacctgacgatcatggatctccacccagggagtggaaagactcgcaaatatttgcccgctataattcgggaagcaatcaagagaaggctgcgaaccctcatcctggcccctacacgggtggtcgccgctgagatggaggaagcgcttaagggcctgccgattcgctaccagaccactgcaacaaaatccgagcataccggtagagaaatcgtggacttgatgtgccacgccacgtttactatgaggctactgagccccgtacgggtgccaaattataacctcataattatggatgaggctcatttcacagaccctgcctctatcgcagcccgagggtacattagcaccagagttggaatgggcgaagctgcggccatctttatgaccgcaactcccccaggcacagctgatgccttccctcagtccaatgcacccatacaggacgaggagcgcgacattccagaaaggtcatggaacagtgggaatgagtggatcaccgattttgccggaaagacagtctggttcgtgccgagcatcaaagctggtaacgacattgccaactgtttacgtaagaatggcaaaaaggtgatccaactgtctcggaagacttttgatacggaataccagaaaaccaagcttaacgactgggatttcgtcgtaacaactgacatttccgagatgggggcgaattttaaagcagatagagtgatagaccctaggcgctgcctgaagcccgttatcctcaccgatggaccagagcgagtgattttggccggccccatgcctgtcacagctgcctcagctgcacagagacggggtagggtggggcgcaacccacagaaagaaaatgaccaatatatcttcaccggccagcccctgaacaatgatgaggaccacgcccattggactgaagctaagatgctcctggacaacatcaatacgcctgagggaattataccggcccttttcgaaccagagcgtgagaagagtgcagcgatcgatggcgaatacagactaaaaggggagagccggaagacctttgttgaactgatgaggcgcggagacttgcccgtgtggttagcccacaaagtcgcttccgagggtattaagtatacagatcgaaaatggtgcttcgacggccagagaaacaatcagatcctggaagagaacatggatgtggagatttggactaaggaaggggagaaaaagaagctccggcctaggtggctggacgcccgcacctactctgatccccttgcactgaaagaatttaaggacttcgctgccggaagaaaatcgatcgcactcgatttggtaacagagataggcagggtgccaagccacctggcccatcggacccgtaatgctctagacaacctggttatgctccacacttcagaacatggtgggcgcgcgtatcgacacgccgtcgaggagcttcctgaaacaatggagacgctgttattgctgggcctcatgatcctgcttaccggaggcgcaatgctgtttctcatttccgggaagggaatcggtaaaactagtattggcttgatctgtgtgatagcttctagcgggatgctgtggatggccgaaattcccttacaatggatcgcctccgcaattgtgctagagttctttatgatggtcctgctcatcccagagcctgaaaagcagagaacaccgcaggataatcaacttgcttacgttgtgataggaatcctgaccttggccgcgattatcgctgccaacgagatgggcctgctcgaaaccacaaagagggacctgggtatgtcaaaagagcccggggtagtgtctccaactagctatcttgatgtcgacctccaccctgcaagtgcctggacgctgtacgctgtggcaaccacagttattactcccatgttgcggcataccatcgaaaattccacagccaacgtgagcctggcggctatagccaaccaggcagtcgtattaatgggcctagacaagggatggccaatttctaaaatggatctgggcgtgcctctccttgccctggggtgctactcacaggttaatcccttgaccctgactgctgccgtgctcctgcttatcacgcactatgcaatcattggaccgggcttacaggctaaggccacacgcgaggcgcaaaaaagaaccgccgcaggtatcatgaagaacccaactgtcgacgggataatgaccattgatctggaccctgtgatctacgattccaagttcgagaaacagctcggacaggtcatgttgctggtgctatgtgctgttcagctgctccttatgaggacaagttgggccctgtgcgaagcattgactctggctaccggccccattacaacgctctgggagggtagcccaggcaagttttggaataccactatcgccgtgtcgatggccaacatattccgggggtcttatctggcgggagctggcttagcattttccatcatgaaaagcgtagggacaggaaagcgaggcaccggttcacaaggggaaactcttggagagaaatggaagaagaaactgaatcagctcagtagaaaggaattcgacctatacaaaaagtctggcattacagaggtggatcgcaccgaggccaaagaaggtctgaagaggggcgagatcacgcatcacgctgtctcccgggggagcgccaaattgcagtggtttgttgaacgtaacatggtgattcccgagggaagagtcatcgacctgggctgtgggaggggaggctggtcatattactgcgcaggtctcaagaaggtgaccgaagtacgcgggtatacaaaaggaggccctggccatgaggagccggtgcccatgagtacttacgggtggaatattgttaagcttatgagcggaaaagatgtgttctacctgccacctgaaaagtgtgacaccttgctgtgcgatatcggtgagtcctctcccagccctacagtcgaagagtcccggactatacgagtgctcaaaatggtcgagccatggttaaagaacaatcagttctgtattaaggtgctgaacccctatatgcctaccgttatcgaacaccttgagagactgcaaaggaaacacggcgggatgctagtacgcaatccactctcacggaactctacacatgaaatgtactggatcagtaatggaaccggcaacattgtggcctcggtcaatatggtgagcagactgttgctgaaccgttttactatgacgcacaggcggcccacaatagagaaggacgttgatctcggtgctgggacccgccatgtgaacgcggaaccggagactcctaatatggacgtcatcggagagcgaattaaaagaatcaaggaagagcacaactccacctggcactatgacgatgaaaatccatacaaaacatgggcctatcatggctcttacgaggtgaaggcaacgggctcagctagctccatgattaacggggtagtgaagcttctgaccaaaccctgggacgttgtccctatggtgactcagatggccatgacagataccactccattcggacagcaaagggtgtttaaggaaaaagtcgacacacggaccccccgcagtatgccgggtacaagaagggttatggagatcactgcagagtggttatggcgaaccctgggccggaataagaaacctcgtttgtgcacgagagaagagttcaccaagaaggtgcgcacaaacgccgctatgggggccgtatttactgaagagaatcagtgggattctgcgaaagcagccgtggaagacgaggatttctggaagctcgtcgacagggagcgggaactgcacaaactaggaaagtgtggcagctgcgtgtataacatgatgggtaaaagagagaagaaacttggggaatttggaaaggctaagggctcacgcgccatatggtacatgtggctgggcgcaaggtacctcgagttcgaggctctggggtttttgaatgaagatcattggttctcccgagagaacagttatagcggagttgaaggtgagggcctgcacaaactcgggtacatccttcgggacatttctaagatccccggaggcgccatgtatgctgatgacaccgccggttgggacacaagaattactgaagatgacctgcataatgaggagaaaatcacccagcagatggatccagaacacaggcaattagcaaacgcgatatttaagctgacgtaccagaataaagtggtcaaggtgcagcgccctacacccaccgggactgtaatggacattatctcccgtaaggatcagcggggatcaggccaagttggcacatatgggttgaacaccttcactaatatggaggcccagctcatcagacagatggaaggagagggtgtgctgagcaaagctgacctagaaaactcgcaccttccagagaagaaaattacccagtggctggagacaaagggcgtcgaaaggctcaaacgcatggccatatctggggatgactgcgtggtgaagcccatcgatgaccgatttgcaaacgctctgttggccttaaatgatatgggaaaggtccggaaagacattcctcaatggcagccaagtaagggctggcatgattggcagcaggttccgttctgttcccaccatttccacgagctgatcatgaaagacggtagaaagctcgtggtaccctgcaggcctcaagacgaacttattgggcgcgcaagaatcagccagggagccggctggtcactgcgggagacggcgtgtctaggcaaagcttacgcccagatgtggtccctgatgtattttcacaggcgtgatctccgattggcatctaacgccatatgcagcgctgtgccagtccattgggtgcccaccagtcgcactacatggtccatccacgcccatcaccaatggatgaccactgaagacatgctgacagtttggaatagagtgtggattgaggataacccttggatggaggacaagaccccagtcacgacatgggaaaatgtgccctaccttgggaagcgggaggatcagtggtgtggaagcctgatcggtctcacctctagggcaacttgggctcagaacattcctaccgccatccagcaagtacgctcattaattggcaatgaagagttcctggactacatgccgagtatgaaaagatttcggaaggaggaagagtccgaaggggcgatatggtga

SEQ ID NO: 15153 - RNA, 9873 nt, synthetic construct
  misc_feature 1..9873: note = derived and/or modified CDS sequence (opt3) from DENV-3__GQ868546__SS-prME
  source 1..9873: mol_type = other RNA
accagcctgtgcctcgtgatgatccttcccgccgctctggcattccacttgacatccagagacggcgagcctaggatgattgtcgggaagaacgaacggggaaaatctttactgtttaagactgcctcaggtataaatatgtgtacgctaatcgcgatggatctcggcgagatgtgcgacgataccgttacatacaaatgtccacatattactgaagtggagccggaagacatcgattgctggtgtaacctgaccagtacatgggtaacctatgggacttgcaatcaggctggagagcgccgacgtgacaagagaagcgtggcccttgcaccccacgtcggcatgggtctggatacaaggacccaaacgtggatgtccgccgagggggcttggcggcaggtggaaaaagttgagacttgggcattgcgccatcctggattcaccattctcgccctgtttctggctcactacatcggcacatctctcactcagaaggtggtcatattcatcttactgatgcttgtgaccccatcgatgacaatgagatgtgtaggcgttgggaacagggactttgtggaaggattgtcaggtgccacctgggtcgatgtggtgctggagcatggcgggtgcgtcacgactatggcgaagaataaacccacactagacattgagctccagaagaccgaagcaactcaactggccacacttcggaaactgtgtatcgagggaaagattaccaacatcacgaccgatagccgctgccctacacagggcgaagctgttttgccagaggaacaggaccagaattatgtgtgtaaacacacttacgtagatcgaggttgggggaacggatgcggcctcttcggcaaggggagtctggtgacctgcgccaagtttcaatgtttagagcccatagagggaaaagtcgtgcagtatgaaaatctgaagtacacagttattatcactgtgcacaccggtgaccagcatcaggtcggcaacgagacacaaggggtgaccgcagaaattactcctcaggcttccacgacagaggccatcctcccagaatatggaacccttggcctggagtgctctccgagaactggtttggacttcaatgagatgatcctactgaccatgaaaaacaaggcgtggatggtacacaggcagtggtttttcgatctccccctgccttggacaagcggggccaccactgaaacaccaacgtggaatcggaaagagcttctggttacctttaagaacgcacatgctaaaaagcaagaagtggtcgtgttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtcctcaagaaagaggtgtctgaaacgcagcatgggaccatcctgattaaggttgagtaccgcggagaagatgctccctgtaagatccctttctccacagaggacggccaaggtaaagcgcacaacgggagacttataactgcaaatccagtggtaaccaagaaagaggaacccgtcaacattgaggccgaaccgcctttcggcgagtcaaatatcgtgatcggaattggcgataacgctttgaagatcaattggtataaaaaggggagcagtattggaaagatgtttgaagccacagcaaggggtgcccggcgaatggctatactgggcgacactgcctgggatttcgggtctgttggaggcgtgctcaactccctgggtaaaatggtccatcagatctttgggagcgcatacaccgcgcttttctcgggcgtgtcttgggtaatgaagattggaatcggcatcctgttgacgtggattgggctcaattccaaaaacacatcaatgagttttagctgcatagctatcggaattatcaccctgtatttaggcgccgtggttcaggcagacatgggttgtgtcattaattggaaggggaaagagctgaagtgcggatccggcatcttcgtgactaacgaggtgcacacatggaccgaacagtacaagtttcaagccgattctcccaaacgcctagctactgccatagcaggtgcttgggagaatggcgtctgtgggatcagaagcaccacaaggatggaaaacctcctgtggaagcagattgccaatgagcttaactatatcttgtgggaaaataacattaaactgacggttgtggtgggagacatcataggcgtactcgagcaggggaagcggaccctgactccacagcctatggagttaaaatactcatggaagacatggggaaaagcgaagattgtcaccgccgaaacacaaaacagttccttcatcattgatggccccaatactccagagtgccccagcgcttctcgcgcatggaacgtgtgggaagttgaggactatggttttggggtgttcaccacgaatatctggctgaagcttagagaagtctacacacagttgtgtgaccataggctcatgtcagccgctgtgaaagatgagcgtgccgttcacgcagacatgggatactggatagagagtcagaagaacggcagctggaaactggaaaaggcgtccctaatcgaggtgaaaacctgcacttggcctaagtctcacaccctgtggtcgaatggtgtactcgaaagcgatatgattatcccaaagtccctggccggcccgatttcacagcataaccaccggcccgggtatcatacacaaactgctggaccttggcaccttggcaaattggagctggactttaattactgcgaggggaccacagtcgtgatcacggaaaactgtggaacccgaggcccaagtttaagaactacaaccgtgtctggtaagctcatacacgagtggtgctgtaggagctgcactctgccccctcttcgctatatgggggaagatggatgttggtacggcatggagattcggccaatctccgaaaaagaggagaatatggtcaagtcactggttagcgccggttctggcaaagtggacaacttcacaatgggggtattgtgcctcgcaatcctgtttgaagaggtgatgagaggaaagttcggcaagaaacatatgattgctggggtcttctttaccttcgtgctactgctctccggacagatcacgtggagggatatgactcacaccctgattatgataggcagtaatgccagcgaccgcatgggtatgggggttacatatcttgcattgatcgccacctttaagattcagcccttcctggctttaggatttttcctccgaaaactgacttctcgggaaaaccttctgctaggcgtgggcctcgcgatggccacaaccctgcaattgccggaggatatcgaacagatggcaaatgggattgctctgggattaatggccctcaagctgatcacacagtttgagacttaccagctttggaccgccctgatatccttgacgtgttcaaacacaatgttcaccctcactgtcgcttggcgtaccgcaacactgatcctagccggtgtgagtctgcttcctgtttgccaaagctcgtccatgagaaaaactgactggctcccaatggcggtggctgccatgggcgtcccccctctgcccttgtttattttctctctgaaggataccttaaagaggcgcagctggccactcaatgagggggtaatggcagtgggactggtttcaatccttgccagttccctgttgcggaacgacgtgcctatggctggccccctcgtcgcaggtgggctgctaattgcctgttatgtgatcacgggaacatctgcggatctgaccgtagaaaaagctgccgacataacttgggaggaagaggcagaacagacaggcgtgagccataaccttatgattaccgtcgacgatgacggcactatgagaatcaaggatgacgagacagagaatatcctcaccgttctgttgaaaacggccttactgattgtgtccggggtgtttccatactcaataccggctactctcctggtctggcacacctggcagaagcagacacaaaggagcggagtgctttgggatgttcctagtcccccagaaacccagaaagccgagctggaagagggtgtataccgaatcaagcagcagggcattttcgggaaaacacaagtgggagtcggcgtgcagaaggagggtgtttttcatactatgtggcacgtgacccgcggggcagtcttgacgtataacggaaagcggctagaacccaattgggcttctgtgaaaaaggacctgatctcctacggcggcgggtggagactcagcgcccagtggcaaaaaggagaggaagtacaggtcattgcggtggagcctggtaagaacccaaaaaatttccagacaactcccggcaccttccagacaaccactggggaaatcggagccatagcactggattttaagcctggcacctcgggttcaccgatcattaacagggaggggaaggttgtgggactttatggcaatggcgtcgtgacaaaaaacgggggatacgtttctggtatcgctcaaacgaatgccgagccagacggccccactcctgaattagaggaagagatgttcaagaaacgtaacctgaccattatggatctccacccagggagtggaaagacacgcaaatatttgcccgctatcatacgggaagcaattaagagaaggctgcgaaccctcatcctggcccctactcgggtggtcgccgctgagatggaggaagcgcttaagggcctgccgatccgctaccagacaaccgcaacgaaatccgagcatactggtagagaaattgtggacttgatgtgccacgccacatttaccatgaggctactgagccccgtacgggtgccaaattataacctcatcataatggatgaggctcatttcaccgaccctgcctctattgcagcccgagggtacatcagcactagagttggaatgggcgaagctgcggccatttttatgacagcaacccccccaggcacagctgatgccttccctcagtccaatgcacccatccaggacgaggagcgcgacataccagaaaggtcatggaacagtgggaatgagtggattactgattttgccggaaagacggtctggttcgtgccgagcatcaaagctggtaacgacatcgccaactgtttacgtaagaatggcaaaaaggtgattcaactgtctcggaagacctttgatacagaataccagaaaactaagcttaacgactgggatttcgtcgtaaccacagacatctccgagatgggggcgaattttaaagcagatagagtgattgaccctaggcgctgcctgaagcccgttatactcaccgatggaccagagcgagtgatcttggccggccccatgcctgtcactgctgcctcagctgcacagagacggggtagggtggggcgcaacccacagaaagaaaatgaccaatatattttcacgggccagcccctgaacaatgatgaggaccacgcccattggaccgaagctaagatgctcctggacaacatcaatacacctgagggaatcattccggcccttttcgaaccagagcgtgagaagagtgcagcgatagatggcgaatacagactaaaaggggagagccggaagacttttgttgaactgatgaggcgcggagacttgcccgtgtggttagcccacaaagtcgcttccgagggtatcaagtataccgatcgaaaatggtgcttcgacggccagagaaacaatcagattctggaagagaacatggatgtggagatctggacaaaggaaggggagaaaaagaagctccggcctaggtggctggacgcccgcacctactctgatccccttgcactgaaagaatttaaggacttcgctgccggaagaaaatcgattgcactcgatttggtaactgagatcggcagggtgccaagccacctggcccatcggacacgtaatgctctagacaacctggttatgctccacacgtcagaacatggtgggcgcgcgtatcgacacgccgtcgaggagcttcctgaaaccatggagactctgttattgctgggcctcatgatactgcttacaggaggcgcaatgctgtttctcatctccgggaagggaattggtaaaaccagtatcggcttgatttgtgtgatcgcttctagcgggatgctgtggatggccgaaatacccttacaatggattgcctccgcaatcgtgctagagttctttatgatggtcctgctcattccagagcctgaaaagcagagaaccccgcaggataatcaacttgcttacgttgtgatcggaatactgacattggccgcgatcattgctgccaacgagatgggcctgctcgaaactacgaagagggacctgggtatgtcaaaagagcccggggtagtgtctccaaccagctatcttgatgtcgacctccaccctgcaagtgcctggacactgtacgctgtggcaactaccgttatcacacccatgttgcggcataccattgaaaattccactgccaacgtgagcctggcggctatcgccaaccaggcagtcgtattaatgggcctagacaagggatggccaatatctaaaatggatctgggcgtgcctctccttgccctggggtgctactcacaggttaatcccttgacgctgacagctgccgtgctcctgcttattacccactatgcaatcatcggaccgggcttacaggctaaggccactcgcgaggcgcaaaaaagaaccgccgcaggtattatgaagaacccaacagtcgacgggatcatgactatagatctggaccctgtgatttacgattccaagttcgagaaacagctcggacaggtcatgttgctggtgctatgtgctgttcagctgctccttatgaggaccagttgggccctgtgcgaagcattgacactggctacgggccccatcaccactctctgggagggtagcccaggcaagttttggaatacaaccattgccgtgtcgatggccaacatcttccgggggtcttatctggcgggagctggcttagcattttccataatgaaaagcgtagggactggaaagcgaggcacaggttcacaaggggaaacccttggagagaaatggaagaagaaactgaatcagctcagtagaaaggaattcgacctatacaaaaagtctggcatcacggaggtggatcgcaccgaggccaaagaaggtctgaagaggggcgagattacacatcacgctgtctcccgggggagcgccaaattgcagtggtttgttgaacgtaacatggtgatccccgagggaagagtcattgacctgggctgtgggaggggaggctggtcatattactgcgcaggtctcaagaaggtgactgaagtacgcgggtataccaaaggaggccctggccatgaggagccggtgcccatgagtacatacgggtggaatatcgttaagcttatgagcggaaaagatgtgttctacctgccacctgaaaagtgtgacactttgctgtgcgatattggtgagtcctctcccagccctaccgtcgaagagtcccggacaatccgagtgctcaaaatggtcgagccatggttaaagaacaatcagttctgtataaaggtgctgaacccctatatgcctaccgttattgaacaccttgagagactgcaaaggaaacacggcgggatgctagtacgcaatccactctcacggaactctactcatgaaatgtactggatcagtaatggaacgggcaacatcgtggcctcggtcaatatggtgagcagactgttgctgaaccgttttacaatgacccacaggcggcccactattgagaaggacgttgatctcggtgctgggacccgccatgtgaacgcggaaccggagacacctaatatggacgtcataggagagcgaatcaaaagaattaaggaagagcacaactccacgtggcactatgacgatgaaaatccatacaaaacctgggcctatcatggctcttacgaggtgaaggcaactggctcagctagctccatgatcaacggggtagtgaagcttctgacaaaaccctgggacgttgtccctatggtgacccagatggccatgactgatacaaccccattcggacagcaaagggtgtttaaggaaaaagtcgacacacggactccccgcagtatgccgggtaccagaagggttatggagattacggcagagtggttatggcgaaccctgggccggaataagaaacctcgtttgtgcacaagagaagagttcactaagaaggtgcgcaccaacgccgctatgggggccgtatttacagaagagaatcagtgggattctgcgaaagcagccgtggaagacgaggatttctggaagctcgtcgacagggagcgggaactgcacaaactaggaaagtgtggcagctgcgtgtataacatgatgggtaaaagagagaagaaacttggggaatttggaaaggctaagggctcacgcgccatctggtacatgtggctgggcgcaaggtacctcgagttcgaggctctggggtttttgaatgaagatcattggttctcccgagagaacagttatagcggagttgaaggtgagggcctgcacaaactcgggtacatacttcgggacatctctaagattcccggaggcgccatgtatgctgatgacactgccggttgggacaccagaatcacggaagatgacctgcataatgaggagaaaattacacagcagatggatccagaacacaggcaattagcaaacgcgatctttaagctgacctaccagaataaagtggtcaaggtgcagcgccctactcccacagggaccgtaatggacataatttcccgtaaggatcagcggggatcaggccaagttggcacttatgggttgaacaccttcacaaatatggaggcccagctcatcagacagatggaaggagagggtgtgctgagcaaagctgacctagaaaacccacaccttcccgagaagaaaatcacgcagtggctggagaccaagggcgtcgaaaggctcaaacgcatggccatttcgggggatgactgcgtggtgaagcctatagatgaccgatttgcaaacgctctgttggccttaaatgatatgggaaaggtccggaaagacatcccacaatggcagccgtctaagggctggcatgattggcagcaggttcccttctgtagtcaccatttccacgagctgattatgaaagacggtagaaagctcgtggtaccttgcaggccacaagacgaacttatcgggcgcgcaagaatttcccagggagccggctggagcctgcgggagactgcgtgtctaggcaaagcttacgcccagatgtggtcactgatgtattttcacaggcgtgatctccgattggcatccaacgccatctgctctgctgtgcccgtccattgggtgcctacaagccgcaccacttggagtatacacgcccatcaccaatggatgacaaccgaagacatgctgacggtttggaatagagtgtggatcgaggataacccatggatggaggacaagacacccgtcaccacttgggaaaatgtgccttaccttgggaagcgggaggatcagtggtgtggatccctgattggtctcaccagcagggcaacatgggctcagaacatcccgactgccattcagcaagtacgctctttaatcggcaatgaagagttcctggactacatgccatcaatgaaaagatttcggaaggaggaagagagtgaaggggcgatttggtga

SEQ ID NO: 15154 - RNA, 9873 nt, synthetic construct
  misc_feature 1..9873: note = derived and/or modified CDS sequence (opt3) from DENV-3__GU131850__SS-prME
  source 1..9873: mol_type = other RNA
accagcctgtgcctcgtgatgatccttcccgccgctctggcattccacttgacatccagagacggcgagcctaggatgattgtcgggaagaacgaacggggaaaatctttactgtttaagactgcctcaggtataaatatgtgtacgctaatcgcgatggatctcggcgagatgtgcgacgataccgttacatacaaatgtccacatattactgaagtggagccggaagacatcgattgctggtgtaacctgaccagtacatgggtaacctatgggacttgcaatcaggctggagagcgccgacgtgacaagagaagcgtggcccttgcaccccacgtcggcatgggtctggatacaaggacccaaacgtggatgtccgccgagggggcttggcggcaggtggaaaaagttgagacttgggcattgcgccatcctggattcaccattctcgccctgtttctggctcactacatcggcacatctctcactcagaaggtggtcatattcatcttactgatgcttgtgaccccatcgatgacaatgagatgtgtaggcgttgggaacagggactttgtggaaggattgtcaggtgccacctgggtcgatgtggtgctggagcatggcgggtgcgtcacgactatggcgaagaataaacccacactagacattgagctccagaagaccgaagcaactcaactggccacacttcggaaactgtgtatcgagggaaagattaccaacatcacgaccgatagccgctgccctacacagggcgaagctgttttgccagaggaacaggaccagaattatgtgtgtaaacacacttacgtagatcgaggttgggggaacggatgcggcctcttcggcaaggggagtctggtgacctgcgccaagtttcaatgtttagagcccatagagggaaaagtcgtgcagtatgaaaatctgaagtacacagttattatcactgtgcacaccggtgaccagcatcaggtcggcaacgagacacaaggggtgaccgcagaaattactcctcaggcttccacgacagaggccatcctcccagaatatggaacccttggcctggagtgctctccgagaactggtttggacttcaatgagatgatcctactgaccatgaaaaacaaggcgtggatggtacacaggcagtggtttttcgatctccccctgccttggacaagcggggccaccactgaaacaccaacgtggaatcggaaagagcttctggttacctttaagaacgcacatgctaaaaagcaagaagtggtcgtgttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtcctcaagaaagaggtgtctgaaacgcagcatgggaccatcctgattaaggttgagtaccgcggagaagatgctccctgtaagatccctttctccacagaggacggccaaggtaaagcgcacaacgggagacttataactgcaaatccagtggtaattaagaaagaggaacccgtcaacatcgaggccgaaccgcctttcggcgagtcaaatatcgtgattggaatcggcgataacgctttgaagattaattggtataaaaaggggagcagtataggaaagatgtttgaagccaccgcaaggggtgcccggcgaatggctatcctgggcgacacagcctgggatttcgggtctgttggaggcgtgctcaactccctgggtaaaatggtccatcagatttttgggagcgcatacactgcgcttttctcgggcgtgtcttgggtaatgaagatcggaatcggcattctgttgacctggatagggctcaattccaaaaacacgtcaatgagttttagctgcatcgctattggaatcattacactgtatttaggcgccgtggttcaggcagacatcggttgtgtcataaattggaaggggaaagagctgaagtgcggatccggcatcttcgtgaccaacgaggtgcacacttggacagaacagtacaagtttcaagccgattctcccaaacgcctagctaccgccattgcaggtgcttgggagaatggcgtctgtgggatcagaagcactaccaggatggaaaacctcctgtggaagcagattgccaatgagcttaactatatcttgtgggaaaataacataaaactgacagttgtggtgggagacattatcggcgtactcgagcaggggaagcggacgctgaccccacagcctatggagttaaaatactcatggaagacttggggaaaagcgaagattgtcacagccgaaacccaaaacagttccttcatcatagatggccccaatacaccagagtgccccagcgcttctcgcgcatggaacgtgtgggaagttgaggactatggttttggggtgttcactaccaatatctggctgaagcttagagaagtctacacgcagttgtgtgaccataggctcatgtcagccgctgtgaaagatgagcgtgccgttcacgcagacatgggatactggattgagagtcagaagaacggcagctggaaactggaaaaggcgtccctaatcgaggtgaaaacatgcacctggcctaagtctcacactctgtggtcgaatggtgtactcgaaagcgatatgattatcccaaagtccctggccggcccgatatcacagcataaccaccggcccgggtatcatacccaaacagctggaccttggcaccttggcaaattggagctggactttaattactgcgaggggactaccgtcgtgattacagaaaactgtggaacgcgaggcccaagtttaagaaccactacagtgtctggtaagctcatccacgagtggtgctgtaggagctgcaccctgccccctcttcgctatatgggggaagatggatgttggtacggcatggagatccggccaatttccgaaaaagaggagaatatggtcaagtcactggttagcgccggttctggcaaagtggacaacttcactatgggggtattgtgcctcgcaatcctgtttgaagaggtgatgagaggaaagttcggcaagaaacatatgattgctggggtcttctttacattcgtgctactgctctccggacagataacctggagggatatgacgcacactctgatcatgattggcagtaatgccagcgaccgcatgggtatgggggttacctatcttgcattgatcgccacatttaagattcagcccttcctggctttaggatttttcctccgaaaactgacctctcgggaaaaccttctgctaggcgtgggcctcgcgatggccactacactgcaattgccggaggatatcgaacagatggcaaatgggatagctctgggattaatggccctcaagctgatcacccagtttgagacataccagctttggactgccctgatttccttgacctgttcaaacacgatgttcacactcaccgtcgcttggcgtactgcaaccctgatcctagccggtgtgagtctgcttcctgtttgccaaagctcgtccatgagaaaaacagactggctcccaatggcggtggctgccatgggcgtcccccctctgcccttgtttattttctctctgaaggatactttaaagaggcgcagctggccactcaatgagggggtaatggcagtgggactggtttcaatccttgccagttccctgttgcggaacgacgtgcctatggctggccccctcgtcgcaggtgggctgctaatagcctgttatgtgattaccggaacgtctgcggatctgacagtagaaaaagctgccgacatcacctgggaggaagaggcagaacagactggcgtgagccataaccttatgatcacagtcgacgatgacggcaccatgagaattaaggatgacgagactgagaatatactcacagttctgttgaaaaccgccttactgatcgtgtccggggtgtttccatactcaattccggctacgctcctggtctggcacacttggcagaagcagacccaaaggagcggagtgctttgggatgttcctagtcccccagaaacacagaaagccgagctggaagagggtgtataccgaatcaagcagcagggcattttcgggaaaacccaagtgggagtcggcgtgcagaaggagggtgtttttcatacaatgtggcacgtgactcgcggggcagtcttgacctataacggaaagcggctagaacccaattgggcttctgtgaaaaaggacctgatctcctacggcggcgggtggagactcagcgcccagtggcaaaaaggagaggaagtacaggtcatagcggtggagcctggtaagaacccaaaaaatttccagacgatgcccggcacattccagactaccacaggggaaatcggagccattgcactggattttaagcctggcacctcgggttcaccgatcattaacagggaggggaaggttgtgggactttatggcaatggcgtcgtgactaaaaacgggggatacgtttctggtatcgctcaaaccaatgccgagccagacggccccacacctgaattagaggaagagatgttcaagaaacgtaacctgacgataatggatctccacccagggagtggaaagactcgcaaatatttgcccgctattatccgggaagcaatcaagagaaggctgcgaaccctcattctggcccctacacgggtggtcgccgctgagatggaggaagcgcttaagggcctgccgatccgctaccagaccactgcaacaaaatccgagcataccggtagagaaatagtggacttgatgtgccacgccacgtttactatgaggctactgagccccgtacgggtgccaaattataacctcattatcatggatgaggctcatttcacagaccctgcctctattgcagcccgagggtacatcagcaccagagttggaatgggcgaagctgcggccatatttatgaccgcaactcccccaggcacagctgatgccttccctcagtccaatgcacccattcaggacgaggagcgcgacatcccagaaaggtcatggaacagtgggaatgagtggatcaccgattttgtcggaaagacagtgtggttcgtgccgagcattaaagccggtaacgacatcgctaactgtttacgtaagaatggcaaaaaggtcattcaactgtctcggaagacttttgatacggaataccagaaaaccaagcttaacgactgggatttcgtagtgacaactgacatatccgagatgggggccaattttaaagcggatagagttatcgaccctaggcgctgcctgaagcccgtgattctcaccgatggaccagagcgagtcatcttggcaggccccatgcctgtgacagccgcttcagccgctcagagacggggtagggttgggcgcaacccacagaaagaaaatgaccaatatatcttcaccggccagcccctgaacaatgatgaggaccacgcacattggactgaagccaagatgctcctggacaacattaatacgcctgagggaataatcccggctcttttcgaaccagagcgtgagaagagtgccgcaattgatggcgaatacagactaaaaggggagagccggaagacctttgtggaactgatgaggcgcggagacttgcccgtctggttagcgcacaaagtggcctccgagggtatcaagtatacagatcgaaaatggtgcttcgacggccagagaaacaatcagattctggaagagaacatggatgtagagatctggactaaggaaggggagaaaaagaagctccggcctaggtggctggacgctcgcacctactctgatccccttgccctgaaagaatttaaggacttcgcagctggaagaaaatcgatagccctcgatttggtgacagagatcggcagggttccaagccacctggcacatcggacccgtaatgccctagacaacctggtcatgctccacacttcagaacatggtgggcgcgcttatcgacacgcggtggaggagcttcctgaaacaatggagacgctgttattgctgggcctcatgattctgcttaccggaggcgccatgctgtttctcatctccgggaagggaattggtaaaactagtatcggcttgatatgtgtgattgcatctagcgggatgctgtggatggctgaaatccccttacaatggattgcctccgccatcgtcctagagttctttatgatggttctgctcataccagagcctgaaaagcagagaacaccgcaggataatcaacttgcatacgtggtaatcggaattctgaccttggctgccatcattgcggctaacgagatgggcctgctcgaaaccacaaagagggacctgggtatgtcaaaagagcccggggtggtctctccaaatagctatcttgatgtggacctccaccctgccagtgcatggactctgtacgccgttgctacgaccgtgatcacacccatgttgcggcatactatagaaaactccaccgcaaacgtcagcctggccgcgattgctaatcaggccgtagtgttaatgggcctagacaagggatggccaatctctaaaatggatctgggcgttcctctccttgcactggggtgctactcacaggtgaaccccttgacactgaccgccgctgtcctcctgcttatcactcactatgccattatcggaccgggcttacaggcaaaggctacgcgcgaggcccaaaaaagaacagcggccggtataatgaagaatccaaccgtggacgggattatgactatcgatctggaccctgtcatttacgattccaagttcgagaaacagctcggacaggtgatgttgctggttctatgtgcagtgcagctgctccttatgaggaccagttgggctctgtgcgaagccttgacactggcaactggccccatcaccacactctgggagggtagcccaggcaagttttggaacacgaccatagctgtatcgatggccaatatcttccgggggtcttatctggccggagcgggcttagctttttccattatgaaaagcgtggggactggaaagcgaggcacaggttcacaaggggaaacccttggagagaaatggaagaagaaactgaaccagctcagtagaaaggaattcgacctatacaaaaagtctggcatcactgaggtcgatcgcacagaggcaaaagaaggtctgaagaaaggcgagattacccatcacgccgtttccagggggagcgctaagttgcagtggtttgtggaacggaatatggtcatccccgagggacgtgtgattgacctgggctgtgggagaggaggctggtcatattactgcgccggtctcaagaaagtaacggaagtgagggggtataccaagggaggccctggccatgaggagccggttcccatgagtacatacgggtggaacatcgtgaaacttatgagcggaaaggatgtcttctacctgccacctgaaaaatgtgacactttgctgtgcgatataggtgagtcctctcccagccctaccgtggaagagtcccgcacaattcgggtcctcaagatggtggagccatggttaaagaataaccagttctgtatcaaagttctgaatccctatatgcctactgtaatcgaacaccttgagcgactgcaaagaaagcacggcgggatgctagtgaggaacccactctcacgcaattctacccatgaaatgtactggattagtaacggaacaggcaatatagtcgcatcggtgaacatggttagccggctgttgctgaacagatttaccatgactcaccgtaggcccacgatcgagaaagacgtggatctcggtgccgggacacggcatgtcaatgctgaaccggagacccctaacatggacgtgattggagagcgcatcaagcgaattaaagaagagcacaattccacttggcactatgacgatgaaaacccatacaagacctgggcgtatcatggctcttacgaggtaaaggccacaggctcagcaagctccatgatcaatggggtggttaaacttctgacgaagccctgggacgtcgtgcctatggtgacccagatggctatgactgatacaaccccattcggacagcaaagagtctttaaagaaaaggttgacactaggacaccccggagtatgccgggtacccgcagagtgatgggcataacagccgagtggttatggaggactctggggcgaaacaaaaagcctcggttgtgcacccgtgaggaattcacgaagaaagtaagaaccaatgcagccatgggagctgtgtttacagaggaaaaccagtgggattctgccaaggcggcagtcgaggacgaagatttctggaaactcgtggaccgcgagagggagctgcacaagctaggcaaatgtggtagctgcgtttataatatgatggggaagcgggaaaaaaagcttggagagtttggcaaggccaaaggctcaagagctatctggtacatgtggctgggggcccgctacctcgaattcgaggcactgggatttttgaacgaggatcattggttctccagggaaaatagttatagcggtgtggagggcgaagggctgcacaagctcggatacattcttcgagacatctctaaaattcccggcggtgctatgtatgccgatgacactgctgggtgggacacccggatcacagaggatgacctgcataacgaagagaagataactcagcagatggatccagagcacagacaattagccaatgcaatttttaaactgacctaccagaacaaggtcgtgaaggtacagaggcctacgcccacaggaaccgttatggacatcatctcccgcaaagatcagcgtggctcaggccaagtggggacttatggattgaatacattcaccaacatggaagcgcagctcattcggcagatggagggtgaaggcgtcctgagcaaggccgacctagagaacccacaccttcccgaaaaaaagataactcagtggctggagaccaaaggggtggagagactcaagaggatggctatctcgggagatgactgcgtggtcaagcctattgatgaccgctttgccaatgcactgttggctttaaacgatatgggcaaagttcgaaaggacatcccacaatggcagccgtctaaaggttggcatgattggcagcaggtgcccttctgtagtcaccatttccacgaactgattatgaaggacgggcggaaactcgtagtgccttgcagaccacaagacgagcttatcggaagggcccgcatatcccagggcgcaggctggagcctgagagaaacagcctgtctagggaaggcgtacgctcagatgtggtcactgatgtattttcaccggagggatctccgtttggcctccaatgcaatctgctctgccgtccccgtgcattgggttcctacgagccgaaccacttggagtattcacgctcatcaccaatggatgacaaccgaggacatgctgactgtgtggaaccgcgtctggatcgaagataatccatggatggaggacaagacacccgtgaccacgtgggagaacgtaccttaccttggaaaaagagaagatcagtggtgtggttccctgattggcctcacaagccgggccacctgggcacagaatatcccgactgctattcagcaagttaggtctttaatagggaacgaggaattcctggactacatgccatcaatgaagcgctttagaaaagaggaggaaagtgagggagccatctggtga

SEQ ID NO: 15155 - RNA, 9873 nt, synthetic construct
  misc_feature 1..9873: note = derived and/or modified CDS sequence (opt3) from DENV-3__GU131851__SS-prME
  source 1..9873: mol_type = other RNA
accagcctgtgcctcgtgatgatccttcccgccgctctggcattccacttgacatccagagacggcgagcctcatatgattgtcgggaagaacgaaaggggaaaatctttactgtttaagactgcctcaggtataaatatgtgtacgctaatcgcgatggatctcggcgagatgtgcgacgataccgttacatacaaatgtccacacattactgaagtggagccggaagacatcgattgctggtgtaacctgaccagtacatgggtaacctatgggacttgcaatcaggctggagagcggcgccgagacaagcgtagcgtggcccttgcaccccatgtcggcatgggtctggatacaagaacccaaacgtggatgtccgccgagggggcttggaggcaggtggaaaaagttgagacttgggcattgcggcaccctggattcaccattctcgccctgtttctggctcattacatcggcacatctctcactcagaaggtggtcatattcatcttactgatgcttgtgaccccatcgatgacaatgcgctgtgtaggcgttgggaacagagactttgtggaaggattgtcaggtgccacctgggtcgatgtggtgctggagcacggcgggtgcgtcacgactatggcgaagaataaacccacactagacattgagctccagaagaccgaagcaactcaactggccacacttaggaaactgtgtatcgagggaaagattaccaacatcacgaccgatagccggtgccctacacagggcgaagctgttttgccagaggaacaggaccagaattatgtgtgtaaacacacttacgtagatcgcggttgggggaacggatgcggcctcttcggcaaggggagtctggtgacctgcgccaagtttcaatgtttagagcccatagagggaaaagtcgtgcagtatgaaaatctgaagtacacagttattatcactgtgcataccggtgaccagcaccaggtcggcaacgagacacaaggggtgaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtacatagacagtggctctttgatctgccccttccttggacaagcggggccaccactgaaacaccaacgtggaataggaaagagctgttggttaccttcaagaacgcacacgctaaaaagcaagaagtggtcgtgctcggctcccaggagggagccatgcacactgctctgacaggcgccaccgaaattcagaattcagggggaacaagtatatttgcaggtcatttaaagtgtcggctgaaaatggacaagctagagctcaaaggcatgagctacgccatgtgcactaacaccttcgtcctgaagaaagaggtgtctgaaacgcagcacgggaccatccttattaaggttgagtaccgtggagaagatgctccctgtaagatccctttttccacagaggacggccaaggtaaagcgcataacgggcgcttgataactgcaaatccagtggtaaccaagaaagaggaacccgtcaacattgaggccgaaccgcctttcggcgagtcaaatatcgtgatcggaattggcgataacgctctgaagatcaattggtataaaaaggggagcagtattggaaagatgttcgaagccacagcaagaggtgccaggcggatggctatactcggcgacactgcctgggattttgggtctgttggaggcgtgctgaactcccttggtaaaatggtccaccagatcttcgggagcgcatacaccgcgctgttttcgggcgtgtcttgggtaatgaagattggaatcggcatcttgctcacgtggattgggctgaattccaaaaacacatcaatgagtttcagctgcatagctatcggaattatcaccttatatctgggcgccgtggttcaggcagacatgggttgtgtcattaattggaaggggaaagagctaaagtgcggatccggcatctttgtgactaacgaggtgcatacatggaccgaacagtacaagttccaagccgattctcccaaacgactcgctactgccatagcaggtgcttgggagaatggcgtctgtgggatccgcagcaccacaagaatggaaaacctgctttggaagcagattgccaatgagttgaactatatcctgtgggaaaataacattaaactcacggttgtggtgggagacatcataggcgtactggagcaggggaagaggaccttaactccacagcctatggagctgaaatactcatggaagacatggggaaaagcgaagattgtcaccgccgaaacacaaaacagttcctttatcattgatggccccaatactccagagtgccccagcgcttctcgggcatggaacgtgtgggaagttgaggactatggtttcggggtgtttaccacgaatatctggcttaagttgcgcgaagtctacacacagctctgtgaccacagactgatgtcagccgctgtgaaagatgagagggccgttcacgcagacatgggatactggatagagagtcagaagaacggcagctggaaactagaaaaggcgtccctgatcgaggtgaaaacctgcacttggcctaagtctcataccctctggtcgaatggtgtactggaaagcgatatgattatcccaaagtcccttgccggcccgatttcacagcacaaccatcgtcccgggtatcacacacaaactgctggaccttggcacttgggcaaactggagttagacttcaattactgcgaggggaccacagtcgtgatcacggaaaactgtggaacccggggcccaagtctccgaactacaaccgtgtctggtaagctgatacatgagtggtgctgtagaagctgcactcttccccctctgaggtatatgggggaagatggatgttggtacggcatggagattcgcccaatctccgaaaaagaggagaatatggtcaagtcattggttagcgccggttctggcaaagtggacaactttacaatgggggtactctgcctggcaatcctattcgaagaggtgatgcggggaaagtttggcaagaaacacatgattgctggggtcttcttcacctttgtgctgctcctgtccggacagatcacgtggagagatatgactcatacccttattatgataggcagtaatgccagcgacaggatgggtatgggggttacatatttggcactgatcgccaccttcaagattcagccctttttagctctcggattctttctgcgcaaacttacttctcgagaaaacctgctactcggcgtgggcctggcgatggccacaaccttgcaactgccggaggatatcgaacagatggcaaatgggattgctttaggactcatggccctgaagcttatcacacagttcgagacttaccagctgtggaccgccttgatatccctcacgtgttcaaacacaatgtttaccctgactgtcgcttggcggaccgcaacactaatcctggccggtgtgagtcttctccctgtttgccaaagctcgtccatgcgtaaaactgactggctgccaatggcggtggctgccatgggcgtcccccctttgcccctgttcattttttctttaaaggataccctcaagagaaggagctggccactgaatgagggggtaatggcagtgggacttgtttcaatcctggccagttccttgctccgcaacgacgtgcctatggctggccccctggtcgcaggtgggctactgattgcctgttatgtgatcacgggaacatctgcggatcttaccgtagaaaaagctgccgacataacttgggaggaagaggcagaacagacaggcgtgagccacaacctcatgattaccgtcgacgatgacggcactatgcggatcaaggatgacgagacagagaatatcctgaccgttttgttaaaaacggccctgctcattgtgtccggggtgttcccatactcaataccggctactctgcttgtctggcatacctggcagaagcagacacaaagaagcggagtgctgtgggatgttcctagtcccccagaaacccagaaagccgagttggaagagggtgtatacaggatcaagcagcagggcatttttgggaaaacacaagtgggagtcggcgtgcagaaggagggtgttttccacactatgtggcacgtgacccgaggggcagtcctaacgtataacggaaagcgcctggaacccaattgggcttctgtgaaaaaggacctcatctcctacggcggcgggtggcggctgagcgcccagtggcaaaaaggagaggaagtacaggtcattgcggtggagcctggtaagaacccaaaaaattttcagacaactcccggcaccttccagacaaccactggggaaatcggagccatagcacttgatttcaagcctggcacctcgggttcaccgatcattaacagagaggggaaggttgtgggattatatggcaatggcgtcgtgacaaaaaacgggggatacgtttctggtatcgctcaaacgaatgccgagccagacggccccactcctgaactggaggaagagatgtttaagaaaaggaacctcaccattatggatttgcatccagggagtggaaagacacgtaaatatctgcccgctatcatacgcgaagcaattaagcggagactcaggaccctgatccttgcccctactcgagtggtcgccgctgagatggaggaagcgctgaagggcttgccgatccggtaccagacaaccgcaacgaaatccgagcacactggtcgcgaaattgtggacctaatgtgccatgccacattcaccatgagactgctcagccccgtaagggtgccaaattataacttaatcataatggatgaggctcactttaccgaccctgcctctattgcagcccgggggtacatcagcactcgagttggaatgggcgaagctgcggccattttcatgacagcaacccccccaggcacagctgatgcctttcctcagtccaatgcacccatccaggacgaggagagagacataccagaacgctcatggaacagtgggaatgagtggattactgatttcgccggaaagacggtctggtttgtgccgagcatcaaagctggtaacgacatcgccaactgtctgaggaagaatggcaaaaaggtgattcaactttctcgtaagaccttcgatacagaataccagaaaactaagctgaacgactgggattttgtcgtaaccacagacatctccgagatgggggcgaatttcaaagcagatcgggtgattgaccctagaaggtgcctcaagcccgttatattgaccgatggaccagagcgcgtgatcctggccggccccatgcctgtcactgctgcctcagctgcacagcgaagaggtcgggtggggaggaacccacagaaagaaaatgaccaatatatttttacgggccagcccctcaacaatgatgaggaccatgcccactggaccgaagctaagatgctgcttgacaacatcaatacacctgagggaatcattccggccctattcgaaccagagcgcgagaagagtgcagcgatagatggcgaataccgtctgaaaggggagagcagaaagactttcgttgaattgatgcggaggggagacttacccgtgtggctggcccacaaagtcgcttccgagggtatcaagtataccgatcgcaaatggtgctttgacggccagcgaaacaatcagattctcgaagagaacatggatgtggagatctggacaaaggaaggggagaaaaagaagctgagacctcggtggcttgacgccaggacctactctgatcccctggcactcaaagaattcaaggactttgctgccggacgcaaatcgattgcattggatctggtaactgagatcggcagagtgccaagccatctagcccacaggacacggaatgctctggacaacctcgttatgcttcatacgtcagaacacggtgggcgtgcgtatcgccacgccgtcgaggagctgcctgaaaccatggagactttattgctgctcggcctgatgatacttctgacaggaggcgcaatgctcttcttgatctccgggaagggaattggtaaaaccagtatcggcctgatttgtgtgatcgcttctagcgggatgttatggatggccgaaatacccctacaatggattgcctccgcaatcgtgctggagtttttcatgatggtcctccttattccagagcctgaaaagcagcgaaccccgcaggataatcaactggcttacgttgtgatcggaatattgacactggccgcgatcattgctgccaacgagatgggcctcctggaaactacgaagagagaccttggtatgtcaaaagagcccggggtagtgtctccaaccagctatctcgatgtcgacctgcatcctgcaagtgcctggacattgtacgctgtggcaactaccgttatcacacccatgctgaggcacaccattgaaaattccactgccaacgtgagcttagcggctatcgccaaccaggcagtcgtactaatgggcctggacaagggatggccaatatctaaaatggatctcggcgtgcctcttctggccttggggtgctactcacaggttaatcccctgacgctcacagctgccgtgctgcttttaattacccattatgcaatcatcggaccgggcctgcaggctaaggccactcgggaggcgcaaaaacgcaccgccgcaggtattatgaagaacccaacagtcgacgggatcatgactatagatctcgaccctgtgatttacgattccaagtttgagaaacagttgggacaggtcatgctgctagtgctgtgtgctgttcagctccttctgatgagaaccagttgggccttgtgcgaagcactgacactcgctacgggccccatcaccactctgtgggagggtagcccaggcaagttctggaatacaaccattgccgtgtcgatggccaacatctttagggggtcttatttagcgggagctggccttgcattctccataatgaaaagcgtagggactggaaagcggggcacaggttcacaaggggaaaccctgggagagaaatggaagaagaaactcaatcagctaagtcgaaaggaatttgacctgtacaaaaagtctggcatcacggaggtggatagaaccgaggccaaagaaggtttgaagcgcggcgagattacacaccatgctgtctccagggggagcgccaaactgcagtggttcgttgaacggaacatggtgatccccgagggacgtgtcattgacctcggctgtgggagaggaggctggtcatattactgcgcaggtcttaagaaggtgactgaagtaagggggtataccaaaggaggccctggccacgaggagccggtgcccatgagtacatacgggtggaatatcgttaagctgatgagcggaaaagatgtgttttacttgccacctgaaaagtgtgacactctgctctgcgatattggtgagtcctctcccagccctaccgtcgaagagtcccgcacaatccgggtgttaaaaatggtcgagccatggctgaagaacaatcagttctgtataaaggtgcttaacccctatatgcctaccgttattgaacacctggagcgactacaaagaaaacatggcgggatgctcgtaaggaatccactgtcacgcaactctactcacgaaatgtactggatcagtaatggaacgggcaacatcgtggcctcggtcaatatggtgagccggttgctgctcaacagattcacaatgacccatcgtaggcccactattgagaaggacgttgatcttggtgctgggacccggcacgtgaacgcggaaccggagacacctaatatggacgtcataggagagcgcatcaaacgaattaaggaagagcacaactccacgtggcattatgacgatgaaaatccatacaaaacctgggcctatcacggctcttacgaggtgaaggcaactggctcagctagctccatgatcaacggggtagtgaagctgttaacaaaaccctgggacgttgtccctatggtgacccagatggccatgactgatacaaccccatttggacagcaaagagtgttcaaggaaaaagtcgacacaaggactccccggagtatgccgggtacccgcagagttatggagattacggcagagtggctgtggaggaccttgggccgaaataagaaacctcggctctgcacacgtgaagagtttactaagaaggtgagaaccaacgccgctatgggggccgtattcacagaagagaatcagtgggattctgcgaaagcagccgtggaagacgaggatttttggaagctggtcgaccgcgagagggaactacataaacttggaaagtgtggcagctgcgtgtataacatgatgggtaaacgggagaagaaactgggggaattcggaaaggctaagggctcaagagccatctggtacatgtggctcggcgcacgctacctggagtttgaggctttggggttcctgaatgaagatcactggttttccagggagaacagttatagcggagttgaaggtgagggcctccataaacttgggtacatactgcgagacatctctaagattcccggaggcgccatgtatgctgatgacactgccggttgggacacccggatcacggaagatgacttacacaatgaggagaaaattacacagcagatggatccagaacacagacaactggcaaacgcgatcttcaagttgacctaccagaataaagtggtcaaggtgcagaggcctactcccacagggaccgtaatggacataatttcccgcaaggatcagcgtggatcaggccaagttggcacttatgggctcaacacctttacaaatatggaggcccagctgatccggcagatggaaggagagggtgtgctaagcaaagctgaccttgaaaacccacatctgcccgagaagaaaatcacgcagtggctcgagaccaagggcgtcgaaagactgaaaaggatggccatttcgggggatgactgcgtggtgaagcctatagatgaccgcttcgcaaacgctttgttagccctgaatgatatgggaaaggtccgaaaagacatcccacaatggcagccgtctaagggctggcacgattggcagcaggttcccttttgtagtcatcacttccacgagctcattatgaaagacggtcggaagcttgtggtaccttgcagaccacaagacgaactgatcgggagggcacgcatttcccagggagccggctggagcctaagagagactgcgtgtctgggcaaagcttacgcccagatgtggtcactcatgtatttccatcggagggatttgcgtctggcatccaacgccatctgctctgctgtgcccgtccactgggtgcctacaagccgaaccacttggagtatacatgcccaccatcaatggatgacaaccgaagacatgcttacggtttggaatcgcgtgtggatcgaggataacccatggatggaggacaagacacccgtcaccacttgggaaaatgtgccttacctggggaagagagaggatcagtggtgtggatccctcattggtttaaccagccgggcaacatgggctcagaacatcccgactgccattcagcaagtaaggtctctgatcggcaatgaagagtttttggactacatgccatcaatgaaacgcttcagaaaggaggaagagagtgaaggggcgatttggtga

SEQ ID NO: 15156 - RNA, 9873 nt, synthetic construct
  misc_feature 1..9873: note = derived and/or modified CDS sequence (opt3) from DENV-3__GQ868547__SS-prME
  source 1..9873: mol_type = other RNA
accagcctgtgcctcgtgatgatccttcccgccgctctggcattccacttgacatccagagacggcgagcctaggatgattgtcgggaagaacgaacggggaaaatctttactgtttaagactgcctcaggtataaatatgtgtacgctaatcgcgatggatctcggcgagatgtgcgacgataccgttacatacaaatgtccacatattactgaagtggagccggaagacatcgattgctggtgtaacctgaccagtacatgggtaacctatgggacttgcaatcaggctggagagcgccgacgtgacaagagaagcgtggcccttgcaccccacgtcggcatgggtctggatacaaggacccaaacgtggatgtccgccgagggggcttggcggcaggtggaaaaagttgagacttgggcattgcgccatcctggattcaccattctcgccctgtttctggctcactacatcggcacatctctcactcagaaggtggtcatattcatcttactgatgcttgtgaccccatcgatgacaatgagatgtgtaggcgttgggaacagggactttgtggaaggattgtcaggtgccacctgggtcgatgtggtgctggagcatggcgggtgcgtcacgactatggcgaagaataaacccacactagacattgagctccagaagaccgaagcaactcaactggccacacttcggaaactgtgtatcgagggaaagattaccaacatcacgaccgatagccgctgccctacacagggcgaagctgttttgccagaggaacaggaccagaattatgtgtgtaaacacacttacgtagatcgaggttgggggaacggatgcggcctcttcggcaaggggagtctggtgacctgcgccaagtttcaatgtttagagcccatagagggaaaagtcgtgcagtatgaaaatctgaagtacacagttattatcactgtgcacaccggtgaccagcatcaggtcggcaacgagacacaaggggtgaccgcagaaattactcctcaggcttccacgacagaggccatcctcccagaatatggaacccttggcctggagtgctctccgagaactggtttggacttcaatgagatgatcctactgaccatgaaaaacaaggcgtggatggtacacaggcagtggtttttcgatctccccctgccttggacaagcggggccaccactgaaacaccaacgtggaatcggaaagagcttctggttacctttaagaacgcacatgctaaaaagcaagaagtggtcgtgttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtcctcaagaaagaggtgtctgaaacgcagcatgggaccatcctgattaaggttgagtaccgcggagaagatgctccctgtaagatccctttctccacagaggacggccaaggtaaagcgcacaacgggagacttataactgcaaatccagtggtaaccaagaaagaggaacccgtcaacattgaggccgaaccgcctttcggcgagtcaaatatcgtgatcggaattggcgataacgctttgaagatcaattggtataaaaaggggagcagtattggaaagatgtttgaagccacagcaaggggtgcccggcgaatggctatactgggcgacactgcctgggatttcgggtctgttggaggcgtgctcaactccctgggtaaaatggtccatcagatctttgggagcgcatacaccgcgcttttctcgggcgtgtcttgggtaatgaagattggaatcggcatcctgttgacgtggattgggctcaattccaaaaacacatcaatgagttttagctgcatagctatcggaattatcaccctgtatttaggcgccgtggttcaggcagacatgggttgtgtcattaattggaaggggaaagagctgaagtgcggatccggcatcttcgtgactaacgaggtgcacacatggaccgaacagtacaagtttcaagccgattctcccaaacgcctagctactgccatagcaggtgcttgggagaatggcgtctgtgggatcagaagcaccacaaggatggaaaacctcctgtggaagcagattgccaatgagcttaactatatcttgtgggaaaataacattaaactgacggttgtggtgggagacatcataggcgtactcgagcaggggaagcggaccctgactccacagcctatggagttaaaatactcatggaagacatggggaaaagcgaagatggtcaccgccgaaacacaaaacagttccttcattatcgatggccccaatactccagagtgccccagcgcttctcgcgcatggaacgtgtgggaagttgaggactatggttttggggtgttcaccacgaatatttggctgaagcttagagaagtccatacacagttgtgtgaccacaggctcatgtcagccgctgtgaaagatgagcgtgccgttcacgcagacatgggatactggatcgagagtcagaagaacggcagctggaaactggaaaaggcgtccctaatagaggtgaaaacctgcacttggcctaagtctcataccctgtggtcgaatggtgtactcgaaagcgatatgatcattccaaagtccctggccggcccgatctcacagcacaaccatcggcccgggtaccacacacaaactgctggaccttggcaccttggcaaattggagctggactttaattattgcgaggggaccacagtcgtgattacggaaaactgtggaacccgaggcccaagtttaagaactacaaccgtgtctggtaagctcatccatgagtggtgctgtaggagctgcactctgccccctcttcgctacatgggggaagatggatgttggtatggcatggagatacggccaatttccgaaaaagaggagaatatggtcaagtcactggttagcgccggttctggcaaagtggacaacttcacaatgggggtattgtgcctcgcaatcctgtttgaagaggtgatgagaggaaagttcggcaagaaacacatgatcgctggggtcttctttaccttcgtgctactgctctccggacagattacgtggagggatatgactcataccctgatcatgattggcagtaatgccagcgaccgcatgggtatgggggttacataccttgcattgatagccacctttaagatccagcccttcctggctttaggatttttcctccgaaaactgacttctcgggaaaaccttctgctaggcgtgggcctcgcgatggccacaaccctgcaattgccggaggatattgaacagatggcaaatgggatcgctctgggattaatggccctcaagctgattacacagtttgagacttatcagctttggaccgccctgatctccttgacgtgttcaaacacaatgttcaccctcactgtcgcttggcgtaccgcaacactgatactagccggtgtgagtctgcttcctgtttgccaaagctcgtccatgagaaaaactgactggctcccaatggcggtggctgccatgggcgtcccccctctgcccttgtttatcttctctctgaaggataccttaaagaggcgcagctggccactcaatgagggggtaatggcagtgggactggtttcaattcttgccagttccctgttgcggaacgacgtgcctatggctggccccctcgtcgcaggtgggctgctaatcgcctgttacgtgattacgggaacatctgcggatctgaccgtagaaaaagctgccgacatcacttgggaggaagaggcagaacagacaggcgtgagccacaaccttatgataaccgtcgacgatgacggcactatgagaattaaggatgacgagacagagaatatcctcaccgttctgttgaaaacggccttactgatcgtgtccggggtgtttccatattcaattccggctactctcctggtctggcatacctggcagaagcagacacaaaggagcggagtgctttgggatgttcctagtcccccagaaacccagaaagccgagctggaagagggtgtataccgaataaagcagcagggcatcttcgggaaaacacaagtgggagtcggcgtgcagaaggagggtgtttttcacactatgtggcacgtgacccgcggggcagtcttgacgtacaacggaaagcggctagaacccaattgggcttctgtgaaaaaggacctgatttcctatggcggcgggtggagactcagcgcccagtggcaaaaaggagaggaagtacaggtcatcgcggtggagcctggtaagaacccaaaaaatttccagacaactcccggcaccttccagacaaccactggggaaattggagccatcgcactggattttaagcctggcacctcgggttcaccgataatcaacagggaggggaaggttgtgggactttacggcaatggcgtcgtgacaaaaaacgggggatatgtttctggtattgctcaaacgaatgccgagccagacggccccactcctgaattagaggaagagatgttcaagaaacgtaacctgaccatcatggatctccatccagggagtggaaagacacgcaaatacttgcccgctattatccgggaagcaataaagagaaggctgcgaaccctcattctggcccctactcgggtggtcgccgctgagatggaggaagcgcttaagggcctgccgatccgctatcagacaaccgcaacgaaatccgagcacactggtagagaaatcgtggacttgatgtgccatgccacatttaccatgaggctactgagccccgtacgggtgccaaattacaacctcattatcatggatgaggctcacttcaccgaccctgcctctatagcagcccgagggtatattagcactagagttggaatgggcgaagctgcggccatctttatgacagcaacccccccaggcacagctgatgccttccctcagtccaatgcacccattcaggacgaggagcgcgacatcccagaaaggtcatggaacagtgggaatgagtggataactgattttgccggaaagacggtctggttcgtgccgagcattaaagctggtaacgacatcgccaactgtttacgtaagaatggcaaaaaggtgatccaactgtctcggaagacctttgatacagaataccagaaaactaagcttaacgactgggatttcgtcgtaaccacagacatttccgagatgggggcgaattttaaagcagatagagtgatcgaccctaggcgctgcctgaagcccgttattctcaccgatggaccagagcgagtgatattggccggccccatgcctgtcactgctgcctcagctgcacagagacggggtagggtggggcgcaacccacagaaagaaaatgaccaatacatcttcacgggccagcccctgaacaatgatgaggaccatgcccactggaccgaagctaagatgctcctggacaacattaatacacctgagggaatcatcccggcccttttcgaaccagagcgtgagaagagtgcagcgattgatggcgaatatagactaaaaggggagagccggaagacttttgttgaactgatgaggcgcggagacttgcccgtgtggttagcccacaaagtcgcttccgagggtataaagtacaccgatcgaaaatggtgcttcgacggccagagaaacaatcagatcctggaagagaacatggatgtggagatttggacaaaggaaggggagaaaaagaagctccggcctaggtggctggacgcccgcacctattctgatccccttgcactgaaagaatttaaggacttcgctgccggaagaaaatcgatcgcactcgatttggtaactgagattggcagggtgccaagccatctggcccaccggacacgtaatgctctagacaacctggttatgctccatacgtcagaacacggtgggcgcgcgtaccgacacgccgtcgaggagcttcctgaaaccatggagactctgttattgctgggcctcatgatcctgcttacaggaggcgcaatgctgtttctcatatccgggaagggaatcggtaaaaccagtattggcttgatctgtgtgattgcttctagcgggatgctgtggatggccgaaatccccttacaatggatagcctccgcaattgtgctagagttctttatgatggtcctgctcatcccagagcctgaaaagcagagaaccccgcaggataatcaacttgcttatgttgtgattggaatcctgacattggccgcgataatcgctgccaacgagatgggcctgctcgaaactacgaagagggacctgggtatgtcaaaagagcccggggtagtgtctccaaccagctaccttgatgtcgacctccatcctgcaagtgcctggacactgtatgctgtggcaactaccgttattacacccatgttgcggcacaccatcgaaaattccactgccaacgtgagcctggcggctattgccaaccaggcagtcgtattaatgggcctagacaagggatggccaatctctaaaatggatctgggcgtgcctctccttgccctggggtgctactcacaggttaatcccttgacgctgacagctgccgtgctcctgcttataacccattacgcaattatcggaccgggcttacaggctaaggccactcgcgaggcgcaaaaaagaaccgccgcaggtatcatgaagaacccaacagtcgacgggattatgactatcgatctggaccctgtgatatatgattccaagttcgagaaacagctcggacaggtcatgttgctggtgctatgtgctgttcagctgctccttatgaggaccagttgggccctgtgcgaagcattgacactggctacgggccccattaccactctctgggagggtagcccaggcaagttttggaatacaaccatcgccgtgtcgatggccaacattttccgggggtcttacctggcgggagctggcttagcattttccatcatgaaaagcgtagggactggaaagcgaggcacaggttcacaaggggaaacccttggagagaaatggaagaagaaactgaatcagctcagtagaaaggaattcgacctatataaaaagtctggcataacggaggtggatcgcaccgaggccaaagaaggtctgaagaggggcgagatcacacaccatgctgtctcccgggggagcgccaaattgcagtggtttgttgaacgtaacatggtgattcccgagggaagagtcatcgacctgggctgtgggaggggaggctggtcatactattgcgcaggtctcaagaaggtgactgaagtacgcgggtacaccaaaggaggccctggccacgaggagccggtgcccatgagtacatatgggtggaatattgttaagcttatgagcggaaaagatgtgttctacctgccacctgaaaagtgtgacactttgctgtgcgatatcggtgagtcctctcccagccctaccgtcgaagagtcccggacaattcgagtgctcaaaatggtcgagccatggttaaagaacaatcagttctgtatcaaggtgctgaacccctacatgcctaccgttatagaacaccttgagagactgcaaaggaaacatggcgggatgctagtacgcaatccactctcacggaactctactcacgaaatgtattggattagtaatggaacgggcaacatcgtggcctcggtcaatatggtgagcagactgttgctgaaccgttttacaatgacccataggcggcccactatcgagaaggacgttgatctcggtgctgggacccgccacgtgaacgcggaaccggagacacctaatatggacgtcattggagagcgaataaaaagaatcaaggaagagcacaactccacgtggcattacgacgatgaaaatccatataaaacctgggcctaccacggctcttatgaggtgaaggcaactggctcagctagctccatgattaacggggtagtgaagcttctgacaaaaccctgggacgttgtccctatggtgacccagatggccatgactgatacaaccccattcggacagcaaagggtgtttaaggaaaaagtcgacacacggactccccgcagtatgccgggtaccagaagggttatggagatcacggcagagtggttatggcgaaccctgggccggaataagaaacctcgtttgtgcacaagagaagagttcactaagaaggtgcgcaccaacgccgctatgggggccgtatttacagaagagaatcagtgggattctgcgaaagcagccgtggaagacgaggatttctggaagctcgtcgacagggagcgggaactgcataaactaggaaagtgtggcagctgcgtgtacaacatgatgggtaaaagagagaagaaacttggggaatttggaaaggctaagggctcacgcgccatttggtatatgtggctgggcgcaaggtacctcgagttcgaggctctggggtttttgaatgaagatcactggttctcccgagagaacagttacagcggagttgaaggtgagggcctgcataaactcgggtatatccttcgggacatatctaagatccccggaggcgccatgtacgctgatgacactgccggttgggacaccagaattacggaagatgacctgcacaatgaggagaaaatcacacagcagatggatccagaacacaggcaattagcaaacgcgatttttaagctgacctatcagaataaagtggtcaaggtgcagcgccctactcccacagggaccgtaatggacatcatatcccgtaaggatcagcggggatcaggccaagttggcacttacgggttgaacaccttcacaaatatggaggcccagctcattagacagatggaaggagagggtgtgctgagcaaagctgacctagaaaacccacatcttcccgagaagaaaatcacgcagtggctggagaccaagggcgtcgaaaggctcaaacgcatggccatctcgggggatgactgcgtggtgaagcctattgatgaccgatttgcaaacgctctgttggccttaaatgatatgggaaaggtccggaaagacataccacaatggcagccgtctaagggctggcacgattggcagcaggttcccttctgtagtcatcacttccacgagctgatcatgaaagacggtagaaagctcgtggtaccttgcaggccacaagacgaacttattgggcgcgcaagaatctcccagggagccggctggagcctgcgggagactgcgtgtctaggcaaagcttatgcccagatgtggtcactgatgtactttcataggcgtgatctccgattggcatccaacgccatttgctctgctgtgcccgtccactgggtgcctacaagccgcaccacttggagtatccatgcccaccatcaatggatgacaaccgaagacatgctgacggtttggaatagagtgtggatagaggataacccatggatggaggacaagacacccgtcaccacttgggaaaatgtgccttatcttgggaagcgggaggatcagtggtgtggatccctgatcggtctcaccagcagggcaacatgggctcagaacattccgactgccatccagcaagtacgctctttaattggcaatgaagagttcctggactacatgccatcaatgaaaagatttcggaaggaggaagagagtgaaggggcgatctggtga

SEQ ID NO: 15157 - RNA, 9873 nt, synthetic construct
  misc_feature 1..9873: note = derived and/or modified CDS sequence (opt3) from DENV-3__GU131857__SS-prME
  source 1..9873: mol_type = other RNA
accagcctgtgcctcgtgatgatccttcccgccgctctggcattccacttgacatccagagacggcgagcctaggatgattgtcgggaagaacgaacggggaaaatctttactgtttaagactgcctcaggtataaatatgtgtacgctaatcgcgatggatctcggcgagatgtgcgacgataccgttacatacaaatgtccacatattactgaagtggagccggaagacatcgattgctggtgtaacctgaccagtacatgggtaacctatgggacttgcaatcaggctggagagcgccgacgtgacaagagaagcgtggcccttgcaccccacgtcggcatgggtctggatacaaggacccaaacgtggatgtccgccgagggggcttggcggcaggtggaaaaagttgagacttgggcattgcgccatcctggattcaccattctcgccctgtttctggctcactacatcggcacatctctcactcagaaggtggtcatattcatcttactgatgcttgtgaccccatcgatgacaatgagatgtgtaggcgttgggaacagggactttgtggaaggattgtcaggtgccacctgggtcgatgtggtgctggagcatggcgggtgcgtcacgactatggcgaagaataaacccacactagacattgagctccagaagaccgaagcaactcaactggccacacttcggaaactgtgtatcgagggaaagattaccaacatcacgaccgatagccgctgccctacacagggcgaagctgttttgccagaggaacaggaccagaattatgtgtgtaaacacacttacgtagatcgaggttgggggaacggatgcggcctcttcggcaaggggagtctggtgacctgcgccaagtttcaatgtttagagcccatagagggaaaagtcgtgcagtatgaaaatctgaagtacacagttattatcactgtgcacaccggtgaccagcatcaggtcggcaacgagacacaaggggtgaccgcagaaattactcctcaggcttccacgacagaggccatcctcccagaatatggaacccttggcctggagtgctctccgagaactggtttggacttcaatgagatgatcctactgaccatgaaaaacaaggcgtggatggtacacaggcagtggtttttcgatctccccctgccttggacaagcggggccaccactgaaacaccaacgtggaatcggaaagagcttctggttacctttaagaacgcacatgctaaaaagcaagaagtggtcgtgttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtcctcaagaaagaggtgtctgaaacgcagcatgggaccatcctgattaaggttgagtaccgcggagaagatgctccctgtaagatccctttctccacagaggacggccaaggtaaagcgcacaacgggagacttataactgcaaatccagtggtaaccaagaaagaggaacccgtcaacattgaggccgaaccgcctttcggcgagtcaaatatcgtgatcggaattggcgataacgctttgaagatcaattggtataaaaaggggagcagtattggaaagatgtttgaagccacagcaaggggtgcccggcgaatggctatactgggcgacactgcctgggatttcgggtctgttggaggcgtgctcaactccctgggtaaaatggtccatcagatctttgggagcgcatacaccgcgcttttctcgggcgtgtcttgggtaatgaagattggaatcggcatcctgttgacgtggattgggctcaattccaaaaacacatcaatgagttttagctgcatagctatcggaattatcaccctgtatttaggcgccgtggttcaggcagacatgggttgtgtcattaattggaaggggaaagagctgaagtgcggatccggcatcttcgtgactaacgaggtgcacacatggaccgaacagtacaagtttcaagccgattctcccaaacgcctagctactgccatagcaggtgcttgggagaatggcgtctgtgggatcagaagcaccacaaggatggaaaacctcctgtggaagcagattgccaatgagcttaactatatcttgtgggaaaataacattaaactgacggttgtggtgggagacatcataggcgtactcgagcaggggaagcggaccctgactccacagcctatggagttaaaatactcatggaagacatggggaaaagcgaagattgtcaccgccgaaacacaaaacagttccttcatcattgatggccccaatactccagagtgccccagcgcttctcgcgcatggaacgtgtgggaagttgaggactatggttttggggtgttcaccacgaatatctggctgaagcttagagaagtctacacacagttgtgtgaccataggctcatgtcagccgctgtgaaagatgagcgtgccgttcacgcagacatgggatactggatagagagtcagaagaacggcagctggaaactggaaaaggcgtccctaatcgaggtgaaaacctgcacttggcctaagtctcacaccctgtggtcgaatggtgtactcgaaagcgatatgattatcccaaagtccctggccggcccgatttcacagcataaccaccggcccgggtatcatacacaaactgctggaccttggcaccttggcaaattggagctggactttaattactgcgaggggaccacagtcgtgatcacggaaaactgtggaacccgaggcccaagtttaagaactacaaccgtgtctggtaagctcatacacgagtggtgctgtaggagctgcactctgccccctcttcgctatatgggggaagatggatgttggtacggcatggagattcggccaatctccgaaaaagaggagaatatggtcaagtcactggttagcgccggttctggcaaagtggacaacttcacaatgggggtattgtgcctcgcaatcctgtttgaagaggtgatgagaggaaagttcggcaagaaacatatgattgctggggtcttctttaccttcgtgctactgctctccggacagatcacgtggagggatatgactcacaccctgattatgataggcagtaatgccagcgaccgcatgggtatgggggttacatatcttgcattgatcgccacctttaagattcagcccttcctggctttaggatttttcctccgaaaactgacttctcgggaaaaccttctgctaggcgtgggcctcgcgatggccacaaccctgcaattgccggaggatatcgaacagatggcaaatgggattgctctgggattaatggccctcaagctgatcacacagtttgagacttaccagctttggaccgccctgatatccttgacgtgttcaaacacaatgttcaccctcactgtcgcttggcgtaccgcaacactgatcctagccggtgtgagtctgcttcctgtttgccaaagctcgtccatgagaaaaactgactggctcccaatggcggtggctgccatgggcgtcccccctctgcccttgtttattttctctctgaaggataccttaaagaggcgcagctggccactcaatgagggggtaatggcagtgggactggtttcaatccttgccagttccctgttgcggaacgacgtgcctatggctggccccctcgtcgcaggtgggctgctaattgcctgttatgtgatcacgggaacatctgcggatctgaccgtagaaaaagctgccgacataacttgggaggaagaggcagaacagacaggcgtgagccataaccttatgattaccgtcgacgatgacggcactatgagaatcaaggatgacgagacagagaatatcctcaccgttctgttgaaaacggccttactgattgtgtccggggtgtttccatactcaataccggctactctcctggtctggcacacctggcagaagcagacacaaaggagcggagtgctttgggatgttcctagtcccccagaaacccagaaagccgagctggaagagggtgtataccgaatcaagcagcagggcattttcgggaaaacacaagtgggagtcggcgtgcagaaggagggtgtttttcatactatgtggcacgtgacccgcggggcagtcttgacgtataacggaaagcggctagaacccaattgggcttctgtgaaaaaggacctgatctcctacggcggcgggtggagactcagcgcccagtggcaaaaaggagaggaagtacaggtcattgcggtggagcctggtaagaacccaaaaaatttccagacaactcccggcaccttccagacaaccactggggaaatcggagccatagcactggattttaagcctggcacctcgggttcaccgatcattaacagggaggggaaggttgtgggactttatggcaatggcgtcgtgacaaaaaacgggggatacgtttctggtatcgctcaaacgaatgccgagccagacggccccactcctgaattagaggaagagatgttcaagaaacgtaacctgaccattatggatctccacccagggagtggaaagacacgcaaatatttgcccgctatcatacgggaagcaattaagagaaggctgcgaaccctcatcctggcccctactcgggtggtcgccgctgagatggaggaagcgcttaagggcctgccgatccgctaccagacaaccgcaacgaaatccgagcatactggtagagaaattgtggacttgatgtgccacgccacatttaccatgaggctactgagccccgtacgggtgccaaattataacctcatcataatggatgaggctcatttcaccgaccctgcctctattgcagcccgagggtacatcagcactagagttggaatgggcgaagctgcggccatttttatgacagcaacccccccaggcacagctgatgccttccctcagtccaatgcacccatccaggacgaggagcgcgacataccagaaaggtcatggaacagtgggaatgagtggattactgattttgtcggaaagacggtgtggttcgtgccgagcatcaaagccggtaacgacatcgctaactgtttacgtaagaatggcaaaaaggtcattcaactgtctcggaagacctttgatacagaataccagaaaactaagcttaacgactgggatttcgtagtgaccacagacatctccgagatgggggccaattttaaagcggatagagttattgaccctaggcgctgcctgaagcccgtgatactcaccgatggaccagagcgagtcatcttggcaggccccatgcctgtgactgccgcttcagccgctcagagacggggtagggttgggcgcaacccacagaaagaaaatgaccaatatattttcacgggccagcccctgaacaatgatgaggaccacgcacattggaccgaagccaagatgctcctggacaacatcaatacacctgagggaatcattccggctcttttcgaaccagagcgtgagaagagtgccgcaatagatggcgaatacagactaaaaggggagagccggaagacttttgtggaactgatgaggcgcggagacttgcccgtctggttagcgcacaaagtggcctccgagggtatcaagtataccgatcgaaaatggtgcttcgacggccagagaaacaatcagattctggaagagaacatggatgtagagatctggacaaaggaaggggagaaaaagaagctccggcctaggtggctggacgctcgcacctactctgatccccttgccctgaaagaatttaaggacttcgcagctggaagaaaatcgattgccctcgatttggtgactgagatcggcagggttccaagccacctggcacatcggacacgtaatgccctagacaacctggtcatgctccacacgtcagaacatggtgggcgcgcttatcgacacgcggtggaggagcttcctgaaaccatggagactctgttattgctgggcctcatgatactgcttacaggaggcgccatgctgtttctcatctccgggaagggaattggtaaaaccagtatcggcttgatttgtgtgatcgcatctagcgggatgctgtggatggctgaaatacccttacaatggattgcctccgccatcgtcctagagttctttatgatggttctgctcattccagagcctgaaaagcagagaaccccgcaggataatcaacttgcatacgtggtaatcggaatactgacattggctgccatcattgcggctaacgagatgggcctgctcgaaactacgaagagggacctgggtatgtcaaaagagcccggggtggtctctccaaccagctatcttgatgtggacctccaccctgccagtgcatggacactgtacgccgttgctactaccgtgatcacacccatgttgcggcataccattgaaaattccactgcaaacgtcagcctggccgcgatcgctaaccaggccgtagtgttaatgggcctagacaagggatggccaatatctaaaatggatctgggcgttcctctccttgcactggggtgctactcacaggtgaatcccttgacgctgacagccgctgtcctcctgcttattacccactatgccatcatcggaccgggcttacaggcaaaggctactcgcgaggcccaaaaaagaaccgcggccggtattatgaagaacccaacagtggacgggatcatgactatagatctggaccctgtcatttacgattccaagttcgagaaacagctcggacaggtgatgttgctggttctatgtgcagtgcagctgctccttatgaggaccagttgggctctgtgcgaagccttgacactggcaacgggccccatcaccactctctgggagggtagcccaggcaagttttggaatacaaccattgctgtatcgatggccaacatcttccgggggtcttatctggccggagcgggcttagctttttccataatgaaaagcgtggggactggaaagcgaggcacaggttcacaaggggaaacccttggagagaaatggaagaagaaactgaatcagctcagtagaaaggaattcgacctatacaaaaagtctggcatcacggaggtcgatcgcaccgaggcaaaagaaggtctgaagaggggcgagattacacatcacgccgtttcccgggggagcgctaaattgcagtggtttgtggaacgtaacatggtcatccccgagggaagagtgattgacctgggctgtgggaggggaggctggtcatattactgcgccggtctcaagaaggtaactgaagtgcgcgggtataccaaaggaggccctggccatgaggagccggttcccatgagtacatacgggtggaatatcgtgaagcttatgagcggaaaagatgtcttctacctgccacctgaaaagtgtgacactttgctgtgcgatattggtgagtcctctcccagccctaccgtggaagagtcccggacaatccgagtcctcaaaatggtggagccatggttaaagaacaatcagttctgtataaaggttctgaacccctatatgcctaccgtaattgaacaccttgagagactgcaaaggaaacacggcgggatgctagtgcgcaatccactctcacggaactctactcatgaaatgtactggatcagtaatggaacgggcaacatcgtcgcatcggtgaatatggttagcagactgttgctgaaccgttttacaatgacccacaggcggcccactattgagaaggacgtggatctcggtgccgggacccgccatgtcaacgctgaaccggagacacctaatatggacgtgataggagagcgaatcaaaagaattaaggaagagcacaactccacgtggcactatgacgatgaaaatccatacaaaacctgggcgtatcatggctcttacgaggtaaaggccactggctcagcaagctccatgatcaacggggtggttaagcttctgacaaaaccctgggacgtcgtgcctatggtgacccagatggctatgactgatacaaccccattcggacagcaaagggtctttaaggaaaaagttgacacacggactccccgcagtatgccgggtaccagaagggtgatggagattacggccgagtggttatggcgaaccctgggccggaataagaaacctcgtttgtgcacaagagaagagttcactaagaaggtacgcaccaacgcagccatgggggctgtgtttacagaagagaatcagtgggattctgccaaagcggcagtcgaagacgaggatttctggaagctcgtggacagggagcgggaactgcacaaactaggaaagtgtggcagctgcgtttataacatgatgggtaaaagagagaagaaacttggggaatttggaaaggccaagggctcacgcgctatctggtacatgtggctgggcgccaggtacctcgagttcgaggcactggggtttttgaatgaagatcattggttctcccgagagaacagttatagcggagtggaaggtgagggcctgcacaaactcgggtacatacttcgggacatctctaagattcccggaggcgctatgtatgccgatgacactgctggttgggacaccagaatcacggaagatgacctgcataatgaggagaaaattacacagcagatggatccagaacacaggcaattagccaacgcaatctttaagctgacctaccagaataaagtcgtgaaggtacagcgccctactcccacagggaccgttatggacataatttcccgtaaggatcagcggggatcaggccaagtgggcacttatgggttgaacaccttcacaaatatggaggcgcagctcatcagacagatggaaggagagggtgtcctgagcaaagccgacctagaaaacccacaccttcccgagaagaaaatcacgcagtggctggagaccaagggcgtggaaaggctcaaacgcatggctatttcgggggatgactgcgtggtcaagcctatagatgaccgatttgccaacgcactgttggctttaaatgatatgggaaaggttcggaaagacatcccacaatggcagccgtctaagggctggcatgattggcagcaggtgcccttctgtagtcaccatttccacgagctgattatgaaagacggtagaaagctcgtagtgccttgcaggccacaagacgaacttatcgggcgcgccagaatttcccagggagcaggctggagcctgcgggagactgcctgtctaggcaaagcgtacgctcagatgtggtcactgatgtattttcacaggcgtgatctccgattggcctccaacgcaatctgctctgccgtccccgtgcattgggttcctacaagccgcaccacttggagtatacacgctcatcaccaatggatgacaaccgaagacatgctgacggtgtggaatagagtctggatcgaggataacccatggatggaggacaagacacccgtgaccacttgggaaaatgtaccttaccttgggaagcgggaggatcagtggtgtggatccctgattggtctcaccagcagggccacatgggcacagaacatcccgactgctattcagcaagttcgctctttaatcggcaatgaagagttcctggactacatgccatcaatgaaaagatttcggaaggaggaagagagtgaaggggccatttggtga

SEQ ID NO: 15158 - RNA, 9873 nt, synthetic construct
  misc_feature 1..9873: note = derived and/or modified CDS sequence (opt3) from DENV-3__GU131858__SS-prME
  source 1..9873: mol_type = other RNA
accagcctgtgcctcgtgatgatccttcccgccgctctggcattccacttgacatccagagacggcgagcctaggatgattgtcgggaagaacgaacggggaaaatctttactgtttaagactgcctcaggtataaatatgtgtacgctaatcgcgatggatctcggcgagatgtgcgacgataccgttacatacaaatgtccacatattactgaagtggagccggaagacatcgattgctggtgtaacctgaccagtacatgggtaacctatgggacttgcaatcaggctggagagcgccgacgtgacaagagaagcgtggcccttgcaccccacgtcggcatgggtctggatacaaggacccaaacgtggatgtccgccgagggggcttggcggcaggtggaaaaagttgagacttgggcattgcgccatcctggattcaccattctcgccctgtttctggctcactacatcggcacatctctcactcagaaggtggtcatattcatcttactgatgcttgtgaccccatcgatgacaatgagatgtgtaggcgttgggaacagggactttgtggaaggattgtcaggtgccacctgggtcgatgtggtgctggagcatggcgggtgcgtcacgactatggcgaagaataaacccacactagacattgagctccagaagaccgaagcaactcaactggccacacttcggaaactgtgtatcgagggaaagattaccaacatcacgaccgatagccgctgccctacacagggcgaagctgttttgccagaggaacaggaccagaattatgtgtgtaaacacacttacgtagatcgaggttgggggaacggatgcggcctcttcggcaaggggagtctggtgacctgcgccaagtttcaatgtttagagcccatagagggaaaagtcgtgcagtatgaaaatctgaagtacacagttattatcactgtgcacaccggtgaccagcatcaggtcggcaacgagacacaaggggtgaccgcagaaattactcctcaggcttccacgacagaggccatcctcccagaatatggaacccttggcctggagtgctctccgagaactggtttggacttcaatgagatgatcctactgaccatgaaaaacaaggcgtggatggtacacaggcagtggtttttcgatctccccctgccttggacaagcggggccaccactgaaacaccaacgtggaatcggaaagagcttctggttacctttaagaacgcacatgctaaaaagcaagaagtggtcgtgttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtcctcaagaaagaggtgtctgaaacgcagcatgggaccatcctgattaaggttgagtaccgcggagaagatgctccctgtaagatccctttctccacagaggacggccaaggtaaagcgcacaacgggagacttataactgcaaatccagtggtaattaagaaagaggaacccgtcaacatcgaggccgaaccgcctttcggcgagtcaaatatcgtgattggaatcggcgataacgctttgaagattaattggtataaaaaggggagcagtataggaaagatgtttgaagccaccgcaaggggtgcccggcgaatggctatcctgggcgacacagcctgggatttcgggtctgttggaggcgtgctcaactccctgggtaaaatggtccatcagatttttgggagcgcatacactgcgcttttctcgggcgtgtcttgggtaatgaagatcggaatcggcattctgttgacctggatagggctcaattccaaaaacacgtcaatgagttttagctgcatcgctattggaatcattacactgtatttaggcgccgtggttcaggcagacatcggttgtgtcataaattggaaggggaaagagctgaagtgcggatccggcatcttcgtgaccaacgaggtgcacacttggacagaacagtacaagtttcaagccgattctcccaaacgcctagctaccgccattgcaggtgcttgggagaatggcgtctgtgggatcagaagcactaccaggatggaaaacctcctgtggaagcagattgccaatgagcttaactatatcttgtgggaaaataacataaaactgacagttgtggtgggagacattatcggcgtactcgagcaggggaagcggacgctgaccccacagcctatggagttaaaatactcatggaagacttggggaaaagcgaagattgtcacagccgaaacccaaaacagttccttcatcatagatggccccaatacaccagagtgccccagcgcttctcgcgcatggaacgtgtgggaagttgaggactatggttttggggtgttcactaccaatatctggctgaagcttagagaagtctacacgcagttgtgtgaccataggctcatgtcagccgctgtgaaagatgagcgtgccgttcacgcagacatgggatactggattgagagtcagaagaacggcagctggaaactggaaaaggcgtccctaatcgaggtgaaaacatgcacctggcctaagtctcacactctgtggtcgaatggtgtactcgaaagcgatatgattatcccaaagtccctggccggcccgatatcacagcataaccaccggcccgggtatcatacccaaacagctggaccttggcaccttggcaaattggagctggactttaattactgcgaggggactaccgtcgtgattacagaaaactgtggaacgagtggcccatctttaaccactacaaccgtgagcggtaagctcatccacgagtggtgctgtcgatcctgcactctgccccctcttagatatatgggggaagatggatgttggtacggcatggagatcaggccaatttcagaaaaagaggagaatatggtcaagagcctggtttctgccggttccggcaaagtggacaacttcacaatgggggtattgtgcctcgcaatcctgtttgaagaggtgatgcgcggaaagttcggcaagaaacatatgattgctggggtcttctttaccttcgtgctactgctcagtggacagataacgtggcgggatatgactcacaccctgatcatgattggcagcaatgcctctgacagaatgggtatgggggttacatatcttgcattgatcgccacctttaagattcagcccttcctggctttaggatttttcctcaggaaactgacttcccgcgaaaaccttctgctaggcgtgggcctcgcgatggccacaaccctgcaattgccggaggatatcgaacagatggcaaatgggatagctctgggattaatggccctcaagctgatcacacagtttgagacttaccagctttggaccgccctgatttcattgacgtgtagtaacacaatgttcaccctcactgtcgcttggcgaaccgcaacactgatcctagccggtgtgagcctgcttcctgtttgccaatcgtcctctatgcggaaaactgactggctcccaatggcggtggctgccatgggcgtcccccctctgcccttgtttattttcagcctgaaggataccttaaagcgtagatcatggccactcaatgagggggtaatggcagtgggactggttagtatccttgcctcctctctgttgaggaacgacgtgcctatggctggccccctcgtcgcaggtgggctgctaatagcctgttatgtgattacgggaacaagcgcggatctgaccgtagaaaaagctgccgacatcacttgggaggaagaggcagaacagacaggcgtgtcccataaccttatgatcaccgtcgacgatgacggcactatgcgcattaaggatgacgagacagagaatatactcaccgttctgttgaaaacggccttactgatcgtgtcaggggtgtttccatacagcattccggctactctcctggtctggcacacctggcagaagcagacacaacggagtggagtgctttgggatgttccttctcccccagaaacccagaaagccgagctggaagagggtgtatacagaatcaagcagcagggcattttcgggaaaacacaagtgggagtcggcgtgcagaaggagggtgtttttcatactatgtggcacgtgaccaggggggcagtcttgacgtataacggaaagcgactagaacccaattgggcttccgtgaaaaaggacctgatcagctacggcggcgggtggcgcctctcggcccagtggcaaaaaggagaggaagtacaggtcatagcggtggagcctggtaagaacccaaaaaatttccagacaatgcccggcactttccagaccacaaccggggaaatcggagccattgcactggattttaagcctggcacttcaggttctccgatcattaaccgggaggggaaggttgtgggactttatggcaatggcgtcgtgaccaaaaacgggggatacgttagtggtatcgctcaaacaaatgccgagccagacggccccacgcctgaattagaggaagagatgttcaagaaaagaaacctgactataatggatctccacccagggtccggaaagaccaggaaatatttgcccgctattatccgtgaagcaatcaagcgccggctgagaacactcattctggcccctaccagggtggtcgccgctgagatggaggaagcgcttaagggcctgccgatccgataccagactacagcaaccaaaagcgagcatacgggtcgggaaatagtggacttgatgtgccacgccacttttacaatgcgcctactgtctcccgtaagagtgccaaattataacctcattatcatggatgaggctcatttcaccgaccctgccagcattgcagccagggggtacatctccacccgggttggaatgggcgaagctgcggccatatttatgactgcaacacccccaggcaccgctgatgccttccctcagtcaaatgcacccattcaggacgaggagcgagacatcccagaaagaagttggaacagcgggaatgagtggatcacagattttgtcggaaagactgtgtggttcgtgccgtctattaaagccggtaacgacatcgctaactgtttacgcaagaatggcaaaaaggtcattcaactgtccaggaagacgtttgataccgaataccagaaaacaaagcttaacgactgggatttcgtagtgactaccgacatatcagagatgggggccaattttaaagcggatcgtgttatcgaccctcggagatgcctgaagcccgtgattctcacagatggaccagagagggtcatcttggcaggccccatgcctgtgaccgccgctagtgccgctcagcgccgaggtagagttgggcggaacccacagaaagaaaatgaccaatatatcttcactggccagcccctgaacaatgatgaggaccacgcacattggacggaagccaagatgctcctggacaacattaatacccctgagggaataatcccggctcttttcgaaccagagagggagaagagcgccgcaattgatggcgaataccgcctaaaaggggagtcccgtaagacatttgtggaactgatgagacggggagacttgcccgtctggttagcgcacaaagtggcctctgagggtatcaagtatactgataggaaatggtgcttcgacggccagcgcaacaatcagattctggaagagaacatggatgtagagatctggaccaaggaaggggagaaaaagaagctccgacctagatggctggacgctcggacatactcggatccccttgccctgaaagaatttaaggacttcgcagctggaaggaaaagcatagccctcgatttggtgaccgagatcggccgcgttccatcacacctggcacatagaactaggaatgccctagacaacctggtcatgctccacacatccgaacatggtgggcgggcttatcgtcacgcggtggaggagcttcctgaaacgatggagaccctgttattgctgggcctcatgattctgcttactggaggcgccatgctgtttctcatcagtgggaagggaattggtaaaacatctatcggcttgatatgtgtgattgcaagctccgggatgctgtggatggctgaaatccccttacaatggattgcctcagccatcgtcctagagttctttatgatggttctgctcataccagagcctgaaaagcagcgcaccccgcaggataatcaacttgcatacgtggtaatcggaattctgaccttggctgccatcattgcggctaacgagatgggcctgctcgaaacaactaagcgagacctgggtatgtctaaagagcccggggtggtcagcccaaatagttatcttgatgtggacctccaccctgcctccgcatggacgctgtacgccgttgctaccacagtgatcactcccatgttgagacataccatagaaaacagcacagcaaacgtctctctggccgcgattgctaatcaggccgtagtgttaatgggcctagacaagggatggccaatctcaaaaatggatctgggcgttcctctccttgcactggggtgctactcccaggtgaaccccttgaccctgactgccgctgtcctcctgcttatcacgcactatgccattatcggaccgggcttacaggcaaaggctacaagggaggcccaaaaacggaccgcggccggtataatgaagaatccaactgtggacgggattatgaccatcgatctggaccctgtcatttacgatagtaagttcgagaaacagctcggacaggtgatgttgctggttctatgtgcagtgcagctgctccttatgcgcacaagctgggctctgtgcgaagccttgactctggcaaccggccccatcacaacgctctgggagggttcgccaggcaagttttggaacaccactatagctgtatctatggccaatatcttcagagggtcctatctggccggagcgggcttagcttttagcattatgaaatcagtggggacaggaaagaggggcaccggtagtcaaggggaaactcttggagagaaatggaagaagaaactgaaccagctctctcggaaggaattcgacctatacaaaaagtccggcatcacagaggtcgatcgaaccgaggcaaaagaaggtctgaagagaggcgagattacgcatcacgccgttagccgcgggtcagctaaattgcagtggtttgtggaaaggaatatggtcatccccgagggacgggtgattgacctgggctgtgggcgtggaggctggagttattactgcgccggtctcaagaaggtaaccgaagtgagagggtatacaaaaggaggccctggccatgaggagccggttcccatgagcacttacgggtggaacatcgtgaagcttatgtccggaaaagatgtcttctacctgccacctgaaaagtgtgacaccttgctgtgcgatataggtgagtctagcccctcccctacagtggaagagtcaaggactattcgcgtcctcaaaatggtggagccatggttaaagaataaccagttctgtatcaaggttctgaatccctatatgcctaccgtaatcgaacaccttgagcggctgcaacgaaaacacggcgggatgctagtgagaaacccactctctaggaatagtacacatgaaatgtactggatttcgaacggaaccggcaatatagtcgcaagcgtgaacatggtttcccgcctgttgctgaaccggtttactatgacgcacagacgtcccacaatcgagaaggacgtggatctcggtgccgggaccaggcatgtcaatgctgaaccggagactcctaacatggacgtgattggagagcggatcaaacgcattaaggaagagcacaattctacctggcactatgacgatgaaaacccatacaaaacatgggcgtatcatggctcatacgaggtaaaggccacgggcagcgcatccagtatgatcaatggggtggttaagcttctgaccaaaccctgggacgtcgtgcctatggtgactcagatggctatgacagataccactccattcggacagcaacgagtctttaaggaaaaagttgacacaagaacccccaggtctatgccgggtacacggcgcgtgatgggcataactgccgagtggttatggagaaccctggggaggaacaagaaacctcgattgtgcacgcgggaggaattcaccaagaaggtacgtacaaatgcagccatgggagctgtgtttactgaggaaaaccagtgggatagcgccaaagcggcagtcgaggacgaagatttctggaagctcgtggacagagagcgcgagctgcacaaactaggcaagtgtggttcatgcgtttataatatgatggggaaaagggaaaagaaacttggagagtttggcaaggccaagggctcccgggctatctggtacatgtggctgggggccagatacctcgaattcgaggcactgggatttttgaacgaggatcattggttcagtcgcgaaaatagctattctggtgtggagggcgaagggctgcacaaactcggatacattcttagggacatctccaagattcccggcggtgctatgtatgccgatgacaccgctgggtgggacacacgaatcactgaggatgacctgcataacgaagagaaaataacccagcagatggatccagagcaccggcaattagccaatgcaatttttaagctgacgtaccagaacaaagtcgtgaaggtacagagacctacacccaccggaactgttatggacatcatctcaaggaaggatcagcgcggcagcggccaagtggggacatatggattgaataccttcactaacatggaagcgcagctcattcgtcagatggagggtgaaggcgtcctgtcgaaagccgacctagagaacccacaccttcccgaaaagaaaataacccagtggctggagacaaagggggtggagcggctcaaaagaatggctatctctggagatgactgcgtggtcaagcctattgatgacaggtttgccaatgcactgttggctttaaacgatatgggcaaggttcgcaaagacatcccacaatggcagccgagtaagggttggcatgattggcagcaggtgcccttctgttcccaccatttccacgaactgattatgaaagacgggcgaaagctcgtagtgccttgccggccacaagacgagcttatcggaagagccaggataagccagggcgcaggctggtcactgcgcgaaacggcctgtctagggaaagcgtacgctcagatgtggtccctgatgtattttcacagacgggatctcaggttggcctctaatgcaatctgcagcgccgtccccgtgcattgggttcctaccagtcgtactacatggtccattcacgctcatcaccaatggatgaccactgaggacatgctgacagtgtggaaccgagtctggatcgaagataatccatggatggaggacaagacccccgtgacgacatgggagaacgtaccttaccttggaaagcgcgaagatcagtggtgtggtagcctgattggcctcacctctagagccacttgggcacagaatatcccgaccgctattcagcaagttcggtcattaatagggaacgaggaattcctggactacatgccaagtatgaaaaggtttcgcaaggaggaggaatccgagggagccatctggtga

SEQ ID NO: 15159 - RNA, 9873 nt, synthetic construct
  misc_feature 1..9873: note = derived and/or modified CDS sequence (opt3) from DENV-3__GQ868548__SS-prME
  source 1..9873: mol_type = other RNA
accagcctgtgcctcgtgatgatccttcccgccgctctggcattccacttgacatccagagacggcgagcctaggatgattgtcgggaagaacgaacggggaaaatctttactgtttaagactgcctcaggtataaatatgtgtacgctaatcgcgatggatctcggcgagatgtgcgacgataccgttacatacaaatgtccacatattactgaagtggagccggaagacatcgattgctggtgtaacctgaccagtacatgggtaacctatgggacttgcaatcaggctggagagcgccgacgtgacaagagaagcgtggcccttgcaccccacgtcggcatgggtctggatacaaggacccaaacgtggatgtccgccgagggggcttggcggcaggtggaaaaagttgagacttgggcattgcgccatcctggattcaccattctcgccctgtttctggctcactacatcggcacatctctcactcagaaggtggtcatattcatcttactgatgcttgtgaccccatcgatgacaatgagatgtgtaggcgttgggaacagggactttgtggaaggattgtcaggtgccacctgggtcgatgtggtgctggagcatggcgggtgcgtcacgactatggcgaagaataaacccacactagacattgagctccagaagaccgaagcaactcaactggccacacttcggaaactgtgtatcgagggaaagattaccaacatcacgaccgatagccgctgccctacacagggcgaagctgttttgccagaggaacaggaccagaattatgtgtgtaaacacacttacgtagatcgaggttgggggaacggatgcggcctcttcggcaaggggagtctggtgacctgcgccaagtttcaatgtttagagcccatagagggaaaagtcgtgcagcacgaaaatctgaagtatacagttattatcactgtgcataccggtgaccagcaccaggtcggcaacgagacacaaggggtgaccgcagaaattactcctcaggcttccacgacagaggccatcctcccagaatacggaacccttggcctggagtgctctccgagaactggtttggacttcaatgagatgatcctactgaccatgaaaaacaaggcgtggatggtacataggcagtggtttttcgatctccccctgccttggacaagcggggccaccactgaaacaccaacgtggaatcggaaagagcttctggttacctttaagaacgcacacgctaaaaagcaagaagtggtcgtgttgggctcccaggagggagccatgcacactgctctcacaggcgccaccgaaattcagaattcagggggaacaagtatattcgcaggtcatctgaagtgtcgtttaaaaatggacaagctggagctaaaaggcatgagctatgccatgtgcactaacacctttgtcctcaagaaagaggtgtctgaaacgcagcacgggaccatcctgattaaggttgagtaccgcggagaagatgctccctgtaagatccctttctccacagaggacggccaaggtaaagcgcataacgggagacttataactgcaaatccagtggtaaccaagaaagaggaacccgtcaacattgaggccgaaccgcctttcggcgagtcaaatatcgtgatcggaattggcgataacgctttgaagatcaattggtacaaaaaggggagcagtattggaaagatgtttgaagccacagcaaggggtgcccggcgaatggctatactgggcgacactgcctgggatttcgggtctgttggaggcgtgctcaactccctgggtaaaatggtccaccagatctttgggagcgcatataccgcgcttttctcgggcgtgtcttgggtaatgaagattggaatcggcatcctgttgacgtggattgggctcaattccaaaaacacatcaatgagttttagctgcatagctatcggaattatcaccctgtacttaggcgccgtggttcaggcagacatgggttgtgtcattaattggaaggggaaagagctgaagtgcggatccggcatcttcgtgactaacgaggtgcatacatggaccgaacagtataagtttcaagccgattctcccaaacgcctagctactgccatagcaggtgcttgggagaatggcgtctgtgggatcagaagcaccacaaggatggaaaacctcctgtggaagcagattgccaatgagcttaactacatcttgtgggaaaataacattaaactgacggttgtggtgggagacatcataggcgtactcgagcaggggaagcggaccctgactccacagcctatggagttaaaatattcatggaagacatggggaaaagcgaagattgtcaccgccgaaacacaaaacagttccttcatcattgatggccccaatactccagagtgccccagcgcttctcgcgcatggaacgtgtgggaagttgaggactacggttttggggtgttcaccacgaatatctggctgaagcttagagaagtctatacacagttgtgtgaccacaggctcatgtcagccgctgtgaaagatgagcgtgccgttcacgcagacatgggatactggatagagagtcagaagaacggcagctggaaactggaaaaggcgtccctaatcgaggtgaaaacctgcacttggcctaagtctcataccctgtggtcgaatggtgtactcgaaagcgatatgattatcccaaagtccctggccggcccgatttcacagcacaaccatcggcccgggtaccacacacaaactgctggaccttggcaccttggcaaattggagctggactttaattattgcgaggggaccacagtcgtgatcacggaaaactgtggaacccgaggcccaagtttaagaactacaaccgtgtctggtaagctcatacatgagtggtgctgtaggagctgcactctgccccctcttcgctacatgggggaagatggatgttggtatggcatggagattcggccaatctccgaaaaagaggagaatatggtcaagtcactggttagcgccggttctggcaaagtggacaacttcacaatgggggtattgtgcctcgcaatcctgtttgaagaggtgatgagaggaaagttcggcaagaaacacatgattgctggggtcttctttaccttcgtgctactgctctccggacagatcacgtggagggatatgactcataccctgattatgataggcagtaatgccagcgaccgcatgggtatgggggttacataccttgcattgatcgccacctttaagattcagcccttcctggctttaggatttttcctccgaaaactgacttctcgggaaaaccttctgctaggcgtgggcctcgcgatggccacaaccctgcaattgccggaggatatcgaacagatggcaaatgggattgctctgggattaatggccctcaagctgatcacacagtttgagacttatcagctttggaccgccctgatatccttgacgtgttcaaacacaatgttcaccctcactgtcgcttggcgtaccgcaacactgatcctagccggtgtgagtctgcttcctgtttgccaaagctcgtccatgagaaaaactgactggctcccaatggcggtggctgccatgggcgtcccccctctgcccttgtttattttctctctgaaggataccttaaagaggcgcagctggccactcaatgagggggtaatggcagtgggactggtttcaatccttgccagttccctgttgcggaacgacgtgcctatggctggccccctcgtcgcaggtgggctgctaattgcctgttacgtgatcacgggaacatctgcggatctgaccgtagaaaaagctgccgacataacttgggaggaagaggcagaacagacaggcgtgagccacaaccttatgattaccgtcgacgatgacggcactatgagaatcaaggatgacgagacagagaatatcctcaccgttctgttgaaaacggccttactgattgtgtccggggtgtttccatattcaataccggctactctcctggtctggcatacctggcagaagcagacacaaaggagcggagtgctttgggatgttcctagtcccccagaaacccagaaagccgagctggaagagggtgtataccgaatcaagcagcagggcattttcgggaaaacacaagtgggagtcggcgtgcagaaggagggtgtttttcacactatgtggcacgtgacccgcggggcagtcttgacgtacaacggaaagcggctagaacccaattgggcttctgtgaaaaaggacctgatctcctatggcggcgggtggagactcagcgcccagtggcaaaaaggagaggaagtacaggtcattgcggtggagcctggtaagaacccaaaaaatttccagacaactcccggcaccttccagacaaccactggggaaatcggagccatagcactggattttaagcctggcacctcgggttcaccgatcattaacagggaggggaaggttgtgggactttacggcaatggcgtcgtgacaaaaaacgggggatatgtttctggtatcgctcaaacgaatgccgagccagacggccccactcctgaattagaggaagagatgttcaagaaacgtaacctgaccattatggatctccatccagggagtggaaagacacgcaaatacttgcccgctatcatacgggaagcaattaagagaaggctgcgaaccctcatcctggcccctactcgggtggtcgccgctgagatggaggaagcgcttaagggcctgccgatccgctatcagacaaccgcaacgaaatccgagcacactggtagagaaattgtggacttgatgtgccatgccacatttaccatgaggctactgagccccgtacgggtgccaaattacaacctcatcataatggatgaggctcacttcaccgaccctgcctctattgcagcccgagggtatatcagcactagagttggaatgggcgaagctgcggccatttttatgacagcaacccccccaggcacagctgatgccttccctcagtccaatgcacccatccaggacgaggagcgcgacataccagaaaggtcatggaacagtgggaatgagtggattactgattttgtcggaaagacggtgtggttcgtgccgagcatcaaagccggtaacgacatcgctaactgtttacgtaagaatggcaaaaaggtcattcaactgtctcggaagacctttgatacagaataccagaaaactaagcttaacgactgggatttcgtagtgaccacagacatctccgagatgggggccaattttaaagcggatagagttattgaccctaggcgctgcctgaagcccgtgatactcaccgatggaccagagcgagtcatcttggcaggccccatgcctgtgactgccgcttcagccgctcagagacggggtagggttgggcgcaacccacagaaagaaaatgaccaatacattttcacgggccagcccctgaacaatgatgaggaccatgcacactggaccgaagccaagatgctcctggacaacatcaatacacctgagggaatcattccggctcttttcgaaccagagcgtgagaagagtgccgcaatagatggcgaatatagactaaaaggggagagccggaagacttttgtggaactgatgaggcgcggagacttgcccgtctggttagcgcacaaagtggcctccgagggtatcaagtacaccgatcgaaaatggtgcttcgacggccagagaaacaatcagattctggaagagaacatggatgtagagatctggacaaaggaaggggagaaaaagaagctccggcctaggtggctggacgctcgcacctattctgatccccttgccctgaaagaatttaaggacttcgcagctggaagaaaatcgattgccctcgatttggtgactgagatcggcagggttccaagccatctggcacaccggacacgtaatgccctagacaacctggtcatgctccatacgtcagaacacggtgggcgcgcttaccgacacgcggtggaggagcttcctgaaaccatggagactctgttattgctgggcctcatgatactgcttacaggaggcgccatgctgtttctcatctccgggaagggaattggtaaaaccagtatcggcttgatttgtgtgatcgcatctagcgggatgctgtggatggctgaaatacccttacaatggattgcctccgccatcgtcctagagttctttatgatggttctgctcattccagagcctgaaaagcagagaaccccgcaggataatcaacttgcatatgtggtaatcggaatactgacattggctgccatcattgcggctaacgagatgggcctgctcgaaactacgaagagggacctgggtatgtcaaaagagcccggggtggtctctccaaccagctaccttgatgtggacctccatcctgccagtgcatggacactgtatgccgttgctactaccgtgatcacacccatgttgcggcacaccattgaaaattccactgcaaacgtcagcctggccgcgatcgctaaccaggccgtagtgttaatgggcctagacaagggatggccaatatctaaaatggatctgggcgttcctctccttgcactggggtgctactcacaggtgaatcccttgacgctgacagccgctgtcctcctgcttattacccattacgccatcatcggaccgggcttacaggcaaaggctactcgcgaggcccaaaaaagaaccgcggccggtattatgaagaacccaacagtggacgggatcatgactatagatctggaccctgtcatttatgattccaagttcgagaaacagctcggacaggtgatgttgctggttctatgtgcagtgcagctgctccttatgaggaccagttgggctctgtgcgaagccttgacactggcaacgggccccatcaccactctctgggagggtagcccaggcaagttttggaatacaaccattgctgtatcgatggccaacatcttccgggggtcttacctggccggagcgggcttagctttttccataatgaaaagcgtggggactggaaagcgaggcacaggttcacaaggggaaacccttggagagaaatggaagaagaaactgaatcagctcagtagaaaggaattcgacctatataaaaagtctggcatcacggaggtcgatcgcaccgaggcaaaagaaggtctgaagaggggcgagattacacaccatgccgtttcccgggggagcgctaaattgcagtggtttgtggaacgtaacatggtcatccccgagggaagagtgattgacctgggctgtgggaggggaggctggtcatactattgcgccggtctcaagaaggtaactgaagtgcgcgggtacaccaaaggaggccctggccacgaggagccggttcccatgagtacatatgggtggaatatcgtgaagcttatgagcggaaaagatgtcttctacctgccacctgaaaagtgtgacactttgctgtgcgatattggtgagtcctctcccagccctaccgtggaagagtcccggacaatccgagtcctcaaaatggtggagccatggttaaagaacaatcagttctgtataaaggttctgaacccctacatgcctaccgtaattgaacaccttgagagactgcaaaggaaacatggcgggatgctagtgcgcaatccactctcacggaactctactcacgaaatgtattggatcagtaatggaacgggcaacatcgtcgcatcggtgaatatggttagcagactgttgctgaaccgttttacaatgacccataggcggcccactattgagaaggacgtggatctcggtgccgggacccgccacgtcaacgctgaaccggagacacctaatatggacgtgataggagagcgaatcaaaagaattaaggaagagcacaactccacgtggcattacgacgatgaaaatccatataaaacctgggcgtaccacggctcttatgaggtaaaggccactggctcagcaagctccatgatcaacggggtggttaagcttctgacaaaaccctgggacgtcgtgcctatggtgacccagatggctatgactgatacaaccccattcggacagcaaagggtctttaaggaaaaagttgacacacggactccccgcagtatgccgggtaccagaagggtgatggagattacggccgagtggttatggcgaaccctgggccggaataagaaacctcgtttgtgcacaagagaagagttcactaagaaggtacgcaccaacgcagccatgggggctgtgtttacagaagagaatcagtgggattctgccaaagcggcagtcgaagacgaggatttctggaagctcgtggacagggagcgggaactgcataaactaggaaagtgtggcagctgcgtttacaacatgatgggtaaaagagagaagaaacttggggaatttggaaaggccaagggctcacgcgctatctggtatatgtggctgggcgccaggtacctcgagttcgaggcactggggtttttgaatgaagatcactggttctcccgagagaacagttacagcggagtggaaggtgagggcctgcataaactcgggtatatacttcgggacatctctaagattcccggaggcgctatgtacgccgatgacactgctggttgggacaccagaatcacggaagatgacctgcacaatgaggagaaaattacacagcagatggatccagaacacaggcaattagccaacgcaatctttaagctgacctatcagaataaagtcgtgaaggtacagcgccctactcccacagggaccgttatggacataatttcccgtaaggatcagcggggatcaggccaagtgggcacttacgggttgaacaccttcacaaatatggaggcgcagctcatcagacagatggaaggagagggtgtcctgagcaaagccgacctagaaaacccacatcttcccgagaagaaaatcacgcagtggctggagaccaagggcgtggaaaggctcaaacgcatggctatttcgggggatgactgcgtggtcaagcctatagatgaccgatttgccaacgcactgttggctttaaatgatatgggaaaggttcggaaagacatcccacaatggcagccgtctaagggctggcacgattggcagcaggtgcccttctgtagtcatcacttccacgagctgattatgaaagacggtagaaagctcgtagtgccttgcaggccacaagacgaacttatcgggcgcgccagaatttcccagggagcaggctggagcctgcgggagactgcctgtctaggcaaagcgtatgctcagatgtggtcactgatgtactttcataggcgtgatctccgattggcctccaacgcaatctgctctgccgtccccgtgcactgggttcctacaagccgcaccacttggagtatacatgctcaccatcaatggatgacaaccgaagacatgctgacggtgtggaatagagtctggatcgaggataacccatggatggaggacaagacacccgtgaccacttgggaaaatgtaccttatcttgggaagcgggaggatcagtggtgtggatccctgattggtctcaccagcagggccacatgggcacagaacatcccgactgctattcagcaagttcgctctttaatcggcaatgaagagttcctggactacatgccatcaatgaaaagatttcggaaggaggaagagagtgaaggggccatttggtga

SEQ ID NO: 15160 - RNA, 9873 nt, synthetic construct
  misc_feature 1..9873: note = derived and/or modified CDS sequence (opt3) from DENV-3__GU131861__SS-prME
  source 1..9873: mol_type = other RNA
accagcctgtgcctcgtgatgatccttcccgcagctctggcattccacttgacctccagagacggcgagcctaggatgattgtcgggaagaacgaacggggaaaatctttactgtttaagactgcatcaggtataaatatgtgtacgttaatcgcgatggatctcggcgagatgtgcgacgataccgttacatacaaatgtccacatattactgaagtggagccggaagacatcgattgctggtgtaacctgaccagtacatgggtaacctatgggacttgcaatcaggctggagagcgccgacgtgacaagagaagcgtggcccttgcaccccacgtcggcatgggtctggatacaaggacccagacgtggatgtccgccgagggggcttggcggcaagtggaaaaagttgagacttgggcattgcgccatcctggattcaccattctcgccctgtttctggctcactacatcggcacatctctcactcagaaggtggtcatattcatcttactgatgcttgtgaccccatcgatgacaatgagatgtgtaggcgttgggaacagggactttgtggaaggattgtcaggtgccacctgggtcgatgtggtgctggagcatggcgggtgcgtcacgactatggcgaagaataaacccacactagacattgagctccagaagaccgaagcaactcaactggccacacttcggaaactgtgtatcgagggaaagattaccaacatcacgaccgatagccgctgccctacacagggcgaagctgttttgccagaggaacaggaccagaattatgtgtgtaaacacacttacgtagatcgaggttgggggaacggatgcggcctcttcggcaaggggagtctggtgacctgcgccaagtttcaatgtttagagcccatagagggaaaagtcgtgcagtatgaaaatctgaagtacacagttattatcactgtgcacaccggtgaccagcatcaggtcggcaacgagacacaaggggtgaccgcagaaattactcctcaggcttccacgacagaggccatcctcccagaatatggaacccttggcctggagtgctctccgagaactggtttggacttcaatgagatgatcctactgaccatgaaaaacaaggcgtggatggtacacaggcagtggtttttcgatctccccctgccttggacaagcggggccaccactgaaacaccaacgtggaatcggaaagagcttctggttacctttaagaacgcacatgctaaaaagcaagaagtggtcgtgttgggctcccaggagggagccatgcacactgctctcacaggcgccaccgaaattcaaaattcagggggaacaagtatattcgcaggtcacctgaagtgtcgtttaaaaatggacaagctggagctaaaaggcatgagctacgccatgtgcactaacacctttgtcctcaagaaagaggtgtctgaaacgcagcatgggaccatcctgattaaggttgagtaccgcggagaagatgctccctgtaagatccctttctccacagaggacggccaaggtaaagcgcacaacgggagacttataactgcaaatccagtggtaaccaagaaagaggaacccgtcaacattgaggccgaaccgcctttcggcgagtcaaatatcgtgatcggaattggcgataacgctttgaagatcaattggtataaaaaggggagcagtattggaaagatgtttgaagccacagcaaggggtgcccggcgaatggctatactgggcgacactgcctgggatttcgggtctgttggaggcgtgctcaactccctgggtaaaatggtccatcagatctttgggagcgcatacaccgcgcttttctcgggcgtgtcttgggtaatgaagattggaatcggcatcctgttgacgtggattgggctcaattccaaaaacacatcaatgagttttagctgcatagctatcggaattatcaccctgtatttaggcgccgtggttcaggcagacatgggttgtgtcattaattggaaggggaaagagctgaagtgcggatccggcatcttcgtgactaacgaggtgcacacatggaccgaacagtacaagtttcaagccgattctcccaaacgcctagctactgccatagccggtgcttgggagaatggcgtctgtgggatcagaagcaccacaaggatggaaaacctcctgtggaagcagattgccaatgagcttaactatatcttgtgggaaaataacattaaactgacggttgtggtgggagacatcataggcgtactcgagcaggggaagcggaccctgactccacagcctatggagttaaaatactcatggaagacatggggaaaagcgaagattgtcaccgccgaaacacaaaacagttccttcatcattgatggccccaatactccagagtgccccagcgcttctcgcgcatggaacgtgtgggaagttgaggactatggttttggggtgttcaccacgaatatctggctgaaacttagagaagtctacacacagttgtgtgaccataggctcatgtcagccgctgtgaaagatgagcgtgccgttcacgcagacatgggatactggatagagagtcagaagaacggcagctggaaactggaaaaggcgtccctaatcgaggtgaaaacctgcacttggcctaagtctcacaccctgtggtcgaatggtgtactcgaaagcgatatgattatcccaaagtccctggccggcccgatttcacagcataaccaccggcccgggtatcatacacaaactgctggaccttggcaccttggcaaattggagctggactttaattactgcgaggggaccacagtcgtgatcacggaaaactgtggaacccgaggcccaagtttaagaactacaaccgtgtctggtaagctcatacacgagtggtgctgtaggagctgcactctgccccctcttcgctatatgggggaagatggatgttggtacggcatggagattcggccaatctccgaaaaagaggagaatatggtcaagtcactggttagcgccggttctggcaaagtggacaacttcacaatgggggtattgtgcctcgcaatcctgtttgaagaggtgatgagaggaaagttcggcaagaaacatatgattgctggggtcttctttaccttcgtgctactgctctccggacagatcacgtggagggatatgactcacaccctgattatgataggcagtaatgccagcgaccgcatgggtatgggggttacatatcttgcattgatcgccacctttaagattcagcccttcctggctttaggatttttcctccgaaaactgacttctcgggaaaaccttctgctaggcgtgggcctcgcgatggccacaaccctgcaattgccggaggatatcgaacagatggcaaatgggattgctctgggattaatggccctcaagctgatcacacagtttgagacttaccagctttggaccgccctgatatccttgacgtgttcaaacacaatgttcaccctcactgtcgcttggcgtaccgcaacactgatcctagccggtgtgagtctgcttcctgtttgccaaagctcgtccatgagaaaaactgactggctcccaatggcggtggctgccatgggcgtcccacctctgcccttgtttattttctctctgaaggataccttaaagaggcgcagctggccactcaatgagggggtaatggcagtgggactggtttcaatccttgccagttccctgttgcggaacgacgtgcctatggctggccccctcgtcgccggtgggctgctaattgcctgttatgtgatcacgggaacatctgcggatctgaccgtagaaaaagctgccgacataacttgggaggaagaggcagaacagacaggcgtgagccataaccttatgattaccgtcgacgatgacggcactatgagaatcaaggatgacgagacagagaatatcctcaccgttctgttgaaaacggccttactgattgtgtccggggtgtttccatactcaataccggctactctcctggtctggcacacctggcagaagcagacacaaaggagcggagtgctttgggatgttcctagtcccccagaaacccagaaagccgagctggaagagggtgtataccgaatcaagcagcagggcattttcgggaaaacacaagtgggagtcggcgtgcagaaggagggtgtttttcatactatgtggcacgtgacccgcggggcagtcttgacgtataacggaaagcggctagaacccaattgggcttctgtgaaaaaggacctgatctcctacggcggcgggtggagactcagcgcccagtggcaaaaaggagaggaagtacaggtcattgcggtggagcctggtaagaaccccaagaatttccagacaactcccggcaccttccagacaaccactggggaaatcggagccatagcactggattttaagcctggcacctcgggttcaccgatcattaacagggaggggaaggttgtgggactttatggcaatggcgtcgtgaccaagaacgggggatacgtttctggtatcgctcaaacgaatgccgagccagacggccccactcctgaattagaggaagagatgttcaagaaacgtaacctgaccattatggatctccacccagggagtggaaagacacgcaaatatttgcccgctatcatacgggaagcaattaagagaaggctgcgaaccctcatcctggcccctactcgggtggtcgccgctgagatggaggaagcgcttaagggcctgccgatccgctaccagacaaccgtgacgaaatccgagcatactggtagagaaattgtagacttgatgtgccacgcaacatttaccatgaggctactgagccccgtgcgggttccaaattataacctcatcataatggatgaggcccatttcaccgaccctgcttctattgccgcacgagggtacatcagcactagagtcggaatgggcgaagccgctgcgatttttatgacagccacacccccaggcacagcagatgctttccctcagtccaatgcccccatccaggacgaggagcgcgacataccagaaaggtcatggaacagtgggaatgagtggattactgattttgcaggaaagacggtgtggttcgtgccgagcatcaaagccggtaacgacatcgctaactgtttacgtaagaatggcaaaaaggtcattcaactgtctcggaagacctttgatacagaataccagaaaactaaacttaacgactgggatttcgtagtgaccacagacatctccgagatgggggccaattttaaagcggatagagttattgaccctaggcgctgcctgaagcccgtgatactcaccgatggaccagagcgagtcatcttggcaggccccatgcctgtgactgccgcttcagccgctcagagacggggtagggttgggcgcaacccacagaaagaaaatgaccaatatattttcacgggccagcccctgaacaatgatgaggaccacgcacattggaccgaagccaagatgctcctggacaacatcaatacacctgagggaatcattccggctcttttcgaaccagagcgtgagaagagtgccgcaatagatggcgaatacagactaaaaggggagagccggaagacttttgtggaactgatgaggcgcggagacttgcccgtctggttagcgcacaaagtggcctccgagggtatcaagtataccgatcgaaaatggtgcttcgacggccagagaaacaatcagattctggaagagaacatggatgtagagatctggacaaaggaaggggagaaaaagaagctccggcctaggtggctggacgctcgcacctactctgatccccttgccctgaaagaatttaaggacttcgcagctggaagaaaatcgattgccctcgatttggtgactgagatcggcagggttccaagccacctggcacatcggacacgtaatgccctagacaacctggtcatgctccacacgtcagaacatggtgggcgcgcttatcgacacgcggtggaggagcttcctgaaaccatggagactctgttattgctgggcctcatgatactgcttacaggaggcgccatgctgtttctcatctccgggaagggaattggtaaaaccagtatcggcttgatttgtgtgatcgcatctagcgggatgctgtggatggctgaaatacccttacaatggattgcctccgccgtcgttctagagttctttatgatggtgctgctcatcccagagcctgaaaagcagagaaccccgcaggataatcaacttgcatacgtagtgattggaatcctgacattggctgccataatcgcggctaacgagatgggcctgctcgaaactacgaagagggacctgggtatgtcaaaagagcccggggtcgtgtctccaaccagctatcttgatgttgacctccaccctgccagtgcatggacactgtacgccgtggctactaccgtcattacacccatgttgcggcataccatcgaaaattccactgcaaacgtaagcctggccgcgattgctaaccaggccgtggttttaatgggcctagacaagggatggccaatctctaaaatggatctgggcgtgcctctccttgcactggggtgctactcacaggtcaatcccttgacgctgacagccgctgtgctcctgcttataacccactatgccattatcggaccgggcttacaggcaaaggctactcgcgaggcccagaagagaaccgcggccggtatcatgaagaacccaacagtcgacgggattatgactatcgatctggaccctgtgatatacgattccaagttcgagaaacagctcggacaggttatgttgctggtgctatgtgcagtacagctgctccttatgaggaccagttgggctctgtgcgaagccttgacactggcaacgggccccattaccactctctgggagggtagcccaggcaagttttggaatacaaccatcgctgtgtcgatggccaacattttccgggggtcttatctggccggagcgggcttagctttttccatcatgaaaagcgtcgggactggaaagcgaggcacaggttcacaaggggaaacccttggagagaaatggaagagaaagctgaatcagctcagtcgcaaagagttcgacctatacaagaaatctggcataacggaggttgataggaccgaggcaaaggaaggtctgaaacggggcgagatcacacatcacgccgtgtcccgtgggagcgctaagttgcagtggtttgtcgaaagaaacatggtgattcccgagggaagggtaatcgacctgggctgtgggcgcggaggctggtcatattactgcgccggtctcaaaaaggtgactgaagttcgggggtataccaagggaggccctggccatgaggagccggtgcccatgagtacatacgggtggaatattgtcaaacttatgagcggaaaggatgtgttctacctgccacctgaaaaatgtgacactttgctgtgcgatatcggtgagtcctctcccagccctaccgtcgaagagtcccgaacaattagagtgctcaagatggttgagccatggctgaaaaacaatcagttctgtatcaaggtactaaacccctatatgcctaccgtgatagaacaccttgagaggctgcaacgcaagcacggcgggatgctagtccggaatccactctcaagaaactctactcatgaaatgtactggattagtaatggaacgggcaacatcgtggcatcggttaatatggtgagccgtctgttgctgaacaggtttacaatgacccaccggcgccccactatcgagaaagacgtcgatctcggtgccgggacccgacatgtgaacgctgaaccggagacacctaatatggacgtaattggagagagaataaagaaaatcaaggaagaacacaactccacgtggcactatgacgatgaaaatccatacaaaacctgggcgtatcatggctcttacgaggtgaaggccactggctcagcaagctccatgattaacggggttgtcaaacttctgacaaaaccctgggacgtggtgcctatggtcacccagatggctatgactgatacaaccccattcggacagcaaagggtttttaaggaaaaagtggacacacggactccccgcagtatgccgggtaccagaagggtaatggagatcacggccgagtggttatggcgaaccctgggccggaataagaaacctcgtttgtgcacaagagaagagttcactaagaaggtgcgcaccaacgcagccatgggggctgtctttacagaagagaatcagtgggattctgccaaagcggcagtggaagacgaggatttctggaagctcgttgacagggagcgggaactgcacaaactaggaaagtgtggcagctgcgtgtataacatgatgggtaaaagagagaagaaacttggggaatttggaaaggccaagggctcacgcgctatttggtacatgtggctgggcgccaggtacctcgagttcgaggcactggggtttttgaatgaagatcattggttctcccgagagaacagttatagcggagtcgaaggtgagggcctgcacaaactcgggtacatccttcgggacatatctaagatccccggaggcgctatgtatgccgatgacactgctggttgggacaccagaattacggaagatgacctgcataatgaggagaaaatcacacagcagatggatccagaacacaggcaattagccaacgcaatttttaagctgacctaccagaataaagtggtaaaggttcagcgccctactcccacagggaccgtgatggacatcatatcccgtaaggatcagcggggatcaggccaagtcggcacttatgggttgaacaccttcacaaatatggaggcgcagctcattagacagatggaaggagagggtgtgctgagcaaagccgacctagaaaacccacaccttcccgagaagaaaatcacgcagtggctggagaccaagggcgtggaaaggctcaaacgcatggctatctcgggggatgactgcgtcgttaagcctattgatgaccgatttgccaacgcactgttggctttaaatgatatgggaaaggtgcggaaagacataccacaatggcagccgtctaagggctggcatgattggcagcaggtacccttctgtagtcaccatttccacgagctgatcatgaaagacggtagaaagctcgtggtcccttgcaggccacaagacgaacttattgggcgcgccagaatctcccagggagcaggctggagcctgcgggagactgcctgtctaggcaaagcgtacgctcagatgtggtcactgatgtattttcacaggcgtgatctccgattggcctccaacgcaatttgctctgccgtgcccgttcattgggtgcctacaagccgcaccacttggagtatccacgctcatcaccaatggatgacaaccgaagacatgctgacggtctggaatagagtgtggatagaggataacccatggatggaggacaagacacccgtaaccacttgggaaaatgttccttaccttgggaagcgggaggatcagtggtgtggatccctgatcggtctcaccagcagggccacatgggcacagaacattccgactgctatccagcaagtgcgctctttaattggcaatgaagagttcctggactacatgccatcaatgaaaagatttcggaaggaggaagagagtgaaggggccatctggtga

SEQ ID NO: 15161 - RNA, 9873 nt, synthetic construct
  misc_feature 1..9873: note = derived and/or modified CDS sequence (opt3) from DENV-3__GU131862__SS-prME
  source 1..9873: mol_type = other RNA
accagcctgtgcctcgtgatgatccttcccgccgctctggcattccacttgacatccagagacggcgagcctaggatgattgtcgggaagaacgaacggggaaaatctttactgtttaagactgcctcaggtataaatatgtgtacgctaatcgcgatggatctcggcgagatgtgcgacgataccgttacatacaaatgtccacatattactgaagtggagccggaagacatcgattgctggtgtaacctgaccagtacatgggtaacctatgggacttgcaatcaggctggagagcgccgacgtgacaagagaagcgtggcccttgcaccccacgtcggcatgggtctggatacaaggacccaaacgtggatgtccgccgagggggcttggcggcaggtggaaaaagttgagacttgggcattgcgccatcctggattcaccattctcgccctgtttctggctcactacatcggcacatctctcactcagaaggtggtcatattcatcttactgatgcttgtgaccccatcgatgacaatgagatgtgtaggcgttgggaacagggactttgtggaaggattgtcaggtgccacctgggtcgatgtggtgctggagcatggcgggtgcgtcacgactatggcgaagaataaacccacactagacattgagctccagaagaccgaagcaactcaactggccacacttcggaaactgtgtatcgagggaaagattaccaacatcacgaccgatagccgctgccctacacagggcgaagctgttttgccagaggaacaggaccagaattatgtgtgtaaacacacttacgtagatcgaggttgggggaacggatgcggcctcttcggcaaggggagtctggtgacctgcgccaagtttcaatgtttagagcccatagagggaaaagtcgtgcagtatgaaaatctgaagtacacagttattatcactgtgcacaccggtgaccagcatcaggtcggcaacgagacacaaggggtgaccgcagaaattactcctcaggcttccacgacagaggccatcctcccagaatatggaacccttggcctggagtgctctccgagaactggtttggacttcaatgagatgatcctactgaccatgaaaaacaaggcgtggatggtacacaggcagtggtttttcgatctccccctgccttggacaagcggggccaccactgaaacaccaacgtggaatcggaaagagcttctggttacctttaagaacgcacatgctaaaaagcaagaagtggtcgtgttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtcctcaagaaagaggtgtctgaaacgcagcatgggaccatcctgattaaggttgagtaccgcggagaagatgctccctgtaagatccctttctccacagaggacggccaaggtaaagcgcacaacgggagacttataactgcaaatccagtggtaattaagaaagaggaacccgtcaacatcgaggccgaaccgcctttcggcgagtcaaatatcgtgattggaatcggcgataacgctttgaagattaattggtataaaaaggggagcagtataggaaagatgtttgaagccaccgcaaggggtgcccggcgaatggctatcctgggcgacacagcctgggatttcgggtctgttggaggcgtgctcaactccctgggtaaaatggtccatcagatttttgggagcgcatacactgcgcttttctcgggcgtgtcttgggtaatgaagatcggaatcggcattctgttgacctggatagggctcaattccaaaaacacgtcaatgagttttagctgcatcgctattggaatcattacactgtatttaggcgccgtggttcaggcagacatcggttgtgtcataaattggaaggggaaagagctgaagtgcggatccggcatcttcgtgaccaacgaggtgcacacttggacagaacagtacaagtttcaagccgattctcccaaacgcctagctaccgccattgcaggtgcttgggagaatggcgtctgtgggatcagaagcactaccaggatggaaaacctcctgtggaagcagattgccaatgagcttaactatatcttgtgggaaaataacataaaactgacagttgtggtgggagacattatcggcgtactcgagcaggggaagcggacgctgaccccacagcctatggagttaaaatactcatggaagacttggggaaaagcgaagattgtcacagccgaaacccaaaacagttccttcatcatagatggccccaatacaccagagtgccccagcgcttctcgcgcatggaacgtgtgggaagttgaggactatggttttggggtgttcactaccaatatctggctgaagcttagagaagtctacacgcagttgtgtgaccataggctcatgtcagccgctgtgaaagatgagcgtgccgttcacgcagacatgggatactggattgagagtcagaagaacggcagctggaaactggaaaaggcgtccctaatcgaggtgaaaacatgcacctggcctaagtctcacactctgtggtcgaatggtgtactcgaaagcgatatgattatcccaaagtccctggccggcccgatatcacagcataaccaccggcccgggtatcatacccaaacagctggaccttggcaccttggcaaattggagctggactttaattactgcgaggggactaccgtcgtgattacagaaaactgtggaacgcgaggcccaagtttaagaaccactacagtgtctggtaagctcatccacgagtggtgctgtaggagctgcaccctgccccctcttcgctatatgggggaagatggatgttggtacggcatggagatccggccaatttccgaaaaagaggagaatatggtcaagtcactggttagcgccggttctggcaaagtggacaacttcactatgggggtattgtgcctcgcaatcctgtttgaagaggtgatgagaggaaagttcggcaagaaacatatgattgctggggtcttctttacattcgtgctactgctctccggacagataacctggagggatatgacgcacactctgatcatgattggcagtaatgccagcgaccgcatgggtatgggggttacctatcttgcattgatcgccacatttaagattcagcccttcctggctttaggatttttcctccgaaaactgacctctcgggaaaaccttctgctaggcgtgggcctcgcgatggccactacactgcaattgccggaggatatcgaacagatggcaaatgggatagctctgggattaatggccctcaagctgatcacccagtttgagacataccagctttggactgccctgatttccttgacctgttcaaacacgatgttcacactcaccgtcgcttggcgtactgcaaccctgatcctagccggtgtgagtctgcttcctgtttgccaaagctcgtccatgagaaaaacagactggctcccaatggcggtggctgccatgggcgtcccccctctgcccttgtttattttctctctgaaggatactttaaagaggcgcagctggccactcaatgagggggtaatggcagtgggactggtttcaatccttgccagttccctgttgcggaacgacgtgcctatggctggccccctcgtcgcaggtgggctgctaatagcctgttatgtgattaccggaacgtctgcggatctgacagtagaaaaagctgccgacatcacctgggaggaagaggcagaacagactggcgtgagccataaccttatgatcacagtcgacgatgacggcaccatgagaattaaggatgacgagactgagaatatactcacagttctgttgaaaaccgccttactgatcgtgtccggggtgtttccatactcaattccggctacgctcctggtctggcacacttggcagaagcagacccaaaggagcggagtgctttgggatgttcctagtcccccagaaacacagaaagccgagctggaagagggtgtataccgaatcaagcagcagggcattttcgggaaaacccaagtgggagtcggcgtgcagaaggagggtgtttttcatacaatgtggcacgtgactcgcggggcagtcttgacctataacggaaagcggctagaacccaattgggcttctgtgaaaaaggacctgatctcctacggcggcgggtggagactcagcgcccagtggcaaaaaggagaggaagtacaggtcatagcggtggagcctggtaagaacccaaaaaatttccagacgatgcccggcacattccagactaccacaggggaaatcggagccattgcactggattttaagcctggcacctcgggttcaccgatcattaacagggaggggaaggttgtgggactttatggcaatggcgtcgtgactaaaaacgggggatacgtttctggtatcgctcaaaccaatgccgagccagacggccccacacctgaattagaggaagagatgttcaagaaacgtaacctgacgataatggatctccacccagggagtggaaagactcgcaaatatttgcccgctattatccgggaagcaatcaagagaaggctgcgaaccctcattctggcccctacacgggtggtcgccgctgagatggaggaagcgcttaagggcctgccgatccgctaccagaccactgcaacaaaatccgagcataccggtagagaaatagtggacttgatgtgccacgccacgtttactatgaggctactgagccccgtacgggtgccaaattataacctcattatcatggatgaggctcatttcacagaccctgcctctattgcagcccgagggtacatcagcaccagagttggaatgggcgaagctgcggccatatttatgaccgcaactcccccaggcacagctgatgccttccctcagtccaatgcacccattcaggacgaggagcgcgacatcccagaaaggtcatggaacagtgggaatgagtggatcaccgattttgtcggaaagacagtgtggttcgtgccgagcattaaagccggtaacgacatcgctaactgtttacgtaagaatggcaaaaaggtcattcaactgtctcggaagacttttgatacggaataccagaaaaccaagcttaacgactgggatttcgtagtgacaactgacatatccgagatgggggccaattttaaagcggatagagttatcgaccctaggcgctgcctgaagcccgtgattctcaccgatggaccagagcgagtcatcttggcaggccccatgcctgtgacagccgcttcagccgctcagagacggggtagggttgggcgcaacccacagaaagaaaatgaccaatatatcttcaccggccagcccctgaacaatgatgaggaccacgcacattggactgaagccaagatgctcctggacaacattaatacgcctgagggaataatcccggctcttttcgaaccagagcgtgagaagagtgccgcaattgatggcgaatacagactaaaaggggagagccggaagacctttgtggaactgatgaggcgcggagacttgcccgtctggttagcgcacaaagtggcctccgagggtatcaagtatacagatcgaaaatggtgcttcgacggccagagaaacaatcagattctggaagagaacatggatgtagagatctggactaaggaaggggagaaaaagaagctccggcctaggtggctggacgctcgcacctactctgatccccttgccctgaaagaatttaaggacttcgcagctggaagaaaatcgataacactcgatttggtgaccgagatcggcagggttccaagccacctggcccatcggactcgtaatgcactagacaacctggtcatgctccacacatcagaacatggtgggcgcgcctatcgacacgctgtggaggagcttcctgaaacgatggagaccctgttattgctgggcctcatgattctgcttactggaggcgcgatgctgtttctcatctccgggaagggaattggtaaaacaagtatcggcttgatatgtgtgattgcctctagcgggatgctgtggatggcagaaatccccttacaatggattgcttccgccatcgtcctagagttctttatgatggttctgctcataccagagcctgaaaagcagagaaccccgcaggataatcaacttgcctacgtggtaatcggaattctgaccttggcagctatcattgccgcgaacgagatgggcctgctcgaaacaactaagagggacctgggtatgtcaaaagagcccggggtggtctctccaaatagctatcttgatgtggacctccaccctgctagtgcctggacgctgtacgcagttgccaccacagtgatcactcccatgttgcggcataccatagaaaactccacagctaacgtcagcctggcagccattgcgaatcaggctgtagtgttaatgggcctagacaagggatggccaatctctaaaatggatctgggcgttcctctccttgccctggggtgctactcacaggtgaaccccttgaccctgactgcagccgtcctcctgcttatcacgcactatgctattatcggaccgggcttacaggccaaggcaacacgcgaggctcaaaaaagaaccgccgcgggtataatgaagaatccaactgtggacgggattatgaccatcgatctggaccctgtcatttacgattccaagttcgagaaacagctcggacaggtgatgttgctggttctatgtgccgtgcagctgctccttatgaggacaagttgggcactgtgcgaagctttgactctggccaccggccccatcacaacgctctgggagggtagcccaggcaagttttggaacaccactatagcagtatcgatggctaatatcttccgggggtcttatctggccggagccggcttagcgttttccattatgaaaagcgtggggacaggaaagcgaggcaccggttcacaaggggaaactcttggagagaaatggaagaagaaactgaaccagctcagtagaaaggaattcgacctatacaaaaagtctggcatcacagaggtcgatcgcaccgaggctaaagaaggtctgaagaggggcgagattacgcatcacgcagtttcccgggggagcgccaaattgcagtggtttgtggaacgtaatatggtcatccccgagggaagagtgattgacctgggctgtgggaggggaggctggtcatattactgcgctggtctcaagaaggtaaccgaagtgcgcgggtatacaaaaggaggccctggccatgaggagccggttcccatgagtacttacgggtggaacatcgtgaagcttatgagcggaaaagatgtcttctacctgccacctgaaaagtgtgacaccttgctgtgcgatataggtgagtcctctcccagccctacagtggaagagtcccggactattcgagtcctcaaaatggtggagccatggttaaagaataaccagttctgtatcaaggttctgaatccctatatgcctaccgtaatcgaacaccttgagagactgcaaaggaaacacggcgggatgctagtgcgcaacccactctcacggaattctacacatgaaatgtactggattagtaacggaaccggcaatatagtcgcctcggtgaacatggttagcagactgttgctgaaccgttttactatgacgcacaggcggcccacaatcgagaaggacgtggatctcggtgcagggacccgccatgtcaatgccgaaccggagactcctaacatggacgtgattggagagcgaatcaaaagaattaaggaagagcacaattccacctggcactatgacgatgaaaacccatacaaaacatgggcttatcatggctcttacgaggtaaaggcgacgggctcagccagctccatgatcaatggggtggttaagcttctgaccaaaccctgggacgtcgtgcctatggtgactcagatggcaatgacagataccactccattcggacagcaaagggtctttaaggaaaaagttgacacacggaccccccgcagtatgccgggtacaagaagggtgatgggcataactgctgagtggttatggaagaccctggggcgaaacaaaaagcctcggttgtgcacgcgtgaggaattcaccaagaaagtaagaacaaatgccgcaatgggagccgtgtttactgaggaaaaccagtgggattctgctaaggccgcggtcgaggacgaagatttctggaaactcgtggaccgcgagagggagctgcacaagctaggcaaatgtggtagctgcgtttataatatgatggggaagcgggaaaaaaagcttggagagtttggcaaggcaaaaggctcaagagccatctggtacatgtggctgggggctcgctacctcgaattcgaggccctgggatttttgaacgaggatcattggttctccagggaaaatagttatagcggtgtggagggcgaagggctgcacaagctcggatacattcttcgagacatctctaaaattcccggcggtgcaatgtatgctgatgacaccgccgggtgggacacacggatcactgaggatgacctgcataacgaagagaagataacccagcagatggatccagagcacagacaattagctaatgccatttttaaactgacgtaccagaacaaggtcgtgaaggtacagaggcctacacccaccggaactgttatggacatcatctcccgcaaagatcagcgtggctcaggccaagtggggacatatggattgaataccttcactaacatggaagcacagctcattcggcagatggagggtgaaggcgtcctgagcaaggcggacctagagaacccacaccttcccgaaaaaaagataacccagtggctggagacaaaaggggtggagagactcaagaggatggccatctcgggagatgactgcgtggtcaagcctattgatgaccgctttgctaatgccctgttggcattaaacgatatgggcaaagttcgaaaggacatcccacaatggcagccgtctaaaggttggcatgattggcagcaggtgcccttctgtagtcaccatttccacgaactgattatgaaggacgggcggaaactcgtagtgccttgcagaccacaagacgagcttatcggaagggctcgcatatcccagggcgccggctggagcctgagagaaacggcatgtctagggaaggcctacgcgcagatgtggtcactgatgtattttcaccggagggatctccgtttggcttccaatgccatctgctctgcagtccccgtgcattgggttcctaccagccgaactacatggagtattcacgcccatcaccaatggatgaccactgaggacatgctgacagtgtggaaccgcgtctggatcgaagataatccatggatggaggacaagacccccgtgacgacatgggagaacgtaccttaccttggaaaaagagaagatcagtggtgtggttccctgattggcctcaccagccgggctacttgggcccagaatatcccgaccgcaattcagcaagttaggtctttaatagggaacgaggaattcctggactacatgccatcaatgaagcgctttagaaaagaggaggaaagtgagggagctatctggtga

SEQ ID NO: 15162 - RNA, 9873 nt, synthetic construct
  misc_feature 1..9873: note = derived and/or modified CDS sequence (opt3) from DENV-3__GU131865__SS-prME
  source 1..9873: mol_type = other RNA
accagcctgtgcctcgtgatgatccttcccgcagctctggcattccacttgacctccagagacggcgagcctagaatgattgtcgggaagaacgaacggggaaaatctttactgtttaagactgcatcaggtataaatatgtgtacgttaatcgcgatggatctcggcgagatgtgcgacgataccgttacatacaaatgtccacatattactgaagtggagccggaagacatcgattgctggtgtaacctgaccagtacatgggtaacctatgggacttgcaatcaggctggagagcgccgacgtgacaagagaagcgtggcccttgcaccccacgtcggcatgggtctggatacaaggacccagacgtggatgtccgccgagggggcttggcggcaagtggaaaaagttgagacttgggcattgcgccatcctggattcaccattctcgccctgtttctggctcactacatcggcacatctctcactcagaaggtggtcatattcatcttactgatgcttgtgaccccatcgatgacaatgagatgtgtaggcgttgggaacagggactttgtggaaggattgtcaggtgccacctgggtcgatgtggtgctggagcatggcgggtgcgtcacgactatggcgaagaataaacccacactagacattgagctccagaagaccgaagcaactcagctggccacacttcggaaactgtgtatcgagggaaagattaccaacatcacgaccgatagccgctgccctacacagggcgaagctgttttgccagaggaacaggaccagaattatgtgtgtaaacacacttacgtagatcgaggttgggggaacggatgcggcctcttcggcaaggggagtctggtgacctgcgccaagtttcaatgtttagagcccatagagggaaaagtcgtgcagtatgaaaatctgaagtacacagttattatcactgtgcacaccggtgaccagcatcaggtcggcaacgagacacaaggggtgaccgcagaaattactcctcaggcttccacgacagaggccatcctcccagaatatggaacccttggcctggagtgctctccgagaactggtttggacttcaatgagatgatcctactgaccatgaaaaacaaggcgtggatggtacacaggcagtggtttttcgatctccccctgccttggacaagcggggccaccactgaaacaccaacgtggaatcggaaagagcttctggttacctttaagaacgcacatgctaaaaagcaagaagtggtcgtgttgggctcccaggagggagccatgcacactgctctcacaggcgccaccgaaattcaaaattcagggggaacaagtatattcgcaggtcacctgaagtgtcgtttaaaaatggacaagctggagctaaaaggcatgagctacgccatgtgcactaacacctttgtcctcaagaaagaggtgtctgaaacgcagcatgggaccatcctgattaaggttgagtaccgcggagaagatgctccctgtaagatccctttctccacagaggacggccaaggtaaagcgcacaacgggagacttataactgcaaatccagtggtaaccaagaaagaggaacccgtcaacattgaggccgaaccgcctttcggcgagtcaaatatcgtgatcggaattggcgataacgctttgaagatcaattggtataaaaaggggagcagtattggaaagatgtttgaagccacagcaaggggtgcccggcgaatggctatactgggcgacactgcctgggatttcgggtctgttggaggcgtgctcaactccctgggtaaaatggtccatcagatctttgggagcgcatacaccgcgcttttctcgggcgtgtcttgggtaatgaagattggaatcggcatcctgttgacgtggattgggctcaattccaaaaacacatcaatgagttttagctgcatagctatcggaattatcaccctgtatttaggcgccgtggttcaggcagacatgggttgtgtcattaattggaaggggaaagagctgaagtgcggatccggcatcttcgtgactaacgaggtgcacacatggaccgaacagtacaagtttcaagccgattctcccaaacgcctagctactgccatagccggtgcttgggagaatggcgtctgtgggatcagaagcaccacaaggatggaaaacctcctgtggaagcagattgccaatgagcttaactatatcttgtgggaaaataacattaaactgacggttgtggtgggagacatcataggcgtactcgagcaggggaagcggaccctgactccacagcctatggagttaaaatactcatggaagacatggggaaaagcgaagattgtcaccgccgaaacacaaaacagttccttcatcattgatggccccaatactccagagtgccccagcgcttctcgcgcatggaacgtgtgggaagttgaggactatggttttggggtgttcaccacgaatatctggctgaaacttagagaagtctacacacagttgtgtgaccataggctcatgtcagccgctgtgaaagatgagcgtgccgttcacgcagacatgggatactggatagagagtcagaagaacggcagctggaaactggaaaaggcgtccctaatcgaggtgaaaacctgcacttggcctaagtctcacaccctgtggtcgaatggtgtactcgaaagcgatatgattatcccaaagtccctggccggcccgatttcacagcataaccaccggcccgggtatcatacacaaactgctggaccttggcaccttggcaaattggagctggactttaattactgcgaggggaccacagtcgtgatcacggaaaactgtggaacccgaggcccaagtttaagaactacaaccgtgtctggtaagctcatacacgagtggtgctgtaggagctgcactctgccccctcttcgctatatgggggaagatggatgttggtacggcatggagattcggccaatctccgaaaaagaggagaatatggtcaagtcactggttagcgccggttctggcaaagtggacaacttcacaatgggggtattgtgcctcgcaatcctgtttgaagaggtgatgagaggaaagttcggcaagaaacatatgattgctggggtcttctttaccttcgtgctactgctctccggacagatcacgtggagggatatgactcacaccctgattatgataggcagtaatgccagcgaccgcatgggtatgggggttacatatcttgcattgatcgccacctttaagattcagcccttcctggctttaggatttttcctccgaaaactgacttctcgggaaaaccttctgctaggcgtgggcctcgcgatggccacaaccctgcaattgccggaggatatcgaacagatggcaaatgggattgctctgggattaatggccctcaagctgatcacacagtttgagacttaccagctttggaccgccctgatatccttgacgtgttcaaacacaatgttcaccctcactgtcgcttggcgtaccgcaacactgatcctagccggtgtgagtctgcttcctgtttgccaaagctcgtccatgagaaaaactgactggctcccaatggcggtggctgccatgggcgtcccacctctgcccttgtttattttctctctgaaggataccttaaagaggcgcagctggccactcaatgagggggtaatggcagtgggactggtttcaatccttgccagttccctgttgcggaacgacgtgcctatggctggccccctcgtcgccggtgggctgctaattgcctgttatgtgatcacgggaacatctgcggatctgaccgtagaaaaagctgccgacataacttgggaggaagaggcagaacagacaggcgtgagccataaccttatgattaccgtcgacgatgacggcactatgagaatcaaggatgacgagacagagaatatcctcaccgttctgttgaaaacggccttactgattgtgtccggggtgtttccatactcaataccggctactctcctggtctggcacacctggcagaagcagacacaaaggagcggagtgctttgggatgttcctagtcccccagaaacccagaaagccgagctggaagagggtgtataccgaatcaagcagcagggcattttcgggaaaacacaagtgggagtcggcgtgcagaaggagggtgtttttcatactatgtggcacgtgacccgcggggcagtcttgacgtataacggaaagcggctagaacccaattgggcttctgtgaaaaaggacctgatctcctacggcggcgggtggagactcagcgcccagtggcaaaaaggagaggaagtacaggtcattgcggtggagcctggtaagaaccccaagaatttccagacaactcccggcaccttccagacaaccactggggaaatcggagccatagcactggattttaagcctggcacctcgggttcaccgatcattaacagggaggggaaggttgtgggactttatggcaatggcgtcgtgaccaagaacgggggatacgtttctggtatcgctcaaacgaatgccgagccagacggccccactcctgaattagaggaagagatgttcaagaaacgtaacctgaccattatggatctccacccagggagtggaaagacacgcaaatatttgcccgctatcatacgggaagcaattaagagaaggctgcgaaccctcatcctggcccctactcgggtggtcgccgctgagatggaggaagcgcttaagggcctgccgatccgctaccagacaaccgtgacgaaatccgagcatactggtagagaaattgtagacttgatgtgccacgcaacatttaccatgaggctactgagccccgtgcgggttccaaattataacctcatcataatggatgaggcccatttcaccgaccctgcttctattgccgcacgagggtacatcagcactagagtcggaatgggcgaagccgctgcgatttttatgacagccacacccccaggcacagcagatgctttccctcagtccaatgcccccatccaggacgaggagcgcgacataccagaaaggtcatggaacagtgggaatgagtggattactgattttgcaggaaagacggtgtggttcgtgccgagcatcaaagccggtaacgacatcgctaactgtttacgtaagaatggcaaaaaggtcattcaactgtctcggaagacctttgatacagaataccagaaaactaaacttaacgactgggatttcgtagtgaccacagacatctccgagatgggggccaattttaaagcggatagagttattgaccctaggcgctgcctgaagcccgtgatactcaccgatggaccagagcgagtcatcttggcaggccccatgcctgtgactgccgcttcagccgctcagagacggggtagggttgggcgcaacccacagaaagaaaatgaccaatatattttcacgggccagcccctgaacaatgatgaggaccacgcacattggaccgaagccaagatgctcctggacaacatcaatacacctgagggaatcattccggctcttttcgaaccagagcgtgagaagagtgccgcaatagatggcgaatacagactaaaaggggagagccggaagacttttgtggaactgatgaggcgcggagacttgcccgtctggttagcgcacaaagtggcctccgagggtatcaagtataccgatcgaaaatggtgcttcgacggccagagaaacaatcagattctggaagagaacatggatgtagagatctggacaaaggaaggggagaaaaagaagctccggcctaggtggctggacgctcgcacctactctgatccccttgccctgaaagaatttaaggacttcgcagctggaagaaaatcgattgccctcgatttggtgactgagatcggcagggttccaagccacctggcacatcggacacgtaatgccctagacaacctggtcatgctccacacgtcagaacatggtgggcgcgcttatcgacacgcggtggaggagcttcctgaaaccatggagactctgttattgctgggcctcatgatactgcttacaggaggcgccatgctgtttctcatctccgggaagggaattggtaaaaccagtatcggcttgatttgtgtgatcgcatctagcgggatgctgtggatggctgaaatacccttacaatggattgcctccgccgtcgttctagagttctttatgatggtgctgctcatcccagagcctgaaaagcagagaaccccgcaggataatcaacttgcatacgtagtgattggaatcctgacattggctgccataatcgcggctaacgagatgggcctgctcgaaactacgaagagggacctgggtatgtcaaaagagcccggggtcgtgtctccaaccagctatcttgatgttgacctccaccctgccagtgcatggacactgtacgccgtggctactaccgtcattacacccatgttgcggcataccatcgaaaattccactgcaaacgtaagcctggccgcgattgctaaccaggccgtggttttaatgggcctagacaagggatggccaatctctaaaatggatctgggcgtgcctctccttgcactggggtgctactcacaggtcaatcccttgacgctgacagccgctgtgctcctgcttataacccactatgccattatcggaccgggcttacaggcaaaggctactcgcgaggcccagaagagaaccgcggccggtatcatgaagaacccaacagtcgacgggattatgactatcgatctggaccctgtgatatacgattccaagttcgagaaacagctcggacaggttatgttgctggtgctatgtgcagtacagctgctccttatgaggaccagttgggctctgtgcgaagccttgacactggcaacgggccccattaccactctctgggagggtagcccaggcaagttttggaatacaaccatcgctgtgtcgatggccaacattttccgggggtcttatctggccggagcgggcttagctttttccatcatgaaaagcgtcgggactggaaagcgaggcacaggttcacaaggggaaacccttggagagaaatggaagagaaagctgaatcagctcagtcgcaaagagttcgacctatacaagaaatctggcataacggaggttgataggaccgaggcaaaggaaggtctgaaacggggcgagatcacacatcacgccgtgtcccgtgggagcgctaagttgcagtggtttgtcgaaagaaacatggtgattcccgagggaagggtaatcgacctgggctgtgggcgcggaggctggtcatattactgcgccggtctcaaaaaggtgactgaagttcgggggtataccaagggaggccctggccatgaggagccggtgcccatgagtacatacgggtggaatattgtcaaacttatgactggaaaggatgtgttctacctgccacctgaaaaatgtgacaccttgctgtgcgatatcggtgagagctccccctctcctacagtcgaagagagccgaaccattagagtgctcaagatggttgagccatggctaaagaacaatcagttctgtatcaaggtactgaacccctatatgcctactgtgatagaacaccttgagaggctgcaacgcaagcacggcgggatgctagtccggaatccactctccagaaactcaacgcatgaaatgtactggatttctaatggaacaggcaacatcgtggcaagtgttaatatggtgtcgcgtctgttgctgaacaggtttaccatgactcaccggcgccccaccatcgagaaagacgtcgatctcggtgccgggacacgacatgtgaacgctgaaccggagacgcctaatatggacgtaattggagagagaataaagaggatcaaagaagaacacaacagcacctggcactatgacgatgaaaatccatacaagacttgggcgtatcatggctcctacgaggtgaaagccacaggctctgcatcaagcatgattaacggggttgtcaaacttctgaccaagccctgggacgtggtgcctatggtcactcagatggctatgacagataccacaccattcggacagcaacgggtttttaaagaaaaggtggacactcgcacccccagatccatgccgggtacgaggcgagtaatggagatcaccgccgagtggttatggcggacactgggccgtaataaaaagcctagattgtgcactcgcgaagagttcaccaaaaaggtgaggacaaacgcagccatgggggctgtctttactgaagagaatcagtgggatagtgccaaggcggcagtggaagacgaggatttctggaaactcgttgaccgggagagagaactgcacaagctaggaaaatgtggctcttgcgtgtataacatgatgggtaagcgcgagaagaaacttggggaatttggaaaagccaaaggcagcagggctatttggtacatgtggctgggcgcccgatacctcgagttcgaggcactggggtttttgaatgaagatcattggttctcacgggagaactcctatagtggagtcgaaggtgagggcctgcacaagctcgggtacatccttagagacataagcaaaatccccggaggcgctatgtatgccgatgacaccgctggttgggacacgaggattacagaagatgacctgcataatgaggagaagatcacccagcagatggatccagaacaccgccaattagccaacgcaatttttaaactgacttaccagaataaggtggtaaaagttcagcgtcctacacccaccgggactgtgatggacatcatatctcggaaggatcagagaggatccggccaagtcggcacctatgggttgaacacattcacgaatatggaggtgcagctcattaggcagatggaaggagagggtgtgctgtcaaaggcggacctagaaaacccacaccttcccgagaaaaagatcacccagtggctggagactaaaggcgtcgaacgcctcaagcgaatggccatcagcggggatgactgcgttgtgaaacctattgatgaccggtttgctaacgccctgttggcattaaatgatatgggaaaggtaagaaaggacataccacaatggcagccgtcgaaaggctggcatgattggcaacaggtgcccttctgttctcaccatttccacgagctgatcatgaaggacggtaggaaactcgtcgtgccttgccgcccacaagacgaacttattgggagagctcggatcagtcagggagccggctggtccctgagggagacagcatgtctaggcaaggcctacgcgcagatgtggagcctgatgtattttcaccgtcgagatctccgcttggcttcaaacgccatttgctccgcagttcccgtgcattgggtccctacctctagaactacatggagcatccacgcccatcaccaatggatgaccacggaagacatgctgacagtgtggaatcgggtatggatagaggataacccatggatggaggacaaaacccccgttactacctgggaaaatgtgccttaccttgggaagagggaggatcagtggtgtggaagtctgatcggtctcacatcccgcgctacttgggcccagaacattccgaccgcaatccagcaagtcaggagcttaattggcaatgaagagttcctggactacatgccatctatgaagcggtttaggaaagaggaagagtcagaaggggctatctggtga

SEQ ID NO: 15163 - RNA, 9873 nt, synthetic construct
  misc_feature 1..9873: note = derived and/or modified CDS sequence (opt3) from DENV-3__GU131866__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacagaaggagcgtagcccttgcaccccacgtgggcatgggtctggatacacggacccaaacgtggatgtccgccgagggggcttggcgccaggtcgaaaaggtggagacttgggcattgagacatcctggattcaccattctcgccctgtttctggctcactacatcggcacatctctcactcagaaagttgtgatattcatcttactgatgcttgtcaccccatcgatgacaatgaggtgtgtgggcgtagggaaccgggactttgttgaaggattgtcaggtgccacctgggtggatgtcgtgctggagcatggcgggtgcgtgacgactatggcgaagaataagcccacactagacattgagctccagaaaaccgaagcaactcaactggccacacttcgcaagctgtgtatcgagggaaaaattaccaacatcacgaccgatagccgatgccctacacagggcgaagctgtcttgccagaggaacaggaccagaattatgtttgtaagcacacttacgtggatagaggttgggggaacggatgcggcctcttcggcaaagggagtctggtaacctgcgccaagtttcaatgtttagagctgatagagggaaaggtggtccagtatgaaaatctcaaatacacagtgattatcactgttcacaccggtgaccagcatcaggtgggcaacgagacacaaggggtcaccgcagaaattactccccaggcttccacgacagaggccatccttcctgaatatggaaccctgggcttggagtgctctccaaggactggtctagacttcaatgagatgatcctgctcaccatgaagaacaaagcgtggatggtgcaccggcagtggtttttcgatctgccgcttccctggacaagcggggccaccactgaaacacctacgtggaatcgtaaggagctgttggtaacctttaaaaacgcacatgctaagaaacaagaagttgtggtcctcggctcccaggagggagccatgcacactgctctgacaggcgccaccgaaattcagaattcagggggaacaagtatattcgcaggtcacttaaagtgtcgcctgaagatggacaaactagagctcaagggcatgagctacgccatgtgcactaacacctttgtgctgaaaaaggaggtctctgaaacgcagcatgggaccatccttattaaagtggagtacaagggagaagatgctccatgtaagatccccttctccacagaggacggccaaggtaaagcgcacaacgggagattgataactgcaaatcctgttgtgaccaagaaagaggaaccagtaaacattgaggccgaacccccgttcggcgagtcaaatatcgtcatcggaattggcgataacgctctgaagatcaattggtataaaaaggggagcagtattggaaagatgtttgaagccacagcaaggggtgcccggcgaatggctatactcggcgacactgcctgggatttcgggtctgtgggaggcgttctgaactcccttggtaaaatggtgcatcagatctttgggagcgcatacaccgcgctgttctcgggcgtctcttgggtgatgaagattggaatcggcgtattgctcacgtggatcgggctgaattccaaaaacacatcaatgagttttagctgcattgctataggaatcattaccttatatctgggcgccgtggttcaggcagacatgggttgtgtcatcaattggaaggggaaagagctaaagtgcggatccggcattttcgtgactaacgaggtgcacgcctggacagaacagtacaagtttcaagctgattctcctaaacgcctcgccaccgcaatcgctggtgcctgggagaatggcgtctgtgggataagaagcactaccaggatggaaaacctgctttggaagcagatcgcgaatgagttgaactatattctgtgggaaaataacatcaaactcacagttgtggtgggagacattatcggcgtactggagcaggggaagcggacgttaaccccccagccaatggagctgaaatactcatggaagacttggggaaaagccaagatagtcacagctgaaacccaaaacagttccttcattatcgatggccctaatacacccgagtgcccaagcgcatctcgcgcctggaacgtgtgggaagttgaggactatggttttggggtgttcactaccaatatttggcttaagttgagagaagtctacacgcagctctgtgaccataggctgatgtcagctgccgtgaaagatgagcgtgcagttcacgcggacatgggatactggatcgagagtcagaagaacggcagctggaaactagaaaaggcctccctgatagaggtgaaaacatgcacctggcccaagtctcacactctctggtcgaatggtgtactggaaagcgatatgatcattcctaagtcccttgctggcccaatctcacagcataaccaccggccggggtatcatacccaaacagccggaccctggcacttgggcaaactggagttagactttaattactgcgaggggactaccgtcgtgattacagaaaactgtggaacgcgaggccctagtctcagaaccactacagtgtctggtaagctgatccacgagtggtgctgtaggagctgcacccttccacccctgcgctatatgggggaagatggatgttggtacggcatggagatacggcctatttccgaaaaagaggagaatatggtcaagtcattggttagcgcaggttctggcaaagtggacaacttcactatgggggtactctgcctggctatcctatttgaagaggtgatgagaggaaagttcggcaagaaacatatgatcgccggggtcttctttacattcgtgctgctcctgtccggacagattacctggagggatatggcacacacgcttatcatgattggcagtaatgccagcgaccgcatgggtatgggggttacttatttggctctgatagcgacctttaagatccagccattcttagccctcggatttttcctgcgaaaacttacatctcgggaaaacctgctactcggcgtgggcctggcaatggctaccactttgcaactgcccgaggatattgaacagatggccaatgggatcgccttaggactcatggctctgaagcttattacacagtttgagacctaccagctgtggacagcattgatctccctcacttgttcaaacaccatgttcacgctgacagtcgcctggcgtaccgcgactctaatactggctggtgtgagtcttctcccggtttgccaaagctcgtccatgagaaaaaccgactggctgcctatggccgtggcagccatgggcgtcccacccttgcctctgtttatcttctctttaaaggatacactcaagaggcgcagctggcccctgaatgagggggtaatggctgtgggacttgtttcaattctggcaagttccttgctccggaacgacgtgccaatggccggccctctggtcgcgggtgggctactgatcgcttgttatgtgattactggaacctctgccgatcttacggtagaaaaagcagccgacatcacatgggaggaagaggctgaacagaccggcgtgagccataacctcatgataactgtcgacgatgacggcacaatgagaattaaggatgacgagaccgagaatatcctgactgttttgttaaaaacagccctgctcatcgtgtccggggtgtttccctactcaattccagcaaccctgcttgtctggcacacgtggcagaagcagactcaaaggagcggagtgctgtgggatgttccgagtcctcccgaaacccagaaagctgagttggaagagggtgtataccgaataaagcagcagggcatcttcgggaaaacacaagtgggagtcggcgtgcagaaggagggtgtttttcataccatgtggcacgtgacacgcggggccgtcctaacttataacggaaagcggctggaaccaaattgggcgtctgtgaaaaaggacctcatttcctacggcggcgggtggagactgagcgcccagtggcaaaaaggagaggaagtacaggtcatcgcagtggagcccggtaagaaccctaaaaatttccagaccatgccaggcacgttccagacaactaccggggaaattggagctatcgcccttgattttaagcccggcacatcgggttcacctataatcaacagggaggggaaggttgtgggattatatggcaatggcgtcgtgaccaaaaacgggggatacgtttctggtattgctcaaactaatgcagagccggacggcccaacccccgaactggaggaagagatgttcaagaaacgtaacctcacaatcatggatttgcaccctgggagtggaaagacgcgcaaatatctgccagccattgtgcgggaagccatcaagagaaggctccgaactctgatacttgctcccacccgggtcgtggcggcagagatggaggaagccctgaagggcttgcctattcgctaccagacaaccgctactaaatccgagcatacaggtagagaaatcgtagacctaatgtgccacgccacctttacgatgaggctgctcagcccggtgcgggttcccaattataacttaatcattatggatgaggcacatttcactgacccagcctctatcgctgcgcgagggtacataagcacaagagtcggaatgggcgaagccgcagctatttttatgaccgccacccctcccggcactgcagatgccttcccacagtccaatgctcctatccaggacgaggagcgcgacattcccgaaaggtcatggaacagtgggaatgagtggatcacagattttgccggaaagaccgtgtggttcgtgccaagcataaaagcgggtaacgacattgcaaactgtctgcgtaagaatggcaaaaaggtcatccaactttctcggaagacatttgatactgaataccagaaaacgaagctgaacgactgggatttcgtagtgaccacagacatctccgagatgggggccaattttaaagctgatagagttattgacccgaggcgctgcctcaagcctgtgatcttgactgatggacccgagcgagtcattctggccggcccaatgcccgtgaccgctgcatcagccgctcagagacggggtagggttgggcgcaaccctcagaaagaaaatgaccaatatatattcacaggccagccactcaacaatgatgaggaccacgcccattggaccgaagcaaagatgctgcttgacaacatcaatactcccgagggaattatccctgcgctattcgaaccggagcgtgagaagagtgccgctatcgatggcgaatacagactgaaaggggagagccggaagacgtttgtggaattgatgaggcgcggagacttaccagtctggctggcccacaaagtggcatccgagggtattaagtataccgatcgaaaatggtgcttcgacggccagagaaacaatcagatactcgaagagaacatggatgtagagatctggacaaaggaaggggagaaaaagaagctgcggcccaggtggcttgacgctcgcacttactctgatcctctggccctcaaagaatttaaggacttcgcagccggaagaaaatcgattgctttggatctggtgaccgagatcggcagggttcccagccacctagcgcatcggacacgtaatgccctggacaacctcgtcatgcttcacacctcagaacatggtgggcgcgcatatcgacacgctgtggaggagctgccagaaactatggagacattattgctgctcggcctgatgattcttctgacgggaggcgccatgctctttttgatctccgggaagggaataggtaaaaccagtatcggcctgatttgtgtgatcgcctctagcgggatgttatggatggcagaaattcctctacaatggatcgcttccgccatagtcctggagttctttatgatggttctccttattcccgagccagaaaagcagagaactcctcaggataatcaactggcgtacgtggtaatcggaattttgacactggctgccatcatagcagccaacgagatgggcctcctggaaaccaccaagagggaccttggtatgtcaaaagagccgggggtggtctctcccacaagctatctcgatgtggacctgcacccagctagtgcatggactttgtacgccgttgcgacgaccgtgatcacacctatgctgcggcatactattgaaaattccaccgctaacgtcagcttagccgcaatcgccaaccaggctgtagtgctaatgggcctggacaagggatggcccatttctaaaatggatctcggcgttccacttctggccttggggtgctactcacaggtgaatcctctgacactcaccgcagctgtcctgcttttaatcactcactatgccataattggacccggcctgcaggcgaaggccacgcgcgaggcacaaaaaagaacagctgccggtatcatgaagaacccgaccgtggacgggatcatgactattgatctcgacccagtcatctacgattccaagttcgagaaacagttgggacaggtgatgctgctagttctgtgtgcagtgcagctccttctgatgaggaccagttgggctttgtgcgaagccctgacactcgccactggccctataaccacactgtgggagggtagccccggcaagttttggaatacgaccattgcggtatcgatggctaacatcttccgggggtcttatttagcaggagccggccttgctttttccattatgaaaagcgtggggactggaaagcgaggcacaggttcacaaggggaaaccctgggagagaaatggaagaagaaactcaatcagctaagtagaaaggaattcgacctgtacaaaaagtctggcatcactgaggtcgatcgcacagaggccaaagaaggtttgaagaggggcgagataacccatcacgcagtttcccgggggagcgccaaactgcagtggtttgtggaacgtaacatggtcatcccagagggaagagtgattgacctcggctgtgggaggggaggctggtcatattactgcgctggtcttaagaaggtaacggaagtgcgcgggtataccaaaggaggccccggccatgaggagcctgttccgatgagtacatacgggtggaatatcgtgaagctgatgagcggaaaagatgtcttctacttgcccccagaaaagtgtgacactctgctctgcgatattggtgagtcctctcctagccccaccgtggaagagtcccggacaatccgagtcttaaaaatggtggagccttggctgaagaacaatcagttctgtattaaggttcttaacccatatatgcccactgtaatcgaacacctggagagactacaaaggaaacacggcgggatgctcgtgcgcaatcctctgtcacggaactctacccatgaaatgtactggataagtaatggaacaggcaacattgtcgcgtcggtgaatatggttagcagattgctgctcaaccgttttaccatgactcacaggcggccaacgatcgagaaggacgtggatcttggtgccgggacacgccatgtcaacgcagaacccgagaccccgaatatggacgtgatcggagagcgaattaaaagaataaaggaagagcacaactccacttggcactatgacgatgaaaatccttacaaaacctgggcttatcatggctcttacgaggtaaaggccacaggctcagcaagctccatgatcaacggggtggttaagctgttaacgaaaccatgggacgtcgtgcccatggtgacccagatggccatgactgatacaacccctttcggacagcaaagggtctttaaggaaaaagttgacactcggacaccacgcagtatgcccggtaccagaagggtgatgggcattacagctgagtggctgtggcgaactttggggcggaataagaaaccgcgtctctgcaccagagaggaattcacgaagaaggtacgcaccaacgccgcgatgggagcagtgtttacagaggaaaatcagtgggattctgccaaagctgccgtcgaggacgaagatttctggaagctggtggacagggagcgggagctacacaaacttggcaagtgtggtagctgcgtttataacatgatggggaaaagagaaaagaaactgggagagtttggcaaggcaaagggctcacgcgctatctggtacatgtggctcggggccaggtacctggaattcgaggctttgggatttctgaatgaggatcattggttctcccgagaaaacagttatagcggtgtggagggcgaagggctccacaaacttggatacattctgcgggacatctctaagatacctggcggtgccatgtatgcagatgacactgcggggtgggacaccagaatcacagaggatgacttacataatgaagagaaaattactcagcagatggatcccgagcacaggaagctggccaacgctatctttaaattgacctaccaaaataaggtcgtgaaggtacagcgcccaacgcctacaggaaccgttatggacattatctcccgtaaagatcagcggggctcaggccaggtggggacttatggactcaacacattcaccaatatggaagcccaactgataagacagatggagggtgaaggcgtcctaagcaaggcagaccttgagaacccccacctgccagaaaaaaagattactcagtggctcgagaccaaaggggtggagaggctgaagcgcatggctatctcgggagatgactgcgtggtcaagcccatcgatgaccgatttgccaacgcattgttagccctgaatgatatgggcaaagttcggaaggacattcctcagtggcaaccatctaaaggttggcatgattggcagcaggtgccgttctgtagtcaccatttccacgaactcataatgaaggacgggagaaaacttgtagtgccctgcaggcctcaggacgagctgatcggacgcgcgagaatttcccaaggcgctggctggagcctacgggaaacagcctgtctggggaaggcatacgcccagatgtggtcactcatgtattttcacaggcgtgatttgcgactggcttccaacgccatctgctctgcagtcccagtgcattgggttcccacgagccgcaccacttggagtattcacgctcatcaccagtggatgacaaccgaggacatgcttactgtgtggaatagagtctggatcgaagataacccttggatggaggacaagacaccagtgaccacgtgggagaatgtaccctacctgggaaaacgggaagatcaatggtgtggttccctcataggcttaacaagcagggccacctgggcgcagaacatccctactgctattcagcaggttcgctctctgatcgggaatgaggaattcttggactacatgccgtcaatgaagagatttcggaaagaggaggaaagtgagggagccatttggtga

SEQ ID NO: 15164 - RNA, 9873 nt, synthetic construct
  misc_feature 1..9873: note = derived and/or modified CDS sequence (opt3) from DENV-3__GU131868__SS-prME
  source 1..9873: mol_type = other RNA
actcccctgtgcctcatgatgatccttcctgcagctctggcattccacttgaccagcagagacggcgaaccaaggatgattgtggggaagaacgaacggggaaaatccttactgtttaagactgcctctggtataaatatgtgtacgctgatcgcgatggatctcggcgaaatgtgcgacgataccgtcacttacaaatgtccgcatattactgaagttgagcccgaagacatcgattgctggtgtaacctgacctcaacctgggtgacctatgggacttgcaatcaggctggagagcgccgacgtgacaagagaagtgtagcccttgcacctcacgtgggcatgggtctggatacaaggacccagacgtggatgagcgccgagggggcttggcggcaggtcgaaaaagtggagacttgggcattgcgccatccaggattcaccattctcgccctgtttctggctcactacatcggcacatccctcactcagaaggttgtgatattcatcttactgatgcttgtcaccccctctatgacaatgagatgtgtgggcgtagggaacagggactttgttgaaggattgtcgggtgccacctgggtggatgtcgtgctggagcatggcgggtgcgtgacgactatggcgaagaataaacctacactagacattgagctccagaagaccgaagcaactcaactggccacacttcggaaactgtgtatcgagggaaagattaccaacatcacgaccgattcacgctgcccaacacagggcgaagctgtcttgcccgaggaacaggaccagaattatgtttgtaaacacacttacgtggatcgaggttgggggaacggatgcggcctcttcggcaaggggagcctggtaacctgcgccaagtttcaatgtttagagctgatagagggaaaagtggtccagtatgaaaatctcaagtacacagtgattatcactgttcacaccggtgaccagcatcaggtgggcaacgagacacaaggggtcaccgcagaaattactcctcaggctagtacgacagaggccatccttccagaatatggaaccctgggcttggagtgctccccgagaactggtctagacttcaatgagatgatcctgctcaccatgaaaaacaaggcgtggatggtgcacaggcagtggtttttcgatctgccccttccttggacatctggggccaccactgaaacaccaacgtggaatcggaaagagctgttggtaacctttaacaatgcacatgctaagaaacaagaagttgtggtcctcggcagccaggagggagccatgcacactgctctgacaggcgccaccgaaattcagaactccgggggaacatcaatattcgcaggtcacttaaagtgtcgtctgaagatggacaaactagagctcaagggcatgagttacgccatgtgcactaacacctttgtgctgaaaaaggaggtcagcgaaacgcagcatgggaccatccttattaaagtggagtacaagggagaagatgctccctgtaagatccctttctctacagaggacggccaaggtaaagcgcacaatgggcgcttgataactgcaaacccagttgtgaccaagaaagaggaacccgtaaatattgaggccgaaccgcctttcggcgagtccaacatcgtcatcggaattggcgataatgctctgaagatcaactggtataaaaaggggtcaagcattggaaagatgtttgaagccacagcaagaggtgccaggcggatggctatactcggcgacactgcctgggatttcgggagtgtgggaggcgttctaaattctcttggtaaaatggtgcatcagatctttgggtccgcatacaccgcgctgttcagcggcgtctcgtgggtgatgaagattggaatcggcgtattgctcacgtggatcgggctgaactctaaaaatacatccatgtcatttagttgcattgctataggaatcattaccttatatctgggcgccgtggttcaggcagacatgggttgtgtcatcaactggaaggggaaagagctaaagtgcggaagcggcattttcgtgactaatgaggtgcacacatggaccgaacagtacaagtttcaagccgattcccccaaacgactcgctactgccatcgccggtgcttgggagaacggcgtctgtgggatacgctctaccacaagaatggaaaatctgctttggaagcagatcgccaacgagttgaattatattctgtgggaaaacaacatcaaactcacggttgtggtgggagacattatcggcgtactggagcaggggaagaggaccttaactccacagcctatggagctgaaatacagctggaagacatggggaaaagcgaagatagtcaccgccgaaacacaaaattcaagtttcattatcgatggccccaacactccagagtgcccctccgctagccgggcatggaatgtgtgggaagttgaggactatggttttggggtgttcaccacgaacatttggcttaagttgcgcgaagtctacacacagctctgtgaccatagactgatgtctgccgctgtgaaagatgagagggccgttcacgcagacatgggatactggatcgagtcacagaagaatggcagttggaaactagaaaaggcgagcctgatagaggtgaaaacctgcacttggcctaagtcccacaccctctggtctaacggtgtactggaatcggatatgatcattccaaagagccttgccggcccgatctcccagcataatcaccgtcccgggtatcatacacaaactgctggaccttggcacttgggcaaactggagttagactttaactactgcgaggggaccacagtcgtgattacggaaaattgtggaacccggggcccatcactccgaactacaaccgtgagtggtaagctgatccacgagtggtgctgtagatcttgcactcttccccctctgaggtatatgggggaagatggatgttggtacggcatggagatacgcccaattagcgaaaaagaggagaacatggtcaagtccttggtttcagccggtagcggcaaagtggacaatttcacaatgggggtactctgcctggcaatcctatttgaagaggtgatgcggggaaagttcggcaagaaacatatgatcgctggggtcttctttaccttcgtgctgctcctgtctggacagattacgtggagagatatggcccacactcttatcatgattggctccaacgcaagtgacaggatgggtatgggggttacctatttggccctgatagctacatttaagatccagcccttcttagcgctcggatttttcctgcgcaaacttaccagccgagaaaatctgctactcggcgtgggcctggccatggcaactacattgcaactgccggaggatattgaacagatggctaacgggatcgccttaggactcatggccctgaaacttattacccagtttgagacataccagctgtggactgctttgatctctctcacctgttccaatacgatgttcacactgaccgtcgcatggcggactgccaccctaatactggcgggtgtgtcacttctccctgtttgccaaagtagctcgatgcgtaaaacagactggctgccaatggctgtggccgcaatgggcgtcccacctttgcccctgtttatcttctccttaaaggatactctcaagagaaggtcttggccactgaacgagggggtaatggccgtgggacttgttagcattctggcttcaagtttgctccgcaacgacgtgcctatggcaggccccctggtcgccggtgggctactgatcgcgtgttatgtgattaccggaacgtccgctgatcttacagtagaaaaagccgcagacatcacctgggaggaagaggccgaacagactggcgtgtctcataatctcatgataacagtcgacgatgacggcaccatgcggattaaggatgacgagactgagaacatcctgacagttttgttaaaaaccgctctgctcatcgtgagcggggtgtttccatactccattccggccacgctgcttgtctggcacacttggcagaagcagacccaaagatcaggagtgctgtgggatgttcctagtcccccagaaacacagaaagcagagttggaagagggtgtatacaggataaagcagcagggcatcttcgggaaaacccaagtgggagtcggcgtgcagaaggagggtgtttttcatacaatgtggcacgtgactcgaggggctgtcctaacctataatggaaagcgcctggaacccaactgggccagtgtgaaaaaggacctcatttcttacggcggcgggtggcggctgtccgcgcagtggcaaaaaggagaggaagtacaggtcatcgccgtggagcctggtaagaatcccaagaacttccagacgatgcccggcacattccagactaccacaggggaaattggagcaatcgctcttgattttaagcctggcaccagcggttcgccgataatcaatagagaggggaaggttgtgggattatatggcaacggcgtcgtgactaaaaatgggggatacgtttcaggtattgcccaaaccaaggctgagccagacggccccacacctgaactggaggaagagatgttcaaaaagaggaacctcacgatcatggatttgcacccagggtctggaaaaactcgtaagtatctgcccgcaattgtgcgcgaagccatcaagcggagactcaggaccctgatacttgcccctacacgagtcgtggctgcggagatggaggaagcactgaaaggcttgccgattcggtaccagaccactgccacaaagagtgagcataccggtcgcgaaatcgtagacctaatgtgccacgctacgtttactatgagactgctctcccccgtgagggttccaaattataacttaatcattatggatgaggcccatttcacagaccctgcaagcatcgccgctcgggggtacatatctacccgagtcggaatgggcgaagcgagcgccatttttatgaccgcaactcccccaggcacagctgatgccttccctcagtccaatgcacccatccaggacgaggagagagacattccagaacgctcatggaacagtgggaatgagtggatcaccgattttgccggaaaaacagtgtggttcgtgccgagcataaaggctggtaacgacattgccaactgtctgaggaaaaatggcaagaaggtcatccaactttctcgtaaaacttttgatacggaataccagaagaccaaactgaacgactgggatttcgtagtgacaactgacatctccgagatgggggcgaattttaaggcagatcgggttattgaccctagaaggtgcctcaaacccgtgatcttgaccgatggaccagagcgcgtcattctggccggccccatgcctgtgacagctgcctcagctgcacagcgaagaggtcgggttgggaggaacccacagaaggaaaatgaccaatatatattcaccggccagcccctcaacaatgatgaggaccacgcccattggactgaagctaagatgctgcttgacaacatcaatacgcctgagggaattatcccggccctattcgaaccagagcgcgagaaaagtgcagcgatcgatggcgaataccgtctgaagggggagagcagaaaaacctttgtggaattgatgcggaggggagacttacccgtctggctggcccacaaggtggcttccgagggtattaaatatacagatcgcaagtggtgcttcgacggccagcgaaacaatcagatactcgaagagaacatggatgtagagatctggactaaagaaggggagaagaagaaactgagacctcggtggcttgacgccaggacctactctgatcccctggcactcaaggaatttaaagacttcgctgccggacgcaagtcgattgcattggatctggtgacagagatcggcagagttccaagccacctagcccataggacccggaatgctctggacaacctcgtcatgcttcacacttcagaacatggtgggcgtgcgtatcgccacgccgtggaggagctgcctgaaacaatggagacgttattgctgctcggcctgatgattcttctgaccggaggcgcaatgctctttttgatctccgggaaaggaataggtaagacaagcatcggcctgatttgtgtgatcgcttctagcgggatgttatggatggccgaaattcccctacaatggatcgcctccgcaatagtcctggagttctttatgatggttctccttattccagagcctgaaaagcagcgaacaccgcaggataatcaactggcttacgtggtaatcggaattttgaccctggccgcgatcatagctgccaacgagatgggcctcctggaaaccacaaaaagagaccttggtatgtcaaaggagccctctgtggtcagcccaacaagttatctcgatgtggacctgcaccctgcatccgcctggacgttgtacgctgttgcaaccacagtgatcactcccatgctgaggcataccattgaaaatagcacagccaacgtctctttagcggctatcgccaaccaggcagtagtgctaatggggctggacaaaggctggccaatttcaaagatggatctcggagttcctcttctggccttgggctgctactcccaggtgaatcccctgaccctcactgctgccgtcttcctgcttatcacgcactatgcaataattgggccgggattacaggctaaagccacacgggaggcgcaaaagcgcaccgccgcaggcatcatgaagaacccaactgtggacggtatcatgaccattgatctggaccctgtcatctacgatagtaaatttgagaagcagctcggacaggtgatgttgctggttctatgtgctgtgcagctgctccttatgagaacaagctgggccctgtgcgaagcattgactctggctaccggacccataacaacgctctgggagggctcgccaggtaaattctggaataccactattgccgtatctatggccaacatctttaggggctcctatctggcgggggctggattagcattcagcattatgaagtcagtgggcacagggaaacggggaaccggcagtcaaggtgaaactcttggggagaagtggaagaaaaagctgaatcagctctctcgaaaagaatttgacctatacaagaaatccggaatcacagaggtcgatagaaccgaggccaaggaaggcctgaaacgcggtgagataacgcatcacgctgttagcaggggctcagccaagttgcagtggttcgtggaacggaacatggtcatccccgaggggcgtgtgattgacctgggatgtggcagagggggatggagttattactgcgcaggcctcaagaaagtaaccgaagtgaggggttatacaaaaggcgggcctgggcatgaggagccggttcccatgagcacttacggctggaatatcgtgaaacttatgtccgggaaggatgtcttctacctgccacctgaaaaatgtgacaccttgctgtgcgatattggagagtctagcccctcccctacagtggaagagtcacgcactatccgggtcctcaagatggtggagccatggttaaagaacaatcagttttgtattaaagttctgaacccctatatgcctaccgtaatcgaacaccttgagcgactgcaaagaaagcacggtggcatgctagtgaggaatccactctctcgcaacagtacacatgaaatgtactggatatcgaatgggaccggaaacattgtcgccagcgtgaatatggtttcccggctgttgctgaacagattcactatgacgcaccgtaggcccacaatcgagaaagacgtggatctcggcgctggtacccggcatgtcaacgcggaaccggagactcctaatatggacgtgatcggggagcgcattaagcgaataaaagaggaacacaactctacctggcactatgacgatgaaaatccatacaagacatgggcctatcatggatcatacgaggtaaaggcaacgggcagcgcttccagtatgatcaacggcgtggttaaacttctgaccaagccctgggacgtcgtgcctatggtgactcagatggccatgacagataccactccatttgggcagcaaagagtcttcaaagaaaaggttgacacaaggacaccccggtctatgccgggaacacgcagagtgatgggtattactgcagagtggttatggaggaccctgggccgaaataaaaagcctcggttgtgcacgcgtgaggaatttaccaagaaagtaagaacaaacgccgctatgggggccgtgttcactgaggaaaatcagtgggatagcgcgaaggcagccgtcgaggacgaagatttttggaaactcgtggaccgcgagagggagctgcacaagctaggaaaatgtggctcatgcgtttataacatgatgggtaagcgggagaagaaacttggggagttcggaaaggctaaaggctccagagccatctggtacatgtggctgggcgcacgctacctcgaatttgaggctctggggttcttgaatgaggatcattggtttagtagggaaaacagctattctggagtggagggtgaaggcctgcacaagctcgggtacattcttcgagacatctccaaaatacccggaggcgccatgtatgctgatgacaccgccggttgggacacacggatcactgaggatgacctgcataatgaagagaagattacccagcagatggatccagagcacagacaattagcaaacgcgatcttcaaactgacgtaccagaataaggtcgtgaaggtacagaggcctacacccaccgggactgttatggacattatctcacgcaaagatcagcgtggaagcggccaagtgggcacatatgggttgaacacctttactaatatggaagcccagctcatacggcagatggagggagaaggtgtcctgtcgaaggctgacctagagaacccacaccttcccgagaagaagattacccagtggctggagacaaaaggcgtggagagactcaagaggatggccatctctggggatgactgcgtggtcaagcctatcgatgaccgcttcgcaaacgctctgttggccttaaatgatatgggaaaagttcgaaaggacattccacaatggcagccgagtaaaggctggcatgattggcaacaggtgcccttctgttcccaccattttcacgaactgataatgaaggacggtcggaaactcgtagtgccttgcagaccacaagacgagcttatcgggagggcacgcattagccagggagccggctggtcactgagagaaacggcgtgtctaggcaaggcttacgcccagatgtggtccctgatgtatttccaccggagggatctccgtttggcatctaacgccatctgcagcgctgtccccgtgcattgggttcctaccagtcgaactacatggtccattcacgcccatcaccaatggatgaccactgaggacatgctgacagtgtggaatcgcgtctggatcgaagataacccatggatggaggacaagacccccgtgacgacatgggagaatgtaccttaccttgggaaaagagaagatcagtggtgtggaagcctgataggtctcacctctcgggcaacttgggctcagaacatcccgaccgccattcagcaagttaggtcattaatcggcaatgaggaatttctggactacatgccaagtatgaagcgcttcagaaaagaggaggaatccgagggggcgatttggtga

SEQ ID NO: 15165 - RNA, 9873 nt, synthetic construct
  misc_feature 1..9873: note = derived and/or modified CDS sequence (opt3) from DENV-3__GU131869__SS-prME
  source 1..9873: mol_type = other RNA
accagcctgtgcctcgtgatgatccttcccgcagctctggcattccacttgacatcccgggacggcgagcctaggatgattgtcgggaagaacgaacggggaaagtctttactgtttaagactgcatcaggtataaatatgtgtacgttaatcgcgatggatctcggcgagatgtgcgacgataccgttacatacaaatgtccacatattactgaagtggagccggaagacatcgattgctggtgtaacctgaccagtacatgggtaacctatgggacttgcaatcaggctggagagcgccgacgtgacaagagaagcgtggcccttgcaccccacgtcggcatgggtctggatacaaggacccagacgtggatgtccgccgagggggcttggagacaggtggaaaaagttgagacttgggcattgcgccatcctggattcaccattctcgccctgtttctggctcactacatcggcacatctctcactcagaaggtggtcatattcatcttactgatgcttgtgaccccatcgatgacaatgagatgtgtaggcgttgggaacagggactttgtggaaggattgtcaggtgccacctgggtcgatgtggtgctggagcatggcgggtgcgtcacgactatggcgaagaataaacccacactagacattgagctccagaagaccgaagcaactcaactggccacacttcggaaactgtgtatcgagggaaagattaccaacatcacgaccgatagccgctgccctacacagggcgaagctgttttgccagaggaacaggaccagaattatgtgtgtaaacacacttacgtagatcgaggttgggggaacggatgcggcctcttcggcaaggggagtctggtgacctgcgccaagtttcaatgtttagagcccatagagggaaaagtcgtgcagtatgaaaatctgaagtacacagttattatcactgtgcacaccggtgaccagcatcaggtcggcaacgagacacaaggggtgaccgcagaaattactcctcaggcttccacgacagaggccatcctcccagaatatggaacccttggcctggagtgctctccgagaactggtttggacttcaatgagatgatcctactgaccatgaaaaacaaggcgtggatggtacacaggcagtggtttttcgatctccccctgccttggacaagcggggccaccactgaaacaccaacgtggaatcggaaagagcttctggttacctttaagaacgcacatgctaaaaagcaagaagtggtcgtgttgggctcccaggagggagccatgcacactgctctcacaggcgccaccgaaattcaaaattcagggggaacaagtatattcgcaggtcacctgaagtgtcgtttaaaaatggacaagctggagctaaaaggcatgagctacgccatgtgcactaacacctttgtcctcaagaaagaggtgtctgaaacgcagcatgggaccatcctgattaaggttgagtaccgcggagaagatgctccctgtaagatccctttctccacagaggacggccaaggtaaagcgcacaacgggagacttataactgcaaatccagtggtaaccaagaaagaggaacccgtcaacattgaggccgaaccgcctttcggcgagtcaaatatcgtgatcggaattggcgataacgctttgaagatcaattggtataaaaaggggagcagtattggaaagatgtttgaagccacagcaaggggtgcccggcgaatggctatactgggcgacatcgcctgggatttcgggtctgttggaggcgtgctcaactccctgggtaaaatggtccatcagatttttgggagcgcatacactgcgcttttctcgggcgtgtcttgggtaatgaagatcggaatcggcattctgttgacctggatagggctcaattccaaaaacacgtcaatgagttttagctgcatcgctattggaatcattacactgtatttaggcgccgtggttcaggcagacatgggttgtgtcatcaattggaaggggaaagagctgaagtgcggatccggcatattcgtgaccaacgaggtgcacacttggacagaacagtacaagtttcaagccgattctcccaaacgcctagctaccgccatcgccggtgcttgggagaatggcgtctgtgggattagaagcactaccaggatggaaaacctcctgtggaagcagatcgccaatgagcttaactatattttgtgggaaaataacatcaaactgacagttgtggtgggagacataattggcgtactcgagcaggggaagcggacgctgaccccacagcctatggagttaaaatactcatggaagacttggggaaaagcgaagatcgtcacagccgaaacccaaaacagttccttcattatcgatggccccaatacaccagagtgccccagcgcttctcgcgcatggaacgtgtgggaagttgaggactatggttttggggtgttcactaccaatatatggctgaaacttagagaagtctacacgcagttgtgtgaccataggctcatgtcagccgctgtgaaagatgagcgtgccgttcacgcagacatgggatactggatcgagagtcagaagaacggcagctggaaactggaaaaggcgtccctaattgaggtgaaaacatgcacctggcctaagtctcacactctgtggtcgaatggtgtactcgaaagcgatatgatcattccaaagtccctggccggcccgatctcacagcataaccaccggcccgggtatcatacccaaacagctggaccttggcaccttggcaaattggagctggactttaattactgcgaggggactaccgtcgtgataacagaaaactgtggaacgcgaggcccaagtttaagaaccactacagtgtctggtaagctcattcacgagtggtgctgtaggagctgcaccctgccccctcttcgctatatgggggaagatggatgttggtacggcatggagatccggccaatctccgaaaaagaggagaatatggtcaagtcactggttagcgccggttctggcaaagtggacaacttcactatgggggtattgtgcctcgcaattctgtttgaagaggtgatgagaggaaagttcggcaagaaacatatgatcgctggggtcttctttacattcgtgctactgctctccggacagattacctggagggatatgacgcacactctgataatgatcggcagtaatgccagcgaccgcatgggtatgggggttacctatcttgcattgattgccacatttaagatccagcccttcctggctttaggatttttcctccgaaaactgacctctcgggaaaaccttctgctaggcgtgggcctcgcgatggccactacactgcaattgccggaggatattgaacagatggcaaatgggatcgctctgggattaatggccctcaagctgataacccagtttgagacataccagctttggactgccctgatctccttgacctgttcaaacacgatgttcacactcaccgtcgcttggcgtactgcaaccctgattctagccggtgtgagtctgcttcctgtttgccaaagctcgtccatgagaaaaacagactggctcccaatggcggtggctgccatgggcgtcccacctctgcccttgtttatcttctctctgaaggatactttaaagaggcgcagctggccactcaatgagggggtaatggcagtgggactggtttcaattcttgccagttccctgttgcggaacgacgtgcctatggctggccccctcgtcgccggtgggctgctaatcgcctgttatgtgataaccggaacgtctgcggatctgacagtagaaaaagctgccgacattacctgggaggaagaggcagaacagactggcgtgagccataaccttatgatcacagtcgacgatgacggcaccatgagaatcaaggatgacgagactgagaatattctcacagttctgttgaaaaccgccttactgatagtgtccggggtgtttccatactcaatcccggctacgctcctggtctggcacacttggcagaagcagacccaaaggagcggagtgctttgggatgttcctagtcccccagaaacacagaaagccgagctggaagagggtgtataccgaattaagcagcagggcatcttcgggaaaacccaagtgggagtcggcgtgcagaaggagggtgtttttcatacaatgtggcacgtgactcgcggggcagtcttgacctataacggaaagcggctagaacccaattgggcttctgtgaaaaaggacctgatttcctacggcggcgggtggagactcagcgcccagtggcaaaaaggagaggaagtacaggtcatcgcggtggagcctggtaagaaccccaagaatttccagacgacacccggcactttccagaccacaaccggggaaataggagccatcgcactggattttaagcctggcacttcgggttcaccgattatcaacagggaggggaaggttgtgggactttatggcaatggcgtcgtgaccaaaaacgggggatacgtttctggtattgctcaaacaaatgccgagccagacggccccacgcctgaattagaggaagagatgttcaagaaacgtaacctgactatcatggatctccacccagggagtggaaagacccgcaaatatttgcccgctataattcgggaagcaatcaagagaaggctgcgaacactcatcctggcccctacccgggtggtcgccgctgagatggaggaagcgcttaagggcctgccgattcgctaccagactacagcaaccagatccgagcatacgggtagggaaatcgtggacttgatgtgccacgccacttttacaatgcggctactgagccccgtacgagtgccaaattataacctcataattatggatgaggctcatttcaccgaccctgcctctatcgcagccagagggtacattagcacccgcgttggaatgggcgaagctgcggccatctttatgactgcaacacccccaggcaccgctgatgccttccctcagtccaatgcacccatacaggacgaggagagggacattccagaacgttcatggaacagtgggaatgagtggatcacagattttgccggaaaaactgtctggttcgtgccgagcatcaaggctggtaacgacattgccaactgtttacggaaaaatggcaagaaagtgatccaactgtctagaaagacgtttgataccgaataccagaagacaaaacttaacgactgggatttcgtcgtaactaccgacatttccgagatgggggcgaattttaaggcagatagggtgatagaccctcgccgatgcctgaaacccgttatcctcacagatggaccagagagagtgattttggccggccccatgcctgtcaccgctgcctcagctgcacagcggaggggtcgcgtggggcgtaacccacagaaggaaaatgaccaatatatcttcactggccagcccctgaacaatgatgaggaccacgcccattggacggaagctaaaatgctcctggacaacatcaatacccctgagggaattataccggcccttttcgaaccagagagagagaagagtgcagcgatcgatggcgaataccggctaaagggggagagcaggaaaacatttgttgaactgatgcgccgaggagacttgcccgtgtggttagcccacaaggtcgcttccgagggtattaaatatactgatagaaagtggtgcttcgacggccagcggaacaatcagatcctggaagagaacatggatgtggagatttggaccaaagaaggggagaagaaaaagctcaggcctcgctggctggacgccagaacatactctgatccccttgcactgaaggaatttaaagacttcgctgccggaaggaagtcgatcgcactcgatttggtaaccgagataggccgggtgccaagccacctggcccatcgtactcgcaatgctctagacaacctggttatgctccacacatcagaacatggtgggcgagcgtatagacacgccgtcgaggagcttcctgaaacgatggagaccctgttattgctgggcctcatgatcctgcttactggaggcgcaatgctgtttctcatttccgggaaaggaatcggtaagacaagtattggcttgatctgtgtgatagcttctagcgggatgctgtggatggccgaaattcccttacaatggatcgcctccgcaattgtgctagagttctttatgatggtcctgctcatcccagagcctgaaaaacagaggaccccgcaggataatcaacttgcttacgttgtgataggaatcctgaccttggccgcgattatcgctgccaacgagatgggcctgctcgaaacaactaagcgggacctgggtatgtcaaaggagcccggggtagtgtctccaacgagctatcttgatgtcgacctccaccctgcaagtgcctggaccctgtacgctgtggcaacaactgttattacccccatgttgcgccatacaatcgaaaattccaccgccaacgtgagcctggcggctatagccaaccaggcagtcgtattaatgggcctagacaaaggatggccaatttctaagatggatctgggcgtgcctctccttgccctggggtgctactcacaggttaatcccttgactctgacggctgccgtgctcctgcttatcacacactatgcaatcattggaccgggcttacaggctaaagccaccagagaggcgcaaaagaggactgccgcaggtatcatgaaaaacccaaccgtcgacgggataatgacaattgatctggaccctgtgatctacgattccaagttcgagaagcagctcggacaggtcatgttgctggtgctatgtgctgttcagctgctccttatgcggacaagttgggccctgtgcgaagcattgaccctggctacaggccccattacgaccctctgggagggtagcccaggcaaattttggaatactacaatcgccgtgtcgatggccaacatattccgagggtcttatctggcgggagctggcttagcattttccatcatgaaaagcgtagggaccggaaaaagaggcactggttcacaaggggaaacacttggagagaagtggaaaaagaagctgaatcagctcagtcgcaaagagttcgacctatacaagaaatctggcattaccgaggtggataggacggaggccaaggaaggtctgaaacggggcgagatcacccatcacgctgtctcccgtgggagcgccaagttgcagtggtttgttgaaagaaacatggtgattcccgagggaagggtcatcgacctgggctgtgggcgcggaggctggtcatattactgcgcaggtctcaaaaaggtgacagaagtacgggggtatactaagggaggccctggccatgaggagccggtgcccatgagtacctacgggtggaatattgttaaacttatgagcggaaaggatgtgttctacctgccacctgaaaaatgtgacacattgctgtgcgatatcggtgagtcctctcccagccctactgtcgaagagtcccgaaccataagagtgctcaagatggtcgagccatggctaaagaacaatcagttctgtattaaggtgctgaacccctatatgcctacagttatcgaacaccttgagaggctgcaacgcaagcacggcgggatgctagtacggaatccactctcaagaaactctacccatgaaatgtactggatcagtaatggaactggcaacattgtggcctcggtcaatatggtgagccgtctgttgctgaacaggtttacgatgacacaccggcgccccaccatagagaaagacgttgatctcggtgctgggactcgacatgtgaacgcggaaccggagacccctaatatggacgtcatcggagagagaattaagaggatcaaagaagaacacaactccacatggcactatgacgatgaaaatccatacaagacgtgggcctatcatggctcttacgaggtgaaagcaaccggctcagctagctccatgattaacggggtagtgaaacttctgactaagccctgggacgttgtccctatggtgacacagatggccatgaccgatactacaccattcggacagcaacgggtgtttaaagaaaaggtcgacacccgcacacccagaagtatgccgggtactaggcgagttatggagatcaccgcagagtggttatggcggacgctgggccgtaataaaaagcctagattgtgcacccgcgaagagttcactaagaaggtgaggactaacgccgctatgggggccgtatttaccgaagagaatcagtgggattctgcgaaggcagccgtggaagacgaggatttctggaaactcgtcgaccgggagagagaactgcacaagctaggaaaatgtggcagctgcgtgtataacatgatgggtaagcgcgagaagaaacttggggaatttggaaaagctaaaggctcaagggccatatggtacatgtggctgggcgcacgatacctcgagttcgaggctctggggtttttgaatgaagatcattggttctcccgggagaacagttatagcggagttgaaggtgagggcctgcacaagctcgggtacatccttagagacatttctaaaatccccggaggcgccatgtatgctgatgacacagccggttgggacactaggattaccgaagatgacctgcataatgaggagaagatcacgcagcagatggatccagaacaccgccaattagcaaacgcgatatttaaactgacataccagaataaggtggtcaaagtgcagcgtcctacccccactgggacagtaatggacattatctcccggaaggatcagagaggatcaggccaagttggcacctatgggttgaacactttcaccaatatggaggcccagctcatcaggcagatggaaggagagggtgtgctgagcaaggctgacctagaaaacccacaccttcccgagaaaaagattacacagtggctggagacgaaaggcgtcgaacgcctcaagcgaatggccatatcgggggatgactgcgtggtgaaacctatcgatgaccggtttgcaaacgctctgttggccttaaatgatatgggaaaggtcagaaaggacattccacaatggcagccgtctaaaggctggcatgattggcagcaggttcccttctgtagtcaccatttccacgagctgatcatgaaggacggtaggaaactcgtggtaccttgccgcccacaagacgaacttattgggagagcacggatctcccagggagccggctggagcctgagggagaccgcgtgtctaggcaaggcttacgcccagatgtggtcactgatgtattttcaccgtcgagatctccgcttggcatccaacgccatatgctctgctgtgcccgtccattgggtgcctactagcagaacaacctggagtatccacgcccatcaccaatggatgactacagaagacatgctgaccgtttggaatcgggtgtggattgaggataacccatggatggaggacaaaacgcccgtcacaacctgggaaaatgtgccttaccttgggaagagggaggatcagtggtgtggatccctgatcggtctcactagccgcgcaacctgggctcagaacattccgacagccatccagcaagtaagatctttaattggcaatgaagagttcctggactacatgccatcaatgaagcggtttaggaaagaggaagagagtgaaggggcgatatggtga

SEQ ID NO: 15166 - RNA, 9873 nt, synthetic construct
  misc_feature 1..9873: note = derived and/or modified CDS sequence (opt3) from DENV-3__GU131870__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagcccatagagggaaaagtggtccagtatgaaaatctgaagtacacagtgattatcactgttcacaccggtgaccagcatcaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaaaaacaaggcgtggatggtgcacaggcagtggtttttcgatctccccctgccttggacaagcggggccaccactgaaacaccaacgtggaatcggaaagagcttctggtaacctttaagaacgcacatgctaaaaagcaagaagttgtggtcttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtgctcaagaaagaggtctctgaaacgcagcatgggaccatcctgattaaggtggagtaccgcggagaagatgctccctgtaagatccctttctccacagaggacggccaaggtaaagcgcacaacgggagacttataactgcaaatccagttgtgaccaagaaagaggaacccgtaaacattgaggccgaaccgcctttcggcgagtcaaatatcgtcatcggaattggcgataacgctttgaagatcaattggtataaaaaggggagcagtattggaaagatgtttgaagccacagcaaggggtgcccggcgaatggctatactgggcgacactgcctgggatttcgggtctgtgggaggcgttctcaactccctgggtaaaatggtgcatcagatctttgggagcgcatacaccgcgcttttctcgggcgtctcttgggtgatgaagattggaatcggcatcctgttgacgtggattgggctcaattccaaaaacacatcaatgagttttagctgcatagctatcggaattatcaccctgtatttaggcgccgtagtgcaggcagacatgggttgtgttattaattggaaggggaaagagctgaagtgcggatccggcatcttcgtcactaacgaggtgcacacatggaccgaacagtacaagtttcaagccgattctcccaaacgcctagctactgccatagcaggtgcttgggagaatggcgtgtgtgggatcagaagcaccacaaggatggaaaacctcctgtggaagcagattgccaatgagcttaaccatatcttgtgggaaaataacattaaactgacggtcgttgtgggagacatcataggcgtgctcgagcaggggaagcggaccctgactccacagcctatggagttaaaatattcatggaagacatggggaaaagcgaagattgtaaccgccgaaacacaaaacagttccttcatcattgatggccccaatactccagagtgccccagcgcttctcgcgcatggaacgtctgggaagtggaggactacggttttggggttttcaccacgaatatctggctgaagcttagagaagtgtatacacagttgtgtgaccacaggctcatgtcagccgctgtcaaagatgagcgtgccgtgcacgcagacatgggatactggatagagagtcagaagaacggcagctggaaactggaaaaggcgtccctaatcgaggttaaaacctgcacttggcctaagtctcataccctgtggtcgaatggtgtgctcgaaagcgatatgattatcccaaagtccctggccggcccgatttcacagcacaaccatcggcccgggtaccacacacaaactgctggaccttggcaccttggcaaattggagctggactttaattattgcgaggggaccacagtagtcatcacggaaaactgtggaacccgaggcccaagtttaagaactacaaccgtgtctggtaagctcatacatgagtggtgctgtaggagctgcactctgccccctcttcgctacatgggggaagatggatgttggtatggcatggagattcggccaatctccgaaaaagaggagaatatggtgaagtcactggtcagcgccggttctggcaaagttgacaacttcacaatgggggtgttgtgcctcgcaatcctgtttgaagaggtaatgagaggaaagttcggcaagaaacacatgattgctggggtgttctttaccttcgtcctactgctctccggacagatcacgtggagggatatgactcataccctgattatgataggcagtaatgccagcgaccgcatgggtatgggggtgacataccttgcattgatcgccacctttaagattcagcccttcctggctttaggatttttcctccgaaaactgacttctcgggaaaaccttctgctaggcgttggcctcgcgatggccacaaccctgcaattgccggaggatatcgaacagatggcaaatgggattgctctgggattaatggccctcaagctgatcacacagtttgagacttatcagctttggaccgccctgatatccttgacgtgttcaaacacaatgttcaccctcactgtggcttggcgtaccgcaacactgatcctagccggtgtcagtctgcttcctgtgtgccaaagctcgtccatgagaaaaactgactggctcccaatggcggttgctgccatgggcgtgccccctctgcccttgtttattttctctctgaaggataccttaaagaggcgcagctggccactcaatgagggggtcatggcagtaggactggtgtcaatccttgccagttccctgttgcggaacgacgttcctatggctggccccctcgtggcaggtgggctgctaattgcctgttacgtcatcacgggaacatctgcggatctgatagtggaaaaagctgccgacattacctgggaggaagaggcagaacagactggcgtaagccacaaccttatgatcacagtggacgatgacggcaccatgagaatcaaggatgacgagactgagaatattctcacagtcctgttgaaaaccgccttactgatagtttccggggtgtttccatattcaatcccggctacgctcctggtgtggcatacttggcagaagcagacccaaaggagcggagtcctttgggatgtgcctagtcccccagaaacacagaaagccgagctggaagagggtgtttaccgaattaagcagcagggcatcttcgggaaaacccaagtaggagtgggcgtccagaaggagggtgtgtttcacacaatgtggcacgttactcgcggggcagtgttgacctacaacggaaagcggctagaacccaattgggcttctgtcaaaaaggacctgatttcctatggcggcgggtggagactcagcgcccagtggcaaaaaggagaggaagtgcaggtaatcgcggtcgagcctggtaagaacccaaaaaatttccagacgatgcccggcacattccagactaccacaggggaaataggagccatcgcactggattttaagcctggcacctcgggttcaccgattatcaacagggaggggaaggtggttggactttacggcaatggcgtggtcactaaaaacgggggatatgtgtctggtattgctcaaaccaatgccgagccagacggccccacacctgaattagaggaagagatgttcaagaaacgtaacctgacgatcatggatctccatccagggagtggaaagactcgcaaatacttgcccgctataattcgggaagcaatcaagagaaggctgcgaaccctcatcctggcccctacacgggttgtggccgctgagatggaggaagcgcttaagggcctgccgattcgctatcagaccactgcaacaaaatccgagcacaccggtagagaaatcgtcgacttgatgtgccatgccacgtttactatgaggctactgagccccgtgcgggtaccaaattacaacctcataattatggatgaggctcacttcacagaccctgcctctatcgcagcccgagggtatattagcaccagagtgggaatgggcgaagctgcggccatctttatgaccgcaactcccccaggcacagctgatgccttccctcagtccaatgcacccatacaggacgaggagcgcgacattccagaaaggtcatggaacagtgggaatgagtggatcaccgattttgccggaaagacagtttggttcgtcccgagcatcaaagctggtaacgacattgccaactgtttacgtaagaatggcaaaaaggtgatccaactgtctcggaagacttttgatacggaataccagaaaaccaagcttaacgactgggatttcgtggtcacaactgacatttccgagatgggggcgaattttaaagcagatagagtaatagaccctaggcgctgcctgaagcccgtgatcctcaccgatggaccagagcgagttattttggccggccccatgcctgtgacagctgcctcagctgcacagagacggggtagggtcgggcgcaacccacagaaagaaaatgaccaatacatcttcaccggccagcccctgaacaatgatgaggaccatgcccactggactgaagctaagatgctcctggacaacatcaatacgcctgagggaattataccggcccttttcgaaccagagcgtgagaagagtgcagcgatcgatggcgaatatagactaaaaggggagagccggaagacctttgtggaactgatgaggcgcggagacttgcccgtttggttagcccacaaagtggcttccgagggtattaagtacacagatcgaaaatggtgcttcgacggccagagaaacaatcagatcctggaagagaacatggatgtcgagatttggactaaggaaggggagaaaaagaagctccggcctaggtggctggacgcccgcacctattctgatccccttgcactgaaagaatttaaggacttcgctgccggaagaaaatcgatcgcactcgatttggtgacagagataggcagggtaccaagccatctggcccaccggacccgtaatgctctagacaacctggtgatgctccatacttcagaacacggtgggcgcgcgtaccgacacgccgttgaggagcttcctgaaacaatggagacgctgttattgctgggcctcatgatcctgcttaccggaggcgcaatgctgtttctcatttccgggaagggaatcggtaaaactagtattggcttgatctgtgtcatagcttctagcgggatgctgtggatggccgaaattcccttacaatggatcgcctccgcaattgtgctagagttctttatgatggtgctgctcatcccagagcctgaaaagcagagaacaccgcaggataatcaacttgcttatgtcgttataggaatcctgaccttggccgcgattatcgctgccaacgagatgggcctgctcgaaaccacaaagagggacctgggtatgtcaaaagagcccggggtggtatctccaactagctaccttgatgtggacctccatcctgcaagtgcctggacgctgtatgctgtcgcaaccacagtgattactcccatgttgcggcacaccatcgaaaattccacagccaacgttagcctggcggctatagccaaccaggcagtggtcttaatgggcctagacaagggatggccaatttctaaaatggatctgggcgtacctctccttgccctggggtgctactcacaggtgaatcccttgaccctgactgctgccgttctcctgcttatcacgcattacgcaatcattggaccgggcttacaggctaaggccacacgcgaggcgcaaaaaagaaccgccgcaggtatcatgaagaacccaactgtggacgggataatgaccattgatctggaccctgtcatctatgattccaagttcgagaaacagctcggacaggtgatgttgctggtcctatgtgctgtgcagctgctccttatgaggacaagttgggccctgtgcgaagcattgactctggctaccggccccattacaacgctctgggagggtagcccaggcaagttttggaataccactatcgccgtttcgatggccaacatattccgggggtcttacctggcgggagctggcttagcattttccatcatgaaaagcgtggggacaggaaagcgaggcaccggttcacaaggggaaactcttggagagaaatggaagaagaaactgaatcagctcagtagaaaggaattcgacctatataaaaagtctggcattacagaggtagatcgcaccgaggccaaagaaggtctgaagaggggcgagatcacgcaccatgctgtgtcccgggggagcgccaaattgcagtggtttgtcgaacgtaacatggttattcccgagggaagagtgatcgacctgggctgtgggaggggaggctggtcatactattgcgcaggtctcaagaaggtcaccgaagtgcgcgggtacacaaaaggaggccctggccacgaggagccggtacccatgagtacttatgggtggaatattgtgaagcttatgagcggaaaagatgttttctacctgccacctgaaaagtgtgacaccttgctgtgcgatatcggtgagtcctctcccagccctacagtggaagagtcccggactatacgagtcctcaaaatggtggagccatggttaaagaacaatcagttctgtattaaggtcctgaacccctacatgcctaccgtgatcgaacaccttgagagactgcaaaggaaacatggcgggatgctagttcgcaatccactctcacggaactctacacacgaaatgtattggatcagtaatggaaccggcaacattgtagcctcggtgaatatggtcagcagactgttgctgaaccgttttactatgacgcataggcggcccacaatagagaaggacgtggatctcggtgctgggacccgccacgttaacgcggaaccggagactcctaatatggacgtgatcggagagcgaattaaaagaatcaaggaagagcacaactccacctggcattacgacgatgaaaatccatataaaacatgggcctaccacggctcttatgaggtcaaggcaacgggctcagctagctccatgattaacggggtggtaaagcttctgaccaaaccctgggacgtggttcctatggtcactcagatggccatgacagataccactccattcggacagcaaagggtgtttaaggaaaaagtggacacacggaccccccgcagtatgccgggtacaagaagggtcatgggcatcactgcagagtggttatggcgaaccctggggcggaataagaaacctcgtttgtgcacgagagaggaattcaccaagaaggttcgcacaaacgccgctatgggagccgtgtttactgaggaaaatcagtgggattctgcgaaagcagccgtagaggacgaagatttctggaagctcgtggacagggagcgggagctgcataaactaggcaagtgtggtagctgcgtctacaacatgatggggaaaagagaaaagaaacttggagagtttggcaaggctaagggctcacgcgccatatggtatatgtggctgggggcaaggtacctcgaattcgaggctctgggatttttgaatgaggatcactggttctcccgagaaaacagttacagcggtgtggagggcgaagggctgcataaactcggatatatccttcgggacatttctaagatccccggcggtgccatgtacgctgatgacaccgccgggtgggacacaagaattactgaggatgacctgcacaatgaagagaaaatcacccagcagatggatccagagcacaggcaattagcaaacgcgatatttaagctgacgtatcagaataaagttgtgaaggtccagcgccctacacccaccggaactgtgatggacattatctcccgtaaggatcagcggggctcaggccaagtagggacatacggattgaacaccttcactaatatggaagcccagctcatcagacagatggagggtgaaggcgttctgagcaaagctgacctagagaacccacatcttcccgaaaagaaaattacccagtggctggagacaaagggggtggagaggctcaaacgcatggccatatcgggagatgactgcgtcgtgaagcctatcgatgaccgatttgcaaacgctctggtggccttgaatgatatgggcaaggtccggaaagacattccacaatggcagccgtctaagggttggcacgattggcagcaggttcccttctgtagtcatcacttccacgaattaatcatgaaagacgggagaaagctggtggtaccttgcaggccacaagacgagctcattggacgcgcaagaatctcccagggcgccggctggagccttcgggaaacggcgtgtctggggaaagcttatgcccagatgtggtcactaatgtactttcataggcgtgatctgcgactcgcatccaacgccatatgctctgctgtgcccgtccactgggtgcctaccagccgcactacatggagtatccatgcccaccatcaatggatgaccactgaggacatgttgacagtttggaatagagtgtggattgaagataacccatggatggaggacaagacccccgtcacgacatgggagaatgtgccttatctgggaaagcgggaagatcagtggtgtggttcccttatcggcctgaccagcagggcaacttgggctcagaacattccgaccgccatccagcaagtacgctctctcattgggaatgaggaattcttagactacatgccatcaatgaaaagatttcggaaggaggaggaaagtgagggagcgatatggtga

SEQ ID NO: 15167 - RNA, 9873 nt, synthetic construct
  misc_feature 1..9873: note = derived and/or modified CDS sequence (opt3) from DENV-3__GU131871__SS-prME
  source 1..9873: mol_type = other RNA
accagcctgtgcctcgtgatgatccttcccgcagctctggcattccacttgacatccagagacggcgagcctagaatgattgtcgggaagaacgaacggggaaagtctttactgtttaagactgcatcaggtataaatatgtgtacgttaatcgcgatggatctcggcgagatgtgcgacgataccgttacatacaaatgtccacatattactgaagtggagccggaagacatcgattgctggtgtaacctgaccagcacatgggtaacctatgggacttgcaatcaggctggagagcgccgacgtgacaagagaagcgtggcccttgcaccccacgtcggcatgggtctggatacaaggacccagacgtggatgtccgccgagggggcttggcggcaagtggaaaaagttgagacttgggcattgcgccatcctggattcaccattctcgccctgtttctggctcactacatcggcacatctctcactcagaaggtggtcatattcatcttactgatgcttgtgaccccatcgatgacaatgagatgtgtaggcgttgggaacagggactttgtggaaggattgtcaggtgccacctgggtcgatgtggtgctggagcatggcgggtgcgtcacgactatggcgaagaataaacccacactagacattgagctccagaagaccgaagcaactcaactggccacacttcggaaactgtgtatcgagggaaagattaccaacatcacgaccgatagccgctgccctacacagggcgaagctgttttgccagaggaacaggaccagaattatgtgtgtaaacacacttacgtagatcgaggttgggggaacggatgcggcctcttcggcaaggggagtctggtgacctgcgccaagtttcaatgtttagagcccatagagggaaaagtcgtgcagtatgaaaatctgaagtacacagttattatcactgtgcacaccggtgaccagcatcaggtcggcaacgagacacaaggggtgaccgcagaaattactcctcaggcttccacgacagaggccatcctcccagaatatggaacccttggcctggagtgctctccgagaactggtttggacttcaatgagatgatcctactgaccatgaaaaacaaggcgtggatggtacacaggcagtggtttttcgatctccccctgccttggacaaccggggccactacagaaacgccaacctggaatcggaaagagcttctggttacttttaagaacgcacatgctaaaaagcaagaagtggtcgtgttgggcagccaggagggagccatgcacacagctctcaccggcgccacagaaattcaaaattccgggggaacttcaatattcgcaggtcacctgaagtgtcgtttaaaaatggacaagctggagctaaaaggcatgagttacgccatgtgcaccaacacgtttgtcctcaagaaagaggtgagcgaaacccagcatgggacaatcctgattaaggttgagtaccgcggagaagatgctccctgtaagatccctttctctactgaggacggccaaggtaaagcgcacaacgggagacttataaccgcaaatccagtggtaacaaagaaagaggaacccgtcaacattgaggccgaaccgcctttcggcgagtccaatatcgtgatcggaattggcgataacgctttgaagatcaattggtataaaaaggggtcaagcattggaaagatgtttgaagccactgcaaggggtgcccggcgaatggctatactgggcgacaccgcctgggatttcgggagtgttggaggcgtgctcaactctctgggtaaaatggtccatcagatctttgggtccgcatacacggcgcttttcagcggcgtgtcgtgggtaatgaagattggaatcggcatcctgttgacatggattgggctcaattctaaaaacacctccatgtcatttagttgcatagctatcggaattatcactctgtatttaggcgccgtggttcaggcagacatgggttgtgtcattaattggaaggggaaagagctgaagtgcggaagcggcatcttcgtgacaaacgaggtgcacacctggactgaacagtacaagtttcaagccgattcccccaaacgcctagctaccgccatagccggtgcttgggagaatggcgtctgtgggatcagatctacaacgaggatggaaaacctcctgtggaagcagattgccaatgagcttaactatatcttgtgggaaaataacattaaactgaccgttgtggtgggagacatcataggcgtactcgagcaggggaagcggactctgacaccacagcctatggagttaaaatacagctggaagacctggggaaaagcgaagattgtcacagccgaaactcaaaactcaagtttcatcattgatggccccaataccccagagtgcccctccgctagccgcgcatggaacgtgtgggaagttgaggactatggttttggggtgttcacgacaaatatctggctgaaacttagagaagtctacacccagttgtgtgaccataggctcatgtctgccgctgtgaaagatgagcgtgccgttcacgcagacatgggatactggatagagtcacagaagaacggcagttggaaactggaaaaggcgagcctaatcgaggtgaaaacttgcacctggcctaagtcccacacactgtggtctaatggtgtactcgaatcggatatgattatcccaaagagcctggccggcccgatttcccagcataaccaccggcccgggtatcatactcaaaccgctggaccttggcaccttggcaaattggagctggactttaattactgcgaggggacaacggtcgtgatcaccgaaaactgtggaactcgaggcccatcattaagaacaaccactgtgagtggtaagctcatacacgagtggtgctgtaggtcttgcacactgccccctcttcgctatatgggggaagatggatgttggtacggcatggagattcggccaatcagcgaaaaagaggagaatatggtcaagtccctggtttcagccggtagcggcaaagtggacaacttcaccatgggggtattgtgcctcgcaatcctgtttgaagaggtgatgagaggaaagttcggcaagaaacatatgattgctggggtcttctttacgttcgtgctactgctctctggacagatcacttggagggatatgacccacacactgattatgataggctccaatgccagtgaccgcatgggtatgggggttacctatcttgcattgatcgccacttttaagattcagcccttcctggctttaggatttttcctccgaaaactgacaagccgggaaaaccttctgctaggcgtgggcctcgcgatggccaccacactgcaattgccggaggatatcgaacagatggcaaatgggattgctctgggattaatggccctcaagctgatcactcagtttgagacctaccagctttggacggccctgatatctttgacatgttccaacaccatgttcactctcaccgtcgcttggcgtacagcaactctgatcctagccggtgtgtcactgcttcctgtttgccaaagtagctcgatgagaaaaaccgactggctcccaatggcggtggctgccatgggcgtcccacctctgcccttgtttattttctccctgaaggatacgttaaagaggcgctcttggccactcaatgagggggtaatggcagtgggactggttagcatccttgcctcaagtctgttgcggaacgacgtgcctatggctggccccctcgtcgccggtgggctgctaattgcctgttatgtgatcacaggaacctccgcggatctgactgtagaaaaagctgccgacataacatgggaggaagaggcagaacagaccggcgtgtctcataaccttatgattactgtcgacgatgacggcacaatgagaatcaaggatgacgagaccgagaatatcctcacggttctgttgaaaactgccttactgattgtgagcggggtgtttccatactccataccggctaccctcctggtctggcacacatggcagaagcagacccaaaggtcaggagtgctttgggatgttcctagtcccccagaaacacagaaagccgagctggaagagggtgtataccgaatcaagcagcagggcattttcgggaaaactcaagtgggagtcggcgtgcagaaggagggtgtttttcataccatgtggcacgtgacgcgcggggcagtcttgacatataacggaaagcggctagaacccaattgggctagtgtgaaaaaggacctgatctcttacggcggcgggtggagactctccgcccagtggcaaaaaggagaggaagtacaggtcattgcggtggagcctggtaagaaccccaagaatttccagactacccccggcacattccagaccactaccggggaaatcggagccatagcactggattttaagcctggcacaagcggttcgccgatcattaacagggaggggaaggttgtgggactttatggcaatggcgtcgtgacgaaaaacgggggatacgtttcaggtatcgctcaaactaatgccgagccagacggccccacccctgaattagaggaagagatgttcaagaaacgtaacctgacaattatggatctccacccagggtctggaaagacccgcaaatatttgcccgctatcatacgggaagcaattaagagaaggctgcgaactctcatcctggcccctacacgggtggtcgccgctgagatggaggaagcgcttaagggcctgccgatccgctaccagaccacggcaactaaaagtgagcatacaggtagagaaattgtggacttgatgtgccacgccacctttaccatgaggctactgtcccccgtacgggtgccaaattataacctcatcataatggatgaggctcatttcactgaccctgccagcattgcagcccgagggtacatctctacaagagttggaatgggcgaagctgcggccatttttatgaccgcaacacccccaggcactgctgatgccttccctcagagcaatgcacccatccaggacgaggagcgcgacataccagaaaggtcctggaactcagggaatgagtggattacggattttgccggaaagaccgtctggttcgtgccgagtatcaaagctggtaacgacatcgccaactgtttacgtaagaatggcaaaaaggtgattcaactgagccggaagacatttgatactgaataccagaaaaccaaacttaacgactgggatttcgtcgtaacaaccgacatctctgagatgggggcgaattttaaagcagatagagtgattgaccctaggcgctgcctgaagcccgttatactcactgatggaccagagcgagtgatcttggccggccccatgcctgtcacggctgcctccgctgcacagagacggggtagggtggggcgcaacccacagaaagaaaatgaccaatatattttcaccggccagcccctgaacaatgatgaggaccacgcccattggacagaagctaagatgctcctggacaacatcaatactcctgagggaatcattccggcccttttcgaaccagagcgtgagaagtcagcagcgatagatggcgaatacagactaaaaggggagagtcggaagacctttgttgaactgatgaggcgcggagacttgcccgtgtggttagcccacaaagtcgctagcgagggtatcaagtatacagatcgaaaatggtgcttcgacggccagagaaacaatcagattctggaagagaacatggatgtggagatctggaccaaggaaggggagaaaaagaagctccggcctaggtggctggacgcccgcacttactccgatccccttgcactgaaagaatttaaggacttcgctgccggaagaaaatctattgcactcgatttggtaacagagatcggcagggtgccatcgcacctggcccatcggacgcgtaatgctctagacaacctggttatgctccacaccagcgaacatggtgggcgcgcgtatcgacacgccgtcgaggagcttcctgaaactatggagacactgttattgctgggcctcatgatactgcttaccggaggcgcaatgctgtttctcatctcagggaagggaattggtaaaacctccatcggcttgatttgtgtgatcgctagttctgggatgctgtggatggccgaaatacccttacaatggattgccagcgcaatcgtgctagagttctttatgatggtcctgctcattccagagcctgaaaagcagagaacaccgcaggataatcaacttgcttacgttgtgatcggaatactgactttggccgcgatcattgctgccaacgagatgggcctgctcgaaacgaccaagagggacctgggtatgtccaaagagcccggggtagtgtcaccaacatcttatcttgatgtcgacctccaccctgcaagcgcctggactctgtacgctgtggcaaccacagttatcacccccatgttgcggcatactattgaaaatagtacggccaacgtgtccctggcggctatcgccaaccaggcagtcgtattaatgggcctagacaagggatggccaataagcaaaatggatctgggcgtgcctctccttgccctggggtgctactctcaggttaatcccttgacactgaccgctgccgtgctcctgcttattactcactatgcaatcatcggaccgggcttacaggctaaggccacccgcgaggcgcagaagagaacagccgcaggtattatgaagaacccaactgtcgacgggatcatgaccatagatctggaccctgtgatttacgattcaaagttcgagaaacagctcggacaggtcatgttgctggtgctatgtgctgttcagctgctccttatgaggacatcctgggccctgtgcgaagcattgacgctggctaccggccccatcactacactctgggagggtagtccaggcaagttttggaataccactattgccgtgagcatggccaacatcttccgggggtcgtatctggcgggagctggcttagcattttctataatgaaatccgtagggacaggaaagcgaggcaccggtagccaaggggaaacgcttggagagaaatggaagagaaagctgaatcagctctcacgcaaagagttcgacctatacaagaaaagtggcatcaccgaggtggataggacagaggccaaggaaggtctgaaacggggcgagattactcatcacgctgtctctcgtgggtccgccaagttgcagtggtttgttgaaagaaacatggtgatccccgagggaagggtcattgacctgggctgtgggcgcggaggctggagctattactgcgcaggtctcaaaaaggtgaccgaagtacgggggtatacaaagggaggccctggccatgaggagccggtgcccatgtcaacttacgggtggaatatcgttaaacttatgagtggaaaggatgtgttctacctgccacctgaaaaatgtgacaccttgctgtgcgatattggtgagagctccccctctcctacagtcgaagagagccgaaccatcagagtgctcaagatggtcgagccatggctaaagaacaatcagttctgtataaaggtgctgaacccctatatgcctactgttattgaacaccttgagaggctgcaacgcaagcacggcgggatgctagtacggaatccactctccagaaactcaacgcatgaaatgtactggatctctaatggaacaggcaacatcgtggccagtgtcaatatggtgtcgcgtctgttgctgaacaggtttaccatgactcaccggcgccccaccattgagaaagacgttgatctcggtgctgggacacgacatgtgaacgcggaaccggagacgcctaatatggacgtcataggagagagaatcaagaggattaaagaagaacacaacagcacctggcactatgacgatgaaaatccatacaagacttgggcctatcatggctcctacgaggtgaaagcaacaggctctgcttcaagcatgatcaacggggtagtgaaacttctgaccaagccctgggacgttgtccctatggtgactcagatggccatgacagataccacaccattcggacagcaacgggtgtttaaagaaaaggtcgacactcgcacccccagatccatgccgggtacgaggcgagttatggagattaccgcagagtggttatggcggacactgggccgtaataaaaagcctagattgtgcactcgcgaagagttcaccaaaaaggtgaggacaaacgccgctatgggggccgtatttactgaagagaatcagtgggatagtgcgaaggcagccgtggaagacgaggatttctggaaactcgtcgaccgggagagagaactgcacaagctaggaaaatgtggctcttgcgtgtataacatgatgggtaagcgcgagaagaaacttggggaatttggaaaagctaaaggcagcagggccatctggtacatgtggctgggcgcacgatacctcgagttcgaggctctggggtttttgaatgaagatcattggttctcacgggagaactcctatagtggagttgaaggtgagggcctgcacaagctcgggtacatacttagagacatcagcaaaattcccggaggcgccatgtatgctgatgacaccgccggttgggacacgaggatcacagaagatgacctgcataatgaggagaagattacccagcagatggatccagaacaccgccaattagcaaacgcgatctttaaactgacttaccagaataaggtggtcaaagtgcagcgtcctacacccaccgggactgtaatggacataatttctcggaaggatcagagaggatccggccaagttggcacctatgggttgaacacattcacgaatatggaggcccagctcatcaggcagatggaaggagagggtgtgctgtcaaaggctgacctagaaaacccacaccttcccgagaaaaagatcacccagtggctggagactaaaggcgtcgaacgcctcaagcgaatggccattagcggggatgactgcgtggtgaaacctatagatgaccggtttgcaaacgctctgttggccttaaatgatatgggaaaggtcagaaaggacatcccacaatggcagccgtcgaaaggctggcatgattggcagcaggttcccttctgttctcaccatttccacgagctgattatgaaggacggtaggaaactcgtggtaccttgccgcccacaagacgaacttatcgggagagcacggattagtcagggagccggctggtccctgagggagacagcgtgtctaggcaaggcttacgcccagatgtggagcctgatgtattttcaccgtcgagatctccgcttggcatcaaacgccatctgctccgctgtgcccgtccattgggtgcctacctctagaactacatggagcatacacgcccatcaccaatggatgaccacggaagacatgctgacagtttggaatcgggtgtggatcgaggataacccatggatggaggacaaaacccccgtcactacctgggaaaatgtgccttaccttgggaagagggaggatcagtggtgtggaagtctgattggtctcacatcccgcgcaacttgggctcagaacatcccgaccgccattcagcaagtaaggagcttaatcggcaatgaagagttcctggactacatgccatctatgaagcggtttaggaaagaggaagagtcagaaggggcgatttggtga

SEQ ID NO: 15168 - RNA, 9873 nt, synthetic construct
  misc_feature 1..9873: note = derived and/or modified CDS sequence (opt3) from DENV-3__GU131872__SS-prME
  source 1..9873: mol_type = other RNA
accagcctgtgcctcgtgatgatccttcccgccgctctggcattccacttgacatccagagacggcgagcctaggatgattgtcgggaagaacgaacggggaaaatctttactgtttaagactgcctcaggtataaatatgtgtacgctaatcgcgatggatctcggcgagatgtgcgacgataccgttacatacaaatgtccacatattactgaagtggagccggaagacatcgattgctggtgtaacctgaccagtacatgggtaacctatgggacttgcaatcaggctggagagcgccgacgtgacaagagaagcgtggcccttgcaccccacgtcggcatgggtctggatacaaggacccaaacgtggatgtccgccgagggggcttggcggcaggtggaaaaagttgagacttgggcattgcgccatcctggattcaccattctcgccctgtttctggctcactacatcggcacatctctcactcagaaggtggtcatattcatcttactgatgcttgtgaccccatcgatgacaatgagatgtgtaggcgttgggaacagggactttgtggaaggattgtcaggtgccacctgggtcgatgtggtgctggagcatggcgggtgcgtcacgactatggcgaagaataaacccacactagacattgagctccagaagaccgaagcaactcaactggccacacttcggaaactgtgtatcgagggaaagattaccaacatcacgaccgatagccgctgccctacacagggcgaagctgttttgccagaggaacaggaccagaattatgtgtgtaaacacacttacgtagatcgaggttgggggaacggatgcggcctcttcggcaaggggagtctggtgacctgcgccaagtttcaatgtttagagcccatagagggaaaagtcgtgcagtatgaaaatctgaagtacacagttattatcactgtgcacaccggtgaccagcatcaggtcggcaacgagacacaaggggtgaccgcagaaattactcctcaggcttccacgacagaggccatcctcccagaatatggaacccttggcctggagtgctctccgagaactggtttggacttcaatgagatgatcctactgaccatgaaaaacaaggcgtggatggtacacaggcagtggtttttcgatctccccctgccttggacaagcggggccaccactgaaacaccaacgtggaatcggaaagagcttctggttacctttaagaacgcacatgctaaaaagcaagaagtggtcgtgttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtcctcaagaaagaggtgtctgaaacgcagcatgggaccatcctgattaaggttgagtaccgcggagaagatgctccctgtaagatccctttctccacagaggacggccaaggtaaagcgcacaacgggagacttataactgcaaatccagtggtaaccaagaaagaggaacccgtcaacattgaggccgaaccgcctttcggcgagtcaaatatcgtgatcggaattggcgataacgctttgaagatcaattggtataaaaaggggagcagtattggaaagatgtttgaagccacagcaaggggtgcccggcgaatggctatactgggcgacactgcctgggatttcgggtctgttggaggcgtgctcaactccctgggtaaaatggtccatcagatctttgggagcgcatacaccgcgcttttctcgggcgtgtcttgggtaatgaagattggaatcggcatcctgttgacgtggattgggctcaattccaaaaacacatcaatgagttttagctgcatagctatcggaattatcaccctgtatttaggcgccgtggttcaggcagacatgggttgtgtcattaattggaaggggaaagagctgaagtgcggatccggcatcttcgtgactaacgaggtgcacacatggaccgaacagtacaagtttcaagccgattctcccaaacgcctagctactgccatagcaggtgcttgggagaatggcgtctgtgggatcagaagcaccacaaggatggaaaacctcctgtggaagcagattgccaatgagcttaactatatcttgtgggaaaataacattaaactgacggttgtggtgggagacatcataggcgtactcgagcaggggaagcggaccctgactccacagcctatggagttaaaatactcatggaagacatggggaaaagcgaagatggtcaccgccgaaacacaaaacagttccttcattatcgatggccccaatactccagagtgccccagcgcttctcgcgcatggaacgtgtgggaagttgaggactatggttttggggtgttcaccacgaatatttggctgaagcttagagaagtctacacacagttgtgtgaccataggctcatgtcagccgctgtgaaagatgagcgtgccgttcacgcagacatgggatactggatcgagagtcagaagaacggcagctggaaactggaaaaggcgtccctaatagaggtgaaaacctgcacttggcctaagtctcacaccctgtggtcgaatggtgtactcgaaagcgatatgatcattccaaagtccctggccggcccgatctcacagcataaccaccggcccgggtatcatacacaaactgctggaccttggcaccttggcaaattggagctggactttaattactgcgaggggaccacagtcgtgattacggaaaactgtggaacccgaggcccaagtttaagaactacaaccgtgtctggtaagctcatccacgagtggtgctgtaggagctgcactctgccccctcttcgctatatgggggaagatggatgttggtacggcatggagatacggccaatttccgaaaaagaggagaatatggtcaagtcactggttagcgccggttctggcaaagtggacaacttcacaatgggggtattgtgcctcgcaatcctgtttgaagaggtgatgagaggaaagttcggcaagaaacatatgatcgctggggtcttctttaccttcgtgctactgctctccggacagattacgtggagggatatgactcacaccctgatcatgattggcagtaatgccagcgaccgcatgggtatgggggttacatatcttgcattgatagccacctttaagatccagcccttcctggctttaggatttttcctccgaaaactgacttctcgggaaaaccttctgctaggcgtgggcctcgcgatggccacaaccctgcaattgccggaggatattgaacagatggcaaatgggatcgctctgggattaatggccctcaagctgattacacagtttgagacttaccagctttggaccgccctgatctccttgacgtgttcaaacacaatgttcaccctcactgtcgcttggcgtaccgcaacactgatactagccggtgtgagtctgcttcctgtttgccaaagctcgtccatgagaaaaactgactggctcccaatggcggtggctgccatgggcgtcccccctctgcccttgtttatcttctctctgaaggataccttaaagaggcgcagctggccactcaatgagggggtaatggcagtgggactggtttcaattcttgccagttccctgttgcggaacgacgtgcctatggctggccccctcgtcgcaggtgggctgctaatcgcctgttatgtgattacgggaacatctgcggatctgaccgtagaaaaagctgccgacatcacttgggaggaagaggcagaacagacaggcgtgagccataaccttatgataaccgtcgacgatgacggcactatgagaattaaggatgacgagacagagaatatcctcaccgttctgttgaaaacggccttactgatcgtgtccggggtgtttccatactcaattccggctactctcctggtctggcacacctggcagaagcagacacaaaggagcggagtgctttgggatgttcctagtcccccagaaacccagaaagccgagctggaagagggtgtataccgaataaagcagcagggcatcttcgggaaaacacaagtgggagtcggcgtgcagaaggagggtgtttttcatactatgtggcacgtgacccgcggggcagtcttgacgtataacggaaagcggctagaacccaattgggcttctgtgaaaaaggacctgatttcctacggcggcgggtggagactcagcgcccagtggcaaaaaggagaggaagtacaggtcatcgcggtggagcctggtaagaacccaaaaaatttccagacaactcccggcaccttccagacaaccactggggaaattggagccatcgcactggattttaagcctggcacctcgggttcaccgataatcaacagggaggggaaggttgtgggactttatggcaatggcgtcgtgacaaaaaacgggggatacgtttctggtattgctcaaacgaatgccgagccagacggccccactcctgaattagaggaagagatgttcaagaaacgtaacctgaccatcatggatctccacccagggagtggaaagacacgcaaatatttgcccgctattatccgggaagcaataaagagaaggctgcgaaccctcattctggcccctactcgggtggtcgccgctgagatggaggaagcgcttaagggcctgccgatccgctaccagacaaccgcaacgaaatccgagcatactggtagagaaatcgtggacttgatgtgccacgccacatttaccatgaggctactgagccccgtacgggtgccaaattataacctcattatcatggatgaggctcatttcaccgaccctgcctctatagcagcccgagggtacattagcactagagttggaatgggcgaagctgcggccatctttatgacagcaacccccccaggcacagctgatgccttccctcagtccaatgcacccattcaggacgaggagcgcgacatcccagaaaggtcatggaacagtgggaatgagtggataactgattttgccggaaagacggtctggttcgtgccgagcattaaagctggtaacgacatcgccaactgtttacgtaagaatggcaaaaaggtgatccaactgtctcggaagacctttgatacagaataccagaaaactaagcttaacgactgggatttcgtcgtaaccacagacatttccgagatgggggcgaattttaaagcagatagagtgatcgaccctaggcgctgcctgaagcccgttattctcaccgatggaccagagcgagtgatattggccggccccatgcctgtcactgctgcctcagctgcacagagacggggtagggtggggcgcaacccacagaaagaaaatgaccaatatatcttcacgggccagcccctgaacaatgatgaggaccacgcccattggaccgaagctaagatgctcctggacaacattaatacacctgagggaatcatcccggcccttttcgaaccagagcgtgagaagagtgcagcgattgatggcgaatacagactaaaaggggagagccggaagacttttgttgaactgatgaggcgcggagacttgcccgtgtggttagcccacaaagtcgcttccgagggtataaagtataccgatcgaaaatggtgcttcgacggccagagaaacaatcagatcctggaagagaacatggatgtggagatttggacaaaggaaggggagaaaaagaagctccggcctaggtggctggacgcccgcacctactctgatccccttgcactgaaagaatttaaggacttcgctgccggaagaaaatcgatcgcactcgatttggtaactgagattggcagggtgccaagccacctggcccatcggacacgtaatgctctagacaacctggttatgctccacacgtcagaacatggtgggcgcgcgtatcgacacgccgtcgaggagcttcctgaaaccatggagactctgttattgctgggcctcatgatcctgcttacaggaggcgcaatgctgtttctcatatccgggaagggaatcggtaaaaccagtattggcttgatctgtgtgattgcttctagcgggatgctgtggatggccgaaatccccttacaatggatagcctccgcaattgtgctagagttctttatgatggtcctgctcatcccagagcctgaaaagcagagaaccccgcaggataatcaacttgcttacgttgtgattggaatcctgacattggccgcgataatcgctgccaacgagatgggcctgctcgaaactacgaagagggacctgggtatgtcaaaagagcccggggtagtgtctccaaccagctatcttgatgtcgacctccaccctgcaagtgcctggacactgtacgctgtggcaactaccgttattacacccatgttgcggcataccatcgaaaattccactgccaacgtgagcctggcggctattgccaaccaggcagtcgtattaatgggcctagacaagggatggccaatctctaaaatggatctgggcgtgcctctccttgccctggggtgctactcacaggttaatcccttgacgctgacagctgccgtgctcctgcttataacccactatgcaattatcggaccgggcttacaggctaaggccactcgcgaggcgcaaaaaagaaccgccgcaggtatcatgaagaacccaacagtcgacgggattatgactatcgatctggaccctgtgatatacgattccaagttcgagaaacagctcggacaggtcatgttgctggtgctatgtgctgttcagctgctccttatgaggaccagttgggccctgtgcgaagcattgacactggctacgggccccattaccactctctgggagggtagcccaggcaagttttggaatacaaccatcgccgtgtcgatggccaacattttccgggggtcttatctggcgggagctggcttagcattttccatcatgaaaagcgtagggactggaaagcgaggcacaggttcacaaggggaaacccttggagagaaatggaagaagaaactgaatcagctcagtagaaaggaattcgacctatacaaaaagtctggcataacggaggtggatcgcaccgaggccaaagaaggtctgaagaggggcgagatcacacatcacgctgtctcccgggggagcgccaaattgcagtggtttgttgaacgtaacatggtgattcccgagggaagagtcatcgacctgggctgtgggaggggaggctggtcatattactgcgcaggtctcaagaaggtgactgaagtacgcgggtataccaaaggaggccctggccatgaggagccggtgcccatgagtacatacgggtggaatattgttaagcttatgagcggaaaagatgtgttctacctgccacctgaaaagtgtgacactttgctgtgcgatatcggtgagtcctctcccagccctaccgtcgaagagtcccggacaattcgagtgctcaaaatggtcgagccatggttaaagaacaatcagttctgtatcaaggtgctgaacccctatatgcctaccgttatagaacaccttgagagactgcaaaggaaacacggcgggatgctagtacgcaatccactctcacggaactctactcatgaaatgtactggattagtaatggaacgggcaacatcgtggcctcggtcaatatggtgagcagactgttgctgaaccgttttacaatgacccacaggcggcccactatcgagaaggacgttgatctcggtgctgggacccgccatgtgaacgcggaaccggagacacctaatatggacgtcattggagagcgaataaaaagaatcaaggaagagcacaactccacgtggcactatgacgatgaaaatccatacaaaacctgggcctatcatggctcttacgaggtgaaggcaactggctcagctagctccatgattaacggggtagtgaagcttctgacaaaaccctgggacgttgtccctatggtgacccagatggccatgactgatacaaccccattcggacagcaaagggtgtttaaggaaaaagtcgacacacggactccccgcagtatgccgggtaccagaagggttatggagatcacggcagagtggttatggcgaaccctgggccggaataagaaacctcgtttgtgcacaagagaagagttcactaagaaggtgcgcaccaacgccgctatgggggccgtatttacagaagagaatcagtgggattctgcgaaagcagccgtggaagacgaggatttctggaagctcgtcgacagggagcgggaactgcacaaactaggaaagtgtggcagctgcgtgtataacatgatgggtaaaagagagaagaaacttggggaatttggaaaggctaagggctcacgcgccatttggtacatgtggctgggcgcaaggtacctcgagttcgaggctctggggtttttgaatgaagatcattggttctcccgagagaacagttatagcggagttgaaggtgagggcctgcacaaactcgggtacatccttcgggacatatctaagatccccggaggcgccatgtatgctgatgacactgccggttgggacaccagaattacggaagatgacctgcataatgaggagaaaatcacacagcagatggatccagaacacaggcaattagcaaacgcgatttttaagctgacctaccagaataaagtggtcaaggtgcagcgccctactcccacagggaccgtaatggacatcatatcccgtaaggatcagcggggatcaggccaagttggcacttatgggttgaacaccttcacaaatatggaggcccagctcattagacagatggaaggagagggtgtgctgagcaaagctgacctagaaaacccacaccttcccgagaagaaaatcacgcagtggctggagaccaagggcgtcgaaaggctcaaacgcatggccatctcgggggatgactgcgtggtgaagcctattgatgaccgatttgcaaacgctctgttggccttaaatgatatgggaaaggtccggaaagacataccacaatggcagccgtctaagggctggcatgattggcagcaggttcccttctgtagtcaccatttccacgagctgatcatgaaagacggtagaaagctcgtggtaccttgcaggccacaagacgaacttattgggcgcgcaagaatctcccagggagccggctggagcctgcgggagactgcgtgtctaggcaaagcttacgcccagatgtggtcactgatgtattttcacaggcgtgatctccgattggcatccaacgccatttgctctgctgtgcccgtccattgggtgcctacaagccgcaccacttggagtatccacgcccatcaccaatggatgacaaccgaagacatgctgacggtttggaatagagtgtggatagaggataacccatggatggaggacaagacacccgtcaccacttgggaaaatgtgccttaccttgggaagcgggaggatcagtggtgtggatccctgatcggtctcaccagcagggcaacatgggctcagaacattccgactgccatccagcaagtacgctctttaattggcaatgaagagttcctggactacatgccatcaatgaaaagatttcggaaggaggaagagagtgaaggggcgatctggtga

SEQ ID NO: 15169 - RNA, 9873 nt, synthetic construct
  misc_feature 1..9873: note = derived and/or modified CDS sequence (opt3) from DENV-3__GU131873__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagctgatagagggaaaagtggtccagtatgaaaatctcaagtacacagtggttattactgtgcacaccggtgaccagcatcaggtcggcaacgagacacaagggatcaccgcagaaattactccccaggcttccacgacagaggccatccttcctgaatatggaaccctgggcttggagtgctctccaagaactggtctagacttcaatgagatgatcctgctcaccatgaaaaacaaggcgtggatggtgcacaggcagtggtttttcgatctgccgcttccctggacaagcggggccaccactgaaacacctacgtggaatcggaaagagctgttggtaacctttaagaacgcacatgctaaaaagcaagaagttgtggtcctcggctcccaggagggagccatgcacactgctctgacaggcgccaccgaaattcagaattcagggggaacaagtatattcgcaggtcacttaaagtgtcgtctgaaaatggacaagctagagctcaaaggcatgagctacgccatgtgcactaacacctttgtgctgaagaaagaggtctctgaaacgcagcatgggaccatccttattaaggtggagtacaagggagaagatgctccatgtaaaatccccttctccacagaggacggccaaggtaaggcgcacaacgggcgcttgataactgcaaatcctgttgtgaccaaaaaggaggaaccagtaaacattgaggccgaacccccgttcggcgagtcaaatatcgtcatcggaattggcgataacgctctgaaaatcaattggtataagaaggggagcagtattggaaaaatgtttgaagccacagcaagaggtgccaggcggatggctatactcggcgacactgcctgggatttcgggtctgtgggaggcgttctgaactcccttggtaagatggtgcatcagatctttgggagcgcatacaccgcgctgttctcgggcgtctcttgggtgatgaaaattggaatcggcgtattgctcacgtggatcgggctgaattccaagaacacatcaatgagttttagctgcattgctataggaatcattaccttatatctgggcgccgtggttcaggcagacatgggttgtgtcatcaattggaaagggaaggagctaaagtgcggatccggcattttcgtgactaacgaggtgcacacatggaccgaacagtacaaatttcaagccgattctcctaagcgactcgctactgccatcgcaggtgcttgggagaatggcgtctgtgggatacgcagcaccacaagaatggaaaacctgctttggaaacagatcgccaatgagttgaactatattctgtgggaaaataacatcaagctcacggttgtggtgggagacattatcggcgtactggagcaggggaaaaggaccttaactccccagccaatggagctgaagtactcatggaaaacatggggaaaggcgaagatagtcaccgccgaaacacaaaacagttccttcattatcgatggccctaatactcccgagtgcccaagcgcttctcgggcatggaacgtgtgggaagttgaggactatggttttggggtgttcaccacgaatatttggcttaaattgcgcgaagtctacacacagctctgtgaccatagactgatgtcagccgctgtgaaggatgagagggccgttcacgcagacatgggatactggatcgagagtcagaaaaacggcagctggaagctagaaaaagcgtccctgatagaggtgaagacctgcacttggcccaagtctcacaccctctggtcgaatggtgtactggaaagcgatatgatcattcctaaatcccttgccggcccaatctcacagcataaccaccgtccggggtatcatacacaaactgctggaccctggcacttgggcaagctggagttagactttaattactgcgaggggaccacagtcgtgattacggaaaactgtggaacccggggccctagtctccgaactacaaccgtgtctggtaaactgatccacgagtggtgctgtagaagctgcactcttccacccctgaggtatatgggggaagatggatgttggtacggcatggagatacgccctatttccgaaaaggaggagaatatggtcaaatcattggttagcgccggttctggcaaggtggacaacttcacaatgggggtactctgcctggcaatcctatttgaagaggtgatgcggggaaagttcggcaaaaagcatatgatcgctggggtcttctttaccttcgtgctgctcctgtccggacagattacgtggagagatatggcccacactcttatcatgattggcagtaatgcaagcgacaggatgggtatgggggttacctatttggccctgatagctacatttaaaatccagccattcttagcgctcggatttttcctgcgcaagcttacctctcgagaaaacctgctactcggcgtgggcctggccatggcaactacattgcaactgcccgaggatattgaacagatggctaatgggatcgccttaggactcatggccctgaaacttattacccagtttgagacataccagctgtggactgctttgatctccctcacctgttcaaacacgatgttcacactgaccgtcgcatggcggactgccaccctaatactggcgggtgtgagtcttctcccggtttgccaaagctcgtccatgcgtaagacagactggctgcctatggctgtggccgcaatgggcgtcccacccttgcctctgtttatcttctctttaaaggatactctcaaaagaaggagctggcccctgaatgagggggtaatggccgtgggacttgtttcaattctggctagttccttgctccgcaacgacgtgccaatggcaggccctctggtcgccggtgggctactgatcgcgtgttatgtgattaccggaacgtctgctgatcttacagtagaaaaggccgcagacatcacctgggaggaagaggccgaacagactggcgtgagccataacctcatgataacagtcgacgatgacggcaccatgcggattaaagatgacgagactgagaatatcctgacagttttgttaaagaccgctctgctcatcgtgtccggggtgtttccctactcaattccagccacgctgcttgtctggcacacttggcagaaacagacccaaagaagcggagtgctgtgggatgttccgagtcctcccgaaacacagaaggcagagttggaagagggtgtatacaggataaaacagcagggcatcttcgggaagacccaagtgggagtcggcgtgcagaaggagggtgtttttcatacaatgtggcacgtgactcgaggggctgtcctaacctataacggaaaacgcctggaaccaaattgggcctctgtgaagaaagacctcatttcctacggcggcgggtggcggctgagcgcgcagtggcaaaagggagaggaagtacaggtcatcgccgtggagcccggtaaaaaccctaagaatttccagacgatgccaggcacattccagactaccacaggggaaattggagcaatcgctcttgattttaagcccggcacctcgggttcacctataatcaacagagaggggaaagttgtgggattatatggcaatggcgtcgtgactaagaacgggggatacgtttctggtattgcccaaaccaatgctgagccggacggcccaacacccgaactggaggaagagatgttcaaaaagaggaacctcacgatcatggatttgcaccctgggagtggaaaaactcgtaagtatctgccagcaattgtgcgcgaagccatcaagcggagactcaggaccctgatacttgcccccacacgagtcgtggctgcggagatggaggaagcactgaaaggcttgcctattcggtaccagaccactgccacaaagtccgagcataccggtcgcgaaatcgtagacctaatgtgccacgctacgtttactatgagactgctcagcccggtgagggttcccaattataacttaatcattatggatgaggcccatttcacagacccagcatctatcgccgctcgggggtacataagcacccgagtcggaatgggcgaagcggccgcaatttttatgaccgctactcctcccggcacagccgatgcattcccacagtccaatgcccctatccaggacgaggagagagacattcccgaacgctcatggaacagtgggaatgagtggatcaccgattttgctggaaaaacagtgtggttcgtgccaagcataaaggccggtaacgacattgcgaactgtctgaggaaaaatggcaagaaggtcatccaactttctcgtaaaacttttgatacggaataccagaagaccaaactgaacgactgggatttcgtagtgacaactgacatctccgagatgggggcaaattttaaggccgatcgggttattgacccgagaaggtgcctcaaacctgtgatcttgaccgatggacccgagcgcgtcattctggctggcccaatgcccgtgacagccgcttcagcagcccagcgaagaggtcgggttgggaggaaccctcagaaggaaaatgaccaatatatattcaccggccagccactcaacaatgatgaggaccacgctcattggactgaagccaagatgctgcttgacaacgtgaatacgcccgagggaatcattcctgcactattcgaaccggagcgcgagaaaagtgcggccatcgatggcgaataccgtctgaagggggagagcagaaaaacctttgtcgaattgatgcggaggggagacttaccagtgtggctggctcacaaggtagcctccgagggtatcaaatatacagatcgcaagtggtgcttcgacggccagcgaaacaatcagattctcgaagagaacatggatgtggagatatggactaaagaaggggagaagaagaaactgagaccccggtggcttgacgcaaggacctactctgatcctctggctctcaaggaatttaaagacttcgccgcaggacgcaagtcgatcgccttggatctggttacagagattggcagagtccccagccacctagctcataggacccggaatgcgctggacaacctcgtgatgcttcacacttcagaacatggtgggcgtgcctatcgccacgcagtggaggagctgccagaaacaatggagacgttattgctgctcggcctgatgatccttctgaccggaggcgctatgctctttattatctccgggaaaggaataggtaagactagtatcggcttgatttgtgtcatcgcctctagcgggatgctgtggatggccgaaattcctttacaatggatcgcatccgctatagttctagagttctttatgatggtgctgctcattcccgagccagaaaagcagcgaacacctcaggataatcaacttgcctacgtagtgatcggaattctgaccttggcggctatcatagccgcaaacgagatgggcctgctcgaaaccacaaaaagagacctgggtatgtcaaaggagccgggggtcgtgtctcccactagctatcttgatgttgacctccacccagccagtgcttggacgctgtacgcagtggccaccacagtcatcactcctatgttgaggcataccattgaaaattccacagcgaacgtaagcctggctgccatcgcaaaccaggccgtggttttaatgggcctagacaaaggatggcccatttctaagatggatctgggcgtgccactccttgctctggggtgctactcacaggtcaatcctttgaccctgactgccgcagtgctcctgcttatcacgcactatgctataattggacccggcttacaggccaaagcgacacgggaggcccaaaagcgcaccgcagctggtatcatgaagaacccgactgtcgacgggatcatgaccattgatctggacccagtgatctacgattccaaattcgagaagcagctcggacaggttatgttgctggtgctatgtgccgtacagctgctccttatgagaacaagttgggcactgtgcgaagctttgactctggccaccggccctataacaacgctctgggagggtagccccggcaaattttggaataccactattgccgtgtcgatggcgaacatcttcagggggtcttatctggctggagcaggcttagccttttccattatgaagagcgtcgggacaggaaaacggggcaccggttcacaaggggaaactcttggagagaagtggaagaaaaagctgaatcagctcagtcgaaaagaattcgacctatacaagaaatctggcatcacagaggttgatagaaccgaggctaaggaaggtctgaaacgcggcgagataacgcatcacgccgtgtccagggggagcgcaaagttgcagtggtttgtcgaacggaacatggtgatcccagagggacgtgtaattgacctgggctgtgggagaggaggctggtcatattactgcgccggtctcaagaaagtgaccgaagttagggggtatacaaagggaggccccggccatgaggagcctgtgccgatgagtacttacgggtggaatatcgtcaaacttatgagcggaaaggatgtgttctacctgcccccagaaaaatgtgacaccttgctgtgcgatattggtgagtcctctcctagccccacagtcgaagagtcccgcactatccgggtgctcaagatggttgagccttggttaaagaacaatcagttctgtattaaagtactgaacccatatatgcccaccgtgatcgaacaccttgagcgactgcaaagaaagcacggcgggatgctagtcaggaatcctctctcacgcaactctacacatgaaatgtactggataagtaatggaaccggcaacattgtggcttcggttaatatggtgagccggctgttgctgaacagatttactatgacgcaccgtaggccaacaatcgagaaagacgtcgatctcggtgcggggacccggcatgtgaacgccgaacccgagactccgaatatggacgtaatcggagagcgcattaagcgaataaaagaagagcacaactccacctggcactatgacgatgaaaatccttacaagacatgggcatatcatggctcttacgaggtgaaggctacgggctcagccagctccatgatcaacggggttgtcaaacttctgaccaagccatgggacgtggtgcccatggtcactcagatggcaatgacagataccactcctttcggacagcaaagagtttttaaagaaaaggtggacacaaggaccccacggagtatgcccggtacacgcagagtaatgggcattactgccgagtggttatggaggaccctggggcgaaataaaaagccgcggttgtgcacgcgtgaggaattcaccaagaaagtgagaacaaacgctgccatgggagcggtctttactgaggaaaatcagtgggattctgcaaaggccgctgtggaggacgaagatttctggaaactcgttgaccgcgagagggagctgcacaagctaggcaaatgtggtagctgcgtgtataacatgatggggaagcgggaaaaaaagcttggagagtttggcaaggccaaaggctcaagagcaatctggtacatgtggctgggggctcgctacctcgaattcgaggccctgggatttttgaatgaggatcattggttctccagggaaaacagttatagcggtgtcgagggcgaagggctgcacaagctcggatacattcttcgagacatctctaaaatacctggcggtgctatgtatgccgatgacaccgcagggtgggacacacggatcactgaggatgacctgcataatgaagagaagattacccagcagatggatcccgagcacagacaattagcgaacgccatctttaaactgacgtaccagaataaggtggtaaaggttcagaggccaacacctaccggaactgtgatggacattatctcccgcaaagatcagcgtggctcaggccaagtcgggacatatggattgaacaccttcactaatatggaagctcagctcatacggcagatggagggtgaaggcgtgctgagcaaggccgacctagagaacccccaccttccagaaaaaaagattacccagtggctggagacaaaaggggtggagagactcaagaggatggcaatctcgggagatgactgcgtcgttaagcccatcgatgaccgctttgctaacgccctgttggcattaaatgatatgggcaaagtgcgaaaggacattcctcaatggcagccatctaaaggttggcatgattggcagcaggtaccgttctgtagtcaccatttccacgaactgataatgaaggacgggcggaaactcgtggtcccctgcagacctcaagacgagcttatcggaagggcccgcatttcccagggcgcgggctggagcctgagagaaacggcttgtctagggaaggcctacgcacagatgtggtcactgatgtattttcaccggagggatctccgtttggcctccaacgctatctgctctgccgtgccagttcattgggtgcccaccagccgaactacatggagtattcacgcacatcaccaatggatgaccactgaggacatgctgacagtctggaatcgcgtgtggatcgaagataacccttggatggaggacaagaccccagtaacgacatgggagaatgttccctaccttggaaaaagagaagatcagtggtgtggttccctgataggcctcaccagccgggctacttgggcccagaacatccctaccgcgattcagcaagtgaggtctttaatcgggaatgaggaattcctggactacatgccgtcaatgaagcgctttagaaaagaggaggaaagtgagggagctatttggtga

SEQ ID NO: 15170 - RNA, 9873 nt, synthetic construct
  misc_feature 1..9873: note = derived and/or modified CDS sequence (opt3) from DENV-3__GU131874__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagctgatagagggaaaagtggtccagtatgaaaatctcaagtacacagtgattatcactgttcacaccggtgaccagcatcaggtgggcaacgagacacaaggggtcaccgcagaaattactccccaggcttccacgacagaggccatccttcctgaatatggaaccctgggcttggagtgctctccaagaactggtctagacttcaatgagatgatcctgctcaccatgaaaaacaaggcgtggatggtgcacaggcagtggtttttcgatctgccgcttccctggacaagcggggccaccactgaaacacctacgtggaatcggaaagagctgttggtaacctttaagaacgcacatgctaaaaagcaagaagttgtggtcctcggctcccaggagggagccatgcacactgctctgacaggcgccaccgaaattcagaattcagggggaacaagtatattcgcaggtcacttaaagtgtcgtctgaaaatggacaagctagagctcaaaggcatgagctacgccatgtgcactaacacctttgtgctgaagaaagaggtctctgaaacgcagcatgggaccatccttattaaggtggagtacaagggagaagatgctccatgtaaaatccccttctccacagaggacggccaaggtaaggcgcacaacgggcgcttgataactgcaaatcctgttgtgaccaaaaaggaggaaccagtaaacattgaggccgaacccccgttcggcgagtcaaatatcgtcatcggaacaggcgataacgctctgaaaattaattggtataagaaggggagcagtatcggaaaaatgtttgaagccactgcaagaggtgccaggcggatggctattctcggcgacaccgcctgggatttcgggtctgtgggaggcgttctgaactcccttggtaagatggtgcatcagatatttgggagcgcatacacggcgctgttctcgggcgtctcttgggtgatgaaaatcggaattggcgtattgctcacatggatcgggctgaattccaagaacacctcaatgagttttagctgcatcgctattggaataatcactttatatctgggcgccgtggttcaggcagacatgggttgtgtcattaattggaaagggaaggagctaaagtgcggatccggcatcttcgtgacaaacgaggtgcacacctggactgaacagtacaaatttcaagccgattctcctaagcgactcgctaccgccattgcaggtgcttgggagaatggcgtctgtgggatccgcagcacaacgagaatggaaaacctgctttggaaacagatagccaatgagttgaactatatcctgtgggaaaataacattaagctcaccgttgtggtgggagacatcattggcgtactggagcaggggaaaaggactttaacaccccagccaatggagctgaagtactcatggaaaacctggggaaaggcgaagatcgtcacagccgaaactcaaaacagttccttcataattgatggccctaatacccccgagtgcccaagcacgtctcgggcttggaacgtgtgggaagttgaggactatggttttggggtgttcacaaccaatatctggcttaaattgcgcgaagtctacactcagctctgtgaccatagactgatgtcagcagccgtgaaggatgagagggctgttcacgccgacatgggatactggattgagagtcagaaaaacggcagctggaagctagaaaaagcatccctgatcgaggtgaagacctgcacatggcccaagtctcacactctctggtcgaatggtgtactggaaagcgatatgataatccctaaatcccttgcgggcccaatttcacagcataaccaccgtccggggtatcatacccaaacagccggaccctggcacttgggcaagctggagttagactttaattactgcgaggggacgaccgtcgtgatcactgaaaactgtggaacacggggccctagtctccgaaccactacagtgtctggtaaactgattcacgagtggtgctgtagaagctgcacccttccacccctgaggtatatgggggaagatggatgttggtacggcatggagatccgccctatatccgaaaaggaggagaatatggtcaaatcattggttagcgctggttctggcaaggtggacaacttcacgatgggggtactctgcctggccattctatttgaagaggtgatgcggggaaagttcggcaaaaagcatatgatcgcaggggtcttctttactttcgtgctgctcctgtccggacagatcacctggagagatatggctcacacacttattatgatcggcagtaatgccagcgacaggatgggtatgggggttacctatttggcactgattgccacttttaaaatacagccattcttagctctcggatttttcctgcgcaagcttacatctcgagaaaacctgctactcggcgtgggcctggcgatggccaccacattgcaactgcccgaggatatcgaacagatggcaaatgggattgctttaggactcatggccctgaaacttatcactcagtttgagacctaccagctgtggacggccttgatttccctcacatgttcaaacaccatgttcactctgaccgtcgcttggcggacagcaactctaatcctggccggtgtgagtcttctcccggtttgccaaagctcgtccatgcgtaagaccgactggctgcctatggcggtggctgccatgggcgtcccacccttgcctctgtttatattctctttaaaggatacgctcaaaagaaggagctggcccctgaatgagggggtaatggcagtgggacttgtttcaatcctggccagttccttgctccgcaacgacgtgccaatggctggccctctggtcgcaggtgggctactgattgcctgttatgtgatcacaggaacctctgcggatcttactgtagaaaaggctgccgacattacatgggaggaagaggcagaacagaccggcgtgagccataacctcatgatcactgtcgacgatgacggcacaatgcggataaaagatgacgagaccgagaatattctgacggttttgttaaagactgccctgctcatcgtgtccggggtgtttccctactcaatcccagctaccctgcttgtctggcacacatggcagaaacagacccaaagaagcggagtgctgtgggatgttccgagtcctcccgaaacacagaaggccgagttggaagagggtgtatacaggattaaacagcagggcatattcgggaagactcaagtgggagtcggcgtgcagaaggagggtgtttttcataccatgtggcacgtgacgcgaggggcagtcctaacatataacggaaaacgcctggaaccaaattgggcttctgtgaagaaagacctcatctcctacggcggcgggtggcggctgagcgcccagtggcaaaagggagaggaagtacaggtcattgcggtggagcccggtaaaaaccctaagaatttccagactatgccaggcaccttccagacaaccactggggaaatcggagccattgcacttgattttaagcccggcacctcgggttcacctatcataaacagagaggggaaagttgtgggattatatggcaatggcgtcgtgacaaagaacgggggatacgtttctggtatcgctcaaacgaatgccgagccggacggcccaactcccgaactggaggaagagatgttcaaaaagaggaacctcaccattatggatttgcaccctgggagtggaaaaacacgtaagtatctgccagctatcgtgcgcgaagcaattaagcggagactcaggaccctgatccttgcccccactcgagtcgtggccgctgagatggaggaagcgctgaaaggcttgcctatacggtaccagacaaccgcaacgaagtccgagcatactggtcgcgaaattgtagacctaatgtgccacgccacatttaccatgagactgctcagcccggtgagggttcccaattataacttaatcatcatggatgaggctcatttcaccgacccagcctctattgcagcccgggggtacatcagcactcgagtcggaatgggcgaagctgcggccatatttatgacagcaacccctcccggcacagctgatgccttcccacagtccaatgcacctattcaggacgaggagagagacatccccgaacgctcatggaacagtgggaatgagtggattactgattttgccggaaaaacggtgtggttcgtgccaagcatcaaggctggtaacgacatagccaactgtctgaggaaaaatggcaagaaggtcattcaactttctcgtaaaacctttgatacagaataccagaagactaaactgaacgactgggatttcgtagtgaccacagacatctccgagatgggggcgaattttaaggcagatcgggttatcgacccgagaaggtgcctcaaacctgtgattttgaccgatggacccgagcgcgtcatcctggccggcccaatgcccgtgactgctgcctcagctgcacagcgaagaggtcgggttgggaggaaccctcagaaggaaaatgaccaatatattttcacgggccagccactcaacaatgatgaggaccacgcccattggaccgaagctaagatgctgcttgacaacataaatacacccgagggaatcattcctgccctattcgaaccggagcgcgagaaaagtgcagcgatcgatggcgaataccgtctgaagggggagagcagaaaaacttttgtggaattgatgcggaggggagacttaccagtctggctggcccacaaggtggcttccgagggtatcaaatataccgatcgcaagtggtgcttcgacggccagcgaaacaatcagattctcgaagagaacatggatgtagagatatggacaaaagaaggggagaagaagaaactgagaccccggtggcttgacgccaggacctactctgatcctctggcactcaaggaatttaaagacttcgctgccggacgcaagtcgatcgcattggatctggtgactgagattggcagagttcccagccacctagcccataggacacggaatgctctggacaacctcgtcatgcttcacacgtcagaacatggtgggcgtgcgtatcgccacgccgtggaggagctgccagaaaccatggagactttattgctgctcggcctgatgatccttctgacaggaggcgcaatgctctttttgatttccgggaaaggaatcggtaagaccagtataggcctgatctgtgtgattgcttctagcgggatgttatggatggccgaaatccctctacaatggattgcctccgcaatcgtcctggagttctttatgatggttctccttatacccgagccagaaaagcagcgaacccctcaggataatcaactggcttacgtggtaattggaatcttgacactggccgcgattatcgctgccaacgagatgggcctcctggaaactacgaaaagagaccttggtatgtcaaaggagccgggggtggtctctcccaccagctatctcgatgtggacctgcacccagcaagtgcctggacattgtacgctgttgcaactaccgtgataacacctatgctgaggcataccatcgaaaattccactgccaacgtcagcttagcggctattgccaaccaggcagtagtgctaatgggcctggacaaaggatggcccatctctaagatggatctcggcgttccacttctggccttggggtgctactcacaggtgaatcctctgacgctcacagctgccgtcctgcttttaattacccactatgcaatcataggacccggcctgcaggctaaagccactcgggaggcgcaaaagcgcaccgccgcaggtattatgaagaacccgacagtggacgggatcatgactatcgatctcgacccagtcatttacgattccaaattcgagaagcagttgggacaggtgatgctgctagttctgtgtgctgcccagctccttctgatgagaaccagttgggcattgtgcgaagctctgacactcgccacgggccctatcaccactctgtgggagggtagccccggcaaattttggaatacaaccatagccgtgtcgatggcgaacattttcagggggtcttatttagctggagcaggccttgccttttccatcatgaagagcgtagggactggaaaacggggcacaggttcacaaggggaaaccctgggagagaagtggaagaaaaagctcaatcagctaagtcgaaaagaattcgacctgtacaagaaatctggcattacggaggtggatagaaccgaggctaaggaaggtttgaaacgcggcgagatcacacatcacgccgtctccagggggagcgcaaagctgcagtggtttgttgaacggaacatggtgataccagagggacgtgtcatcgacctcggctgtgggagaggaggctggtcatattactgcgccggtcttaagaaagtgactgaagtaagggggtataccaagggaggccccggccatgaggagcctgtgccgatgagtacatacgggtggaatattgttaaactgatgagcggaaaggatgtgttctacttgcccccagaaaaatgtgacactctgctctgcgatatcggtgagtcctctcctagccccaccgtcgaagagtcccgcacaattcgggtgttaaagatggtcgagccttggctgaagaacaatcagttctgtatcaaagtgcttaacccatatatgcccaccgttattgaacacctggagcgactacaaagaaagcacggcgggatgctcgtaaggaatcctctgtcacgcaactctactcatgaaatgtactggatcagtaatggaacgggcaacatagtggcttcggtcaatatggtgagccggttgctgctcaacagatttacaatgacccaccgtaggccaactattgagaaagacgttgatcttggtgcggggacccggcatgtgaacgccgaacccgagacaccgaatatggacgtcatcggagagcgcatcaagcgaattaaagaagagcacaactccacgtggcactatgacgatgaaaatccttacaagacctgggcatatcatggctcttacgaggtgaaggctactggctcagccagctccatgataaacggggtagtgaaactgttaacaaagccatgggacgttgtccccatggtgacccagatggcaatgactgatacaacccctttcggacagcaaagagtgtttaaagaaaaggtcgacacaaggactccacggagtatgcccggtacccgcagagttatgggcatcacggccgagtggctgtggaggaccttggggcgaaataaacggccgcgtctctgcacaagagaggaattcactaagaaggtgcgcaccaacgctgccatgggagcggtatttacagaggaaaatcagtgggattctgcaaaagccgctgtggaggacgaagatttctggaagctggtcgacagggagcgggagctacacaaacttggcaagtgtggtagctgcgtgtataacatgatggggaaaagagaaaagaaactgggagagtttggcaaggccaagggctcacgcgcaatttggtacatgtggctcggggctaggtacctggaattcgaggccttgggatttctgaatgaggatcattggttctcccgagaaaacagttatagcggtgttgagggcgaagggctccacaaacttggatacatcctgcgggacatttctaagatccctggcggtgctatgtatgccgatgacactgcagggtgggacaccagaataacggaggatgacttacataatgaagagaaaatcacacagcagatggatcccgagcacaggcaactggcgaacgccatttttaagttgacctaccagaataaagtggtcaaggtgcagcgcccaactcctacaggaaccgtaatggacatcatttcccgtaaggatcagcggggctcaggccaagttgggacttatggactcaacaccttcacaaatatggaagctcagctgatcagacagatggagggtgaaggcgtgctaagcaaagccgaccttgagaacccccacctgccagaaaagaaaatagcacagtggctcgagacgaagggggtcgagaggctgaaacgcatggctatttcgggagatgactgcgtggtgaagcccatcgatgaccgatttgccaacgcattgttagccctgaatgatatgggcaaggtccggaaagacatccctcaatggcagccatctaagggttggcatgattggcagcaggttccgttctgtagtcaccatttccacgaactcattatgaaagacgggagaaagcttgtggtaccctgcaggcctcaagacgagctgataggacgcgcgagaatctcccagggcagcggctggtcactacgggaaaccgcttgtctggggaaagcctacgcacagatgtggtccctcatgtattttcacaggcgtgatttgcgactggcctctaacgctatttgcagcgccgtgccagtccattgggtgcccactagtcgcacaacctggtccatccacgcacatcaccaatggatgactacagaggacatgcttgctgtttggaatagagtgtggattgaagataacccttggatggaggacaagaccccagtcacgacatgggagaatgtgccctacctgggaaagcgggaagatcagtggtgtggtagcctcatcggcttaacctctagggccacttgggcgcagaacatacctaccgctatccagcaagtacgctcactgattgggaatgaggaattcttggactacatgccgagtatgaaaagatttcggaaggaggaggaatccgagggagccatctggtga

SEQ ID NO: 15171 - RNA, 9873 nt, synthetic construct
  misc_feature 1..9873: note = derived and/or modified CDS sequence (opt3) from DENV-3__GU131875__SS-prME
  source 1..9873: mol_type = other RNA
accagcctgtgcctcgtgatgatccttcccgccgctctggcattccacttgacatccagagacggcgagcctaggatgattgtcgggaagaacgaacggggaaaatctttactgtttaagactgcctcaggtataaatatgtgtacgctaatcgcgatggatctcggcgagatgtgcgacgataccgttacatacaaatgtccacatattactgaagtggagccggaagacatcgattgctggtgtaacctgaccagtacatgggtaacctatgggacttgcaatcaggctggagagcgccgacgtgacaagagaagcgtggcccttgcaccccacgtcggcatgggtctggatacaaggacccaaacgtggatgtccgccgagggggcttggcggcaggtggaaaaagttgagacttgggcattgcgccatcctggattcaccattctcgccctgtttctggctcactacatcggcacatctctcactcagaaggtggtcatattcatcttactgatgcttgtgaccccatcgatgacaatgagatgtgtaggcgttgggaacagggactttgtggaaggattgtcaggtgccacctgggtcgatgtggtgctggagcatggcgggtgcgtcacgactatggcgaagaataaacccacactagacattgagctccagaagaccgaagcaactcaactggccacacttcggaaactgtgtatcgagggaaagattaccaacatcacgaccgatagccgctgccctacacagggcgaagctgttttgccagaggaacaggaccagaattatgtgtgtaaacacacttacgtagatcgaggttgggggaacggatgcggcctcttcggcaaggggagtctggtgacctgcgccaagtttcaatgtttagagcccatagagggaaaagtcgtgcagtatgaaaatctgaagtacacagttattatcactgtgcacaccggtgaccagcatcaggtcggcaacgagacacaaggggtgaccgcagaaattactcctcaggcttccacgacagaggccatcctcccagaatatggaacccttggcctggagtgctctccgagaactggtttggacttcaatgagatgatcctactgaccatgaaaaacaaggcgtggatggtacacaggcagtggtttttcgatctccccctgccttggacaagcggggccaccactgaaacaccaacgtggaatcggaaagagcttctggttacctttaagaacgcacatgctaaaaagcaagaagtggtcgtgttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtcctcaagaaagaggtgtctgaaacgcagcatgggaccatcctgattaaggttgagtaccgcggagaagatgctccctgtaagatccctttctccacagaggacggccaaggtaaagcgcacaacgggagacttataactgcaaatccagtggtaaccaagaaagaggaacccgtcaacattgaggccgaaccgcctttcggcgagtcaaatatcgtgatcggaattggcgataacgctttgaagatcaattggtataaaaaggggagcagtattggaaagatgtttgaagccacagcaaggggtgcccggcgaatggctatactgggcgacactgcctgggatttcgggtctgttggaggcgtgctcaactccctgggtaaaatggtccatcagatctttgggagcgcatacaccgcgcttttctcgggcgtgtcttgggtaatgaagattggaatcggcatcctgttgacgtggattgggctcaattccaaaaacacatcaatgagttttagctgcatagctatcggaattatcaccctgtatttaggcgccgtggttcaggcagacatgggttgtgtcattaattggaaggggaaagagctgaagtgcggatccggcatcttcgtgactaacgaggtgcacacatggaccgaacagtacaagtttcaagccgattctcccaaacgcctagctactgccatagcaggtgcttgggagaatggcgtctgtgggatcagaagcaccacaaggatggaaaacctcctgtggaagcagattgccaatgagcttaactatatcttgtgggaaaataacattaaactgacggttgtggtgggagacatcataggcgtactcgagcaggggaagcggaccctgactccacagcctatggagttaaaatactcatggaagacatggggaaaagcgaagattgtcaccgccgaaacacaaaacagttccttcatcattgatggccccaatactccagagtgccccagcgcttctcgcgcatggaacgtgtgggaagttgaggactatggttttggggtgttcaccacgaatatctggctgaagcttagagaagtctacacacagttgtgtgaccataggctcatgtcagccgctgtgaaagatgagcgtgccgttcacgcagacatgggatactggatagagagtcagaagaacggcagctggaaactggaaaaggcgtccctaatcgaggtgaaaacctgcacttggcctaagtctcacaccctgtggtcgaatggtgtactcgaaagcgatatgattatcccaaagtccctggccggcccgatttcacagcataaccaccggcccgggtatcatacacaaactgctggaccttggcaccttggcaaattggagctggactttaattactgcgaggggaccacagtcgtgatcacggaaaactgtggaacccgaggcccaagtttaagaactacaaccgtgtctggtaagctcatacacgagtggtgctgtaggagctgcactctgccccctcttcgctatatgggggaagatggatgttggtacggcatggagattcggccaatctccgaaaaagaggagaatatggtcaagtcactggttagcgccggttctggcaaagtggacaacttcacaatgggggtattgtgcctcgcaatcctgtttgaagaggtgatgagaggaaagttcggcaagaaacatatgattgctggggtcttctttaccttcgtgctactgctctccggacagatcacgtggagggatatgactcacaccctgattatgataggcagtaatgccagcgaccgcatgggtatgggggttacatatcttgcattgatcgccacctttaagattcagcccttcctggctttaggatttttcctccgaaaactgacttctcgggaaaaccttctgctaggcgtgggcctcgcgatggccacaaccctgcaattgccggaggatatcgaacagatggcaaatgggattgctctgggattaatggccctcaagctgatcacacagtttgagacttaccagctttggaccgccctgatatccttgacgtgttcaaacacaatgttcaccctcactgtcgcttggcgtaccgcaacactgatcctagccggtgtgagtctgcttcctgtttgccaaagctcgtccatgagaaaaactgactggctcccaatggcggtggctgccatgggcgtcccccctctgcccttgtttattttctctctgaaggataccttaaagaggcgcagctggccactcaatgagggggtaatggcagtgggactggtttcaatccttgccagttccctgttgcggaacgacgtgcctatggctggccccctcgtcgcaggtgggctgctaattgcctgttatgtgatcacgggaacatctgcggatctgaccgtagaaaaagctgccgacataacttgggaggaagaggcagaacagacaggcgtgagccataaccttatgattaccgtcgacgatgacggcactatgagaatcaaggatgacgagacagagaatatcctcaccgttctgttgaaaacggccttactgattgtgtccggggtgtttccatactcaataccggctactctcctggtctggcacacctggcagaagcagacacaaaggagcggagtgctttgggatgttcctagtcccccagaaacccagaaagccgagctggaagagggtgtataccgaatcaagcagcagggcattttcgggaaaacacaagtgggagtcggcgtgcagaaggagggtgtttttcatactatgtggcacgtgacccgcggggcagtcttgacgtataacggaaagcggctagaacccaattgggcttctgtgaaaaaggacctgatctcctacggcggcgggtggagactcagcgcccagtggcaaaaaggagaggaagtacaggtcattgcggtggagcctggtaagaacccaaaaaatttccagacaatgcccggcactttccagaccacaaccggggaaatcggagccatagcactggattttaagcctggcacttcgggttcaccgatcattaacagggaggggaaggttgtgggactttatggcaatggcgtcgtgaccaaaaacgggggatacgtttctggtatcgctcaaacaaatgccgagccagacggccccacgcctgaattagaggaagagatgttcaagaaacgtaacctgactattatggatctccacccagggagtggaaagacccgcaaatatttgcccgctatcatacgggaagcaattaagagaaggctgcgaacactcatcctggcccctacccgggtggtcgccgctgagatggaggaagcgcttaagggcctgccgatccgctaccagactacagcaaccaaatccgagcatacgggtagagaaattgtggacttgatgtgccacgccacttttacaatgaggctactgagccccgtacgggtgccaaattataacctcatcataatggatgaggctcatttcaccgaccctgcctctattgcagcccgagggtacatcagcaccagagttggaatgggcgaagctgcggccatttttatgactgcaacacccccaggcaccgctgatgccttccctcagtccaatgcacccatccaggacgaggagcgcgacataccagaaaggtcatggaacagtgggaatgagtggattacagattttgccggaaagactgtctggttcgtgccgagcatcaaagctggtaacgacatcgccaactgtttacgtaagaatggcaaaaaggtgattcaactgtctcggaagacgtttgataccgaataccagaaaacaaagcttaacgactgggatttcgtcgtaactaccgacatctccgagatgggggcgaattttaaagtggatagagttattgaccctaggcgctgcctgaagcccgtgatactcacagatggaccagagcgagtcatcttggcaggccccatgcctgtgaccgccgcttcagccgctcagagacggggtagggttgggcgcaacccacagaaagaaaatgaccaatatattttcactggccagcccctgaacaatgatgaggaccacgcacattggacggaagccaagatgctcctggacaacatcaatacccctgagggaatcattccggctcttttcgaaccagagcgtgagaagagtgccgcaatagatggcgaatacagactaaaaggggagagccggaagacatttgtggaactgatgaggcgcggagacttgcccgtctggttagcgcacaaagtggcctccgagggtatcaagtatactgatcgaaaatggtgcttcgacggccagagaaacaatcagattctggaagagaacatggatgtagagatctggaccaaggaaggggagaaaaagaagctccggcctaggtggctggacgctcgcacatactctgatccccttgccctgaaagaatttaaggacttcgcagctggaagaaaatcgattgccctcgatttggtgaccgagatcggcagggttccaagccacctggcacatcggactcgtaatgccctagacaacctggtcatgctccacacatcagaacatggtgggcgcgcttatcgacacgcggtggaggagcttcctgaaacgatggagaccctgttattgctgggcctcatgatactgcttactggaggcgccatgctgtttctcatctccgggaagggaattggtaaaacaagtatcggcttgatttgtgtgatcgcatctagcgggatgctgtggatggctgaaatacccttacaatggattgcctccgccatcgtcctagagttctttatgatggttctgctcattccagagcctgaaaagcagagaaccccgcaggataatcaacttgcatacgtggtaatcggaatactgaccttggctgccatcattgcggctaacgagatgggcctgctcgaaacaactaagagggacctgggtatgtcaaaagagcccggggtggtctctccaacgagctatcttgatgtggacctccaccctgccagtgcatggaccctgtacgccgttgctacaactgtgatcacccccatgttgcggcatacaattgaaaattccaccgcaaacgtcagcctggccgcgatcgctaaccaggccgtagtgttaatgggcctagacaagggatggccaatatctaaaatggatctgggcgttcctctccttgcactggggtgctactcacaggtgaatcccttgactctgacggccgctgtcctcctgcttattacacactatgccatcatcggaccgggcttacaggcaaaggctacccgcgaggcccaaaaaagaactgcggccggtattatgaagaacccaaccgtggacgggatcatgacaatagatctggaccctgtcatttacgattccaagttcgagaaacagctcggacaggtgatgttgctggttctatgtgcagtgcagctgctccttatgaggactagttgggctctgtgcgaagccttgaccctggcaacaggccccatcacgaccctctgggagggtagcccaggcaagttttggaatactacaattgctgtatcgatggccaacatcttccgggggtcttatctggccggagcgggcttagctttttccataatgaaaagcgtggggaccggaaagcgaggcactggttcacaaggggaaacacttggagagaaatggaagaagaaactgaatcagctcagtagaaaggaattcgacctatacaaaaagtctggcatcaccgaggtcgatcgcacggaggcaaaagaaggtctgaagaggggcgagattacccatcacgccgtttcccgggggagcgctaaattgcagtggtttgtggaacgtaacatggtcatccccgagggaagagtgattgacctgggctgtgggaggggaggctggtcatattactgcgccggtctcaagaaggtaacagaagtgcgcgggtatactaaaggaggccctggccatgaggagccggttcccatgagtacctacgggtggaatatcgtgaagcttatgagcggaaaagatgtcttctacctgccacctgaaaagtgtgacacattgctgtgcgatattggtgagtcctctcccagccctactgtggaagagtcccggaccatccgagtcctcaaaatggtggagccatggttaaagaacaatcagttctgtataaaggttctgaacccctatatgcctacagtaattgaacaccttgagagactgcaaaggaaacacggcgggatgctagtgcgcaatccactctcacggaactctacccatgaaatgtactggatcagtaatggaactggcaacatcgtcgcatcggtgaatatggttagcagactgttgctgaaccgttttacgatgacacacaggcggcccaccattgagaaggacgtggatctcggtgccgggactcgccatgtcaacgctgaaccggagacccctaatatggacgtgataggagagcgaatcaaaagaattaaggaagagcacaactccacatggcactatgacgatgaaaatccatacaaaacgtgggcgtatcatggctcttacgaggtaaaggccaccggctcagcaagctccatgatcaacggggtggttaagcttctgactaaaccctgggacgtcgtgcctatggtgacacagatggctatgaccgatactacaccattcggacagcaaagggtctttaaggaaaaagttgacacccggacaccccgcagtatgccgggtactagaagggtgatgggcattaccgccgagtggttatggcgaacgctggggcggaataagaaacctcgtttgtgcaccagagaggaattcacaaagaaggtacgcactaacgcagccatgggagctgtgtttaccgaggaaaatcagtgggattctgccaaagcggcagtcgaggacgaagatttctggaagctcgtggacagggagcgggagctgcacaaactaggcaagtgtggtagctgcgtttataacatgatggggaaaagagaaaagaaacttggagagtttggcaaggccaagggctcacgcgctatctggtacatgtggctgggggccaggtacctcgaattcgaggcactgggatttttgaatgaggatcattggttctcccgagaaaacagttatagcggtgtggagggcgaagggctgcacaaactcggatacatacttcgggacatctctaagattcccggcggtgctatgtatgccgatgacacagctgggtgggacactagaatcaccgaggatgacctgcataatgaagagaaaattacgcagcagatggatccagagcacaggcaattagccaacgcaatctttaagctgacataccagaataaagtcgtgaaggtacagcgccctacccccactggaacagttatggacataatttcccgtaaggatcagcggggctcaggccaagtggggacctatggattgaacactttcaccaatatggaagcgcagctcatcagacagatggagggtgaaggcgtcctgagcaaagccgacctagagaacccacaccttcccgaaaagaaaatcacacagtggctggagacgaagggggtggagaggctcaaacgcatggctatttcgggagatgactgcgtggtcaagcctatagatgaccgatttgccaacgcactgttggctttaaatgatatgggcaaggttcggaaagacatcccacaatggcagccgtctaagggttggcatgattggcagcaggtgcccttctgtagtcaccatttccacgaactgattatgaaagacgggagaaagctcgtagtgccttgcaggccacaagacgagcttatcggacgcgccagaatttcccagggcgcaggctggagcctgcgggaaaccgcctgtctagggaaagcgtacgctcagatgtggtcactgatgtattttcacaggcgtgatctccgattggcctccaacgcaatctgctctgccgtccccgtgcattgggttcctactagccgcacaacctggagtatacacgctcatcaccaatggatgactacagaggacatgctgaccgtgtggaatagagtctggatcgaagataacccatggatggaggacaagacgcccgtgacaacctgggagaatgtaccttaccttggaaagcgggaagatcagtggtgtggttccctgattggcctcactagcagggccacctgggcacagaacatcccgacagctattcagcaagttcgctctttaatcgggaatgaggaattcctggactacatgccatcaatgaaaagatttcggaaggaggaggaaagtgagggagccatttggtga

SEQ ID NO: 15172 - RNA, 9873 nt, synthetic construct
  misc_feature 1..9873: note = derived and/or modified CDS sequence (opt3) from DENV-3__GU131877__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagcccatagagggaaaagtggtccagtatgaaaatctgaagtacacagtgattatcactgttcacaccggtgaccagcatcaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaaaaacaaggcgtggatggtgcacaggcagtggtttttcgatctccccctgccttggacaagcggggccaccactgaaacaccaacgtggaatcggaaagagcttctggtaacctttaagaacgcacatgctaaaaagcaagaagttgtggtcttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtgctcaagaaagaggtctctgaaacgcagcatgggaccatcctgattaaggtggagtaccgcggagaagatgctccctgtaagatccctttctccacagaggacggccaaggtaaagcgcacaacgggagacttataactgcaaatccagttgtgaccaagaaagaggaacccgtaaacattgaggccgaaccgcctttcggcgagtcaaatatcgtcatcggaattggcgataacgctttgaagatcaattggtataaaaaggggagcagtattggaaagatgtttgaagccacagcaaggggtgcccggcgaatggctatactgggcgacactgcctgggatttcgggtctgtgggaggcgttctcaactccctgggtaaaatggtgcatcagatctttgggagcgcatacaccgcgcttttctcgggcgtctcttgggtgatgaagattggaatcggcgtactgttgacgtggatcgggctcaattccaaaaacacatcaatgagttttagctgcattgctataggaatcattaccctgtatttaggcgccgtggttcaggcagacatgggttgtgtcatcaattggaaggggaaagagctgaagtgcggatccggcattttcgtgactaacgaggtgcacacatggaccgaacagtacaagtttcaagccgattctcccaaacgcctagctactgccatcgcaggtgcttgggagaatggcgtctgtgggataagaagcaccacaaggatggaaaacctcctgtggaagcagatcgccaatgagcttaactatattttgtgggaaaataacatcaaactgacggttgtggtgggagacattatcggcgtactcgagcaggggaagcggaccctgactccacagcctatggagttaaaatactcatggaagacatggggaaaagcgaagatagtcaccgccgaaacacaaaacagttccttcattatcgatggccccaatactccagagtgccccagcgcttctcgcgcatggaacgtgtgggaagttgaggactatggttttggggtgttcaccacgaatatttggctgaagcttagagaagtctacacacagttgtgtgaccataggctcatgtcagccgctgtgaaagatgagcgtgccgttcacgcagacatgggatactggatcgagagtcagaagaacggcagctggaaactggaaaaggcgtccctaatagaggtgaaaacctgcacttggcctaagtctcacaccctgtggtcgaatggtgtactcgaaagcgatatgatcattccaaagtccctggccggcccgatctcacagcataaccaccggcccgggtatcatacacaaactgctggaccttggcaccttggcaaattggagctggactttaattactgcgaggggaccacagtcgtgattacggaaaactgtggaacccgaggcccaagtttaagaactacaaccgtgtctggtaagctcatccacgagtggtgctgtaggagctgcactctgccccctcttcgctatatgggggaagatggatgttggtacggcatggagatacggccaatttccgaaaaagaggagaatatggtcaagtcactggttagcgccggttctggcaaagtggacaacttcacaatgggggtattgtgcctcgtgatcctgtttgaagaggtcatgagaggaaagttcggcaagaaacatatgatcgcaggggtgttctttaccttcgttctactgctctccggacagattacgtggagggatatggctcacactctgatcatgattggcagtaatgccagcgaccgcatgggtatgggggtgacctatcttgcattgatagccacatttaagatccagcccttcctggctttaggatttttcctccgaaaactgacctctcgggaaaaccttctgctaggcgtcggcctcgcgatggccactacactgcaattgccggaggatattgaacagatggcaaatgggatcgctctgggattaatggccctcaagctgattacccagtttgagacataccagctttggactgccctgatctccttgacctgttcaaacacgatgttcacactcaccgtggcttggcgtactgcaaccctgatactagccggtgttagtctgcttcctgtgtgccaaagctcgtccatgagaaaaacagactggctcccaatggcggtcgctgccatgggcgtaccccctctgcccttgtttatcttctctctgaaggatactttaaagaggcgcagctggccactcaatgagggggtgatggcagttggactggtgtcaattcttgccagttccctgttgcggaacgacgtccctatggctggccccctcgtggcaggtgggctgctaatcgcctgttatgtaattaccggaacgtctgcggatctgacagtggaaaaagctgccgacatcacctgggaggaagaggcagaacagactggcgtcagccataaccttatgataacagttgacgatgacggcaccatgagaattaaggatgacgagactgagaatatcctcacagtgctgttgaaaaccgccttactgatcatttccggggtgtttccatactcaataccggctacgctcctggtctggcacacttggcagaagcagacccaaaggagcggagtgctttgggatgttcctagtcccccagaaacacagaaagccgagctggaagagggtgtataccgaatcaagcagcagggcattttcgggaaaacccaagtgggagtcggcgtgcagaaggagggtgtttttcatacaatgtggcacgtgactcgcggggcagtcttgacctataacggaaagcggctagaacccaattgggcttctgtgaaaaaggacctgatctcctacggcggcgggtggagactcagcgcccagtggcaaaaaggagaggaagtacaggtcattgcggtggagcctggtaagaacccaaaaaatttccagacgatgcccggcacattccagactaccacaggggaaatcggagccatagcactggattttaagcctggcacctcgggttcaccgatcattaacagggaggggaaggttgtgggactttatggcaatggcgtcgtgactaaaaacgggggatacgtttctggtatcgctcaaaccaatgccgagccagacggccccacacctgaattagaggaagagatgttcaagaaacgtaacctgacgattatggatctccacccagggagtggaaagactcgcaaatatttgcccgctatcatacgggaagcaattaagagaaggctgcgaaccctcatcctggcccctacacgggtggtcgccgctgagatggaggaagcgcttaagggcctgccgatccgctaccagaccactgcaacaaaatccgagcataccggtagagaaattgtggacttgatgtgccacgccacgtttactatgaggctactgagccccgtacgggtgccaaattataacctcatcataatggatgaggctcatttcacagaccctgcctctattgcagcccgagggtacatcagcaccagagttggaatgggcgaagctgcggccatttttatgaccgcaactcccccaggcacagctgatgccttccctcagtccaatgcacccatccaggacgaggagcgcgacataccagaaaggtcatggaacagtgggaatgagtggattaccgattttagcggaaagacagtctggttcgtgccgtctatcaaagccggtaacgacatcgctaactgtttacgtaagaatggcaaaaaggtgattcaactgtcccggaagacttttgatacggaataccagaaaaccaagcttaacgactgggatttcgtcgtaacaactgacatctcagagatgggggccaattttaaagcggatagagtgattgaccctaggcgctgcctgaagcccgttatactcaccgatggaccagagcgagtgatcttggcaggccccatgcctgtcacagccgctagtgccgctcagagacggggtagggtggggcgcaacccacagaaagaaaatgaccaatatattttcaccggccagcccctgaacaatgatgaggaccacgcacattggactgaagccaagatgctcctggacaacatcaatacgcctgagggaatcattccggctcttttcgaaccagagcgtgagaagagcgccgcaatagatggcgaatacagactaaaaggggagtcccggaagacctttgttgaactgatgaggcgcggagacttgcccgtgtggttagcgcacaaagtcgcctctgagggtatcaagtatacagatcgaaaatggtgcttcgacggccagagaaacaatcagattctggaagagaacatggatgtggagatctggactaaggaaggggagaaaaagaagctccggcctaggtggctggacgctcgcacctactcggatccccttgccctgaaagaatttaaggacttcgcagctggaagaaaaagcattgccctcgatttggtaacagagatcggcagggtgccatcacacctggcacatcggacccgtaatgccctagacaacctggttatgctccacacttccgaacatggtgggcgcgcttatcgacacgcggtcgaggagcttcctgaaacaatggagacgctgttattgctgggcctcatgatactgcttaccggaggcgccatgctgtttctcatcagtgggaagggaattggtaaaacttctatcggcttgatttgtgtgatcgcaagctccgggatgctgtggatggctgaaatacccttacaatggattgcctcagccatcgtgctagagttctttatgatggtcctgctcattccagagcctgaaaagcagagaacaccgcaggataatcaacttgcatacgttgtgatcggaatactgaccttggctgccatcattgcggctaacgagatgggcctgctcgaaaccacaaagagggacctgggtatgtctaaagagcccggggtagtgagcccaactagttatcttgatgtcgacctccaccctgcctccgcatggacgctgtacgccgtggctaccacagttatcactcccatgttgcggcataccattgaaaatagcacagcaaacgtgtctctggccgcgatcgctaaccaggccgtcgtattaatgggcctagacaagggatggccaatatcaaaaatggatctgggcgtgcctctccttgcactggggtgctactcccaggttaatcccttgaccctgactgccgctgtgctcctgcttattacgcactatgccatcatcggaccgggcttacaggcaaaggctacacgcgaggcccaaaaaagaaccgcggccggtattatgaagaacccaactgtcgacgggatcatgaccatagatctggaccctgtgatttacgatagtaagttcgagaaacagctcggacaggtcatgttgctggtgctatgtgcagttcagctgctccttatgaggacaagctgggctctgtgcgaagccttgactctggcaaccggccccatcacaacgctctgggagggttcgccaggcaagttttggaataccactattgctgtgtctatggccaacatcttccgggggtcctatctggccggagcgggcttagcttttagcataatgaaatcagtagggacaggaaagcgaggcaccggtagtcaaggggaaactcttggagagaaatggaagaagaaactgaatcagctctctagaaaggaattcgacctatacaaaaagtccggcatcacagaggtggatcgcaccgaggcaaaagaaggtctgaagaggggcgagattacgcatcacgccgtcagccgggggtcagctaaattgcagtggtttgttgaacgtaacatggtgatccccgagggaagagtcattgacctgggctgtgggaggggaggctggagttattactgcgccggtctcaagaaggtgaccgaagtacgcgggtatacaaaaggaggccctggccatgaggagccggtgcccatgagcacttacgggtggaatatcgttaagcttatgtccggaaaagatgtgttctacctgccacctgaaaagtgtgacaccttgctgtgcgatattggtgagtctagcccctcccctacagtcgaagagtcacggactatccgagtgctcaaaatggtcgagccatggttaaagaacaatcagttctgtataaaggtgctgaacccctatatgcctaccgttattgaacaccttgagagactgcaaaggaaacacggcgggatgctagtacgcaatccactctctcggaacagtacacatgaaatgtactggatctcgaatggaaccggcaacatcgtggcaagcgtcaatatggtgtccagactgttgctgaaccgttttactatgacgcacaggcggcccacaattgagaaggacgttgatctcggtgccgggacccgccatgtgaacgctgaaccggagactcctaatatggacgtcataggagagcgaatcaaaagaattaaggaagagcacaactctacctggcactatgacgatgaaaatccatacaaaacatgggcgtatcatggctcatacgaggtgaaggccacgggcagcgcatccagtatgatcaacggggtagtgaagcttctgaccaaaccctgggacgttgtccctatggtgattcagatggctatgactgatacaaccccattcggacagcaaagggtgtttaaggaaaaagtcgacactcggacaccccgctctatgccgggtaccagaagggttatgggcatcacagccgagtggttatggcgaactctggggcggaataagaaacctcgtttgtgcaccagagaggaattcacgaagaaggtgcgcaccaacgcagccatgggagctgtatttacagaggaaaatcagtgggatagcgccaaagcggcagtggaggacgaagatttctggaagctcgtcgacagggagcgggagctgcacaaactaggcaagtgtggttcatgcgtgtataacatgatggggaaaagagaaaagaaacttggagagtttggcaaggccaagggctcccgcgctatatggtacatgtggctgggggccaggtacctcgaattcgaggcactgggatttttgaatgaggatcattggttcagtcgagaaaacagctattctggtgttgagggcgaagggctgcacaaactcggatacatccttcgggacatttccaagatccccggcggtgctatgtatgccgatgacactgctgggtgggacaccagaattacagaggatgacctgcataatgaagagaaaatcactcagcagatggatccagagcacaggcaattagccaacgcaatatttaagctgacctaccagaataaagtggtcaaggtgcagcgccctacgcccacaggaaccgtaatggacattatctcacgtaaggatcagcggggcagcggccaagttgggacttatggattgaacacattcaccaatatggaagcgcagctcatcagacagatggagggtgaaggcgtgctgtcgaaagccgacctagagaacccacacctttctgaaaagaaaattactcagtggctggagaccaagggggtcgagaggctcaaacgcatggctataagtggagatgactgcgtggtgaagcccatcgatgaccgatttgccaacgcactgttggctttaaatgatatgggcaaggtccggaaagacattcctcaatggcagccatccaagggttggcatgattggcagcaggttccgttctgtagccaccatttccacgaactgatcatgaaagacgggagaaagctcgtggtaccctgcaggcctcaagacgagcttattggacgcgccagaatctcacagggcgcaggctggtccctgcgggaaacagcctgtctagggaaagcgtacgctcagatgtggtctctgatgtattttcacaggcgtgatctccgattggccagcaacgcaatatgcagtgccgtgccagtccattgggtgcccacgtcccgcaccacttggagcatccacgctcatcaccaatggatgacaaccgaggacatgctgactgtttggaatagagtgtggattgaagataacccttggatggaggacaagacaccagtcaccacgtgggagaatgtgccctaccttggaaagcgggaagatcagtggtgtggttctctgatcggcctcacatcaagggccacctgggcacagaacattcctactgctatccagcaagtacgcagtttaattgggaatgaggaattcctggactacatgccgtccatgaaaagatttcggaaggaggaggaaagcgagggagccatatggtga

SEQ ID NO: 15173 - RNA, 9873 nt, synthetic construct
  misc_feature 1..9873: note = derived and/or modified CDS sequence (opt3) from DENV-3__GU131878__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagctgatagagggaaaagtggtccagtatgaaaatctcaagtacacagtgattatcactgttcacaccggtgaccagcatcaggtgggcaacgagacacaaggggtcaccgcagaaattactccccaggcttccacgacagaggccatccttcctgaatatggaaccctgggcttggagtgctctccaagaactggtctagacttcaatgagatgatcctgctcaccatgaaaaacaaggcgtggatggtgcacaggcagtggtttttcgatctgccgcttccctggacaagcggggccaccactgaaacacctacgtggaatcggaaagagctgttggtaacctttaagaacgcacatgctaaaaagcaagaagttgtggtcctcggctcccaggagggagccatgcacactgctctgacaggcgccaccgaaattcagaattcagggggaacaagtatattcgcaggtcacttaaagtgtcgtctgaaaatggacaagctagagctcaaaggcatgagctacgccatgtgcactaacacctttgtgctgaagaaagaggtctctgaaacgcagcatgggaccatccttattaaggtggagtacaagggagaagatgctccatgtaaaatccccttctccacagaggacggccaaggtaaggcgcacaacgggcgcttgataactgcaaatcctgttgtgaccaaaaaggaggaaccagtaaacattgaggccgaacccccgttcggcgagtcaaatatcgtcatcggaacaggcgataacgctctgaaaattaattggtataagaaggggagcagtatcggaaaaatgtttgaagccactgcaagaggtgccaggcggatggctattctcggcgacaccgcctgggatttcgggtctgtgggaggcgttctgaactcccttggtaagatggtgcatcagatatttgggagcgcatacacggcgctgttctcgggcgtctcttgggtgatgaaaatcggaattggcgtattgctcacatggatcgggctgaattccaagaacacctcaatgagttttagctgcatcgctattggaataatcactttatatctgggcgccgtggttcaggcagacatgggttgtgtcattaattggaaagggaaggagctaaagtgcggatccggcatcttcgtgacaaacgaggtgcacacctggactgaacagtacaaatttcaagccgattctcctaagcgactcgctaccgccattgcaggtgcttgggagaatggcgtctgtgggatccgcagcacaacgagaatggaaaacctgctttggaaacagatagccaatgagttgaactatatcctgtgggaaaataacattaagctcaccgttgtggtgggagacatcattggcgtactggagcaggggaaaaggactttaacaccccagccaatggagctgaagtactcatggaaaacctggggaaaggcgaagatcgtcacagccgaaactcaaaacagttccttcataattgatggccctaatacccccgagtgcccaagcgcttctcgggcatggaacgtgtgggaagttgaggactatggttttggggtgttcacgacaaatatctggcttaaattgcgcgaagtctacacccagctctgtgaccatagactgatgtcagccgctgtgaaggatgagagggccgttcacgcagacatgggatactggattgagagtcagaaaaacggcagctggaagctagaaaaagcgtccctgatcgaggtgaagacttgcacctggcccaagtctcacacactctggtcgaatggtgtactggaaagcgatatgataatccctaaatcccttgccggcccaatttcacagcataaccaccgtccggggtatcatactcaaaccgctggaccctggcacttgggcaagctggagttagactttaattactgcgaggggacaacggtcgtgatcaccgaaaactgtggaactcggggccctagtctccgaacaaccactgtgtctggtaaactgattcacgagtggtgctgtagaagctgcacacttccacccctgaggtatatgggggaagatggatgttggtacggcatggagatccgccctatatccgaaaaggaggagaatatggtcaaatcattggttagcgccggttctggcaaggtggacaacttcaccatgggggtactctgcctggcaattctatttgaagaggtgatgcggggaaagttcggcaaaaagcatatgatcgctggggtcttctttacgttcgtgctgctcctgtccggacagatcacttggagagatatggcccacacccttattatgatcggcagtaatgcaagcgacaggatgggtatgggggttacatatttggccctgattgctacctttaaaatacagccattcttagcgctcggatttttcctgcgcaagcttacttctcgagaaaacctgctactcggcgtgggcctggccatggcaacaaccttgcaactgcccgaggatatcgaacagatggctaatgggattgccttaggactcatggccctgaaacttatcacacagtttgagacttaccagctgtggaccgctttgatttccctcacgtgttcaaacacaatgttcaccctgactgtcgcatggcggaccgccacactaatcctggcgggtgtgagtcttctcccggtttgccaaagctcgtccatgcgtaagactgactggctgcctatggctgtggccgcaatgggcgtcccacccttgcctctgtttatattctctttaaaggataccctcaaaagaaggagctggcccctgaatgagggggtaatggccgtgggacttgtttcaatcctggctagttccttgctccgcaacgacgtgccaatggcaggccctctggtcgccggtgggctactgattgcgtgttatgtgatcacgggaacatctgctgatcttaccgtagaaaaggccgcagacattacttgggaggaagaggccgaacagacaggcgtgagccataacctcatgatcaccgtcgacgatgacggcactatgcggataaaagatgacgagacagagaatattctgaccgttttgttaaagacggctctgctcatcgtgtccggggtgtttccctactcaatcccagccactctgcttgtctggcacacctggcagaaacagacacaaagaagcggagtgctgtgggatgttccgagtcctcccgaaacccagaaggcagagttggaagagggtgtatacaggattaaacagcagggcatattcgggaagacacaagtgggagtcggcgtgcagaaggagggtgtttttcatactatgtggcacgtgacccgaggggctgtcctaacgtataacggaaaacgcctggaaccaaattgggcctctgtgaagaaagacctcatctcctacggcggcgggtggcggctgagcgcgcagtggcaaaagggagaggaagtacaggtcattgccgtggagcccggtaaaaaccctaagaatttccagacaatgccaggcactttccagaccacaaccggggaaatcggagcaattgctcttgattttaagcccggcacttcgggttcacctatcataaacagagaggggaaagttgtgggattatatggcaatggcgtcgtgaccaagaacgggggatacgtttctggtatcgcccaaacaaatgctgagccggacggcccaacgcccgaactggaggaagagatgttcaaaaagaggaacctcactattatggatttgcaccctgggagtggaaaaacccgtaagtatctgccagcaatcgtgcgcgaagccattaagcggagactcaggacactgatccttgcccccacccgagtcgtggctgcggagatggaggaagcactgaaaggcttgcctatacggtaccagactacagccaccaagtccgagcatacgggtcgcgaaattgtagacctaatgtgccacgctacttttacaatgagactgctcagcccggtgagggttcccaattataacttaatcatcatggatgaggcccatttcaccgacccagcatctattgccgctcgggggtacatcagcacccgagtcggaatgggcgaagcggccgcaatatttatgactgctacacctcccggcaccgccgatgcattcccacagtccaatgcccctattcaggacgaggagagagacatccccgaacgctcatggaacagtgggaatgagtggattacagattttgctggaaaaactgtgtggttcgtgccaagcatcaaggccggtaacgacatagcgaactgtctgaggaaaaatggcaagaaggtcattcaactttctcgtaaaacgtttgataccgaataccagaagacaaaactgaacgactgggatttcgtagtgactaccgacatctccgagatgggggcaaattttaaggccgatcgggttatcgacccgagaaggtgcctcaaacctgtgattttgacagatggacccgagcgcgtcatcctggctggcccaatgcccgtgaccgccgcttcagcagcccagcgaagaggtcgggttgggaggaaccctcagaaggaaaatgaccaatatattttcactggccagccactcaacaatgatgaggaccacgctcattggacggaagccaagatgctgcttgacaacataaatacccccgagggaatcattcctgcactattcgaaccggagcgcgagaaaagtgcggccatcgatggcgaataccgtctgaagggggagagcagaaaaacatttgtggaattgatgcggaggggagacttaccagtctggctggctcacaaggtggcctccgagggtatcaaatatactgatcgcaagtggtgcttcgacggccagcgaaacaatcagattctcgaagagaacatggatgtagagatatggaccaaagaaggggagaagaagaaactgagaccccggtggcttgacgcaaggacatactctgatcctctggctctcaaggaatttaaagacttcgccgcaggacgcaagtcgatcgccttggatctggtgaccgagattggcagagttcccagccacctagctcataggactcggaatgcgctggacaacctcgtcatgcttcacacatcagaacatggtgggcgtgcctatcgccacgcagtggaggagctgccagaaacgatggagaccttattgctgctcggcctgatgatccttctgactggaggcgctatgctctttttgatttccgggaaaggaatcggtaagacaagtataggcctgatctgtgtgattgcctctagcgggatgttatggatggccgcaatccctctacaatggattgcttccgccatcgtcctggaattctttatgatggttctccttatacccgagccagagaagcagcgaacccctcaggataatcaactggcgtacgtggtaattggaatcttgaccctggctgccattatcgcagccaacgaaatgggcctcctggagacaactaaaagagaccttggtatgtcaaaggaaccgggggtggtctctcccacgagctatctcgatgtggacctgcacccagctagtgcatggaccttgtacgccgttgcgacaactgtgataacccctatgctgaggcatacaatcgagaattccaccgctaacgtcagcttagccgcaattgccaaccaggctgtagtgctaatgggcctggacaaaggatggcccatctctaagatggatctcggcgttccacttctggccttggggtgctactcacaggtgaatcctctgactctcacggcagctgtcctgcttttaattacacactatgccatcataggacccggcctgcaggcgaaagccacccgggaagcacaaaagcgcactgctgccggtattatgaagaacccgaccgtggacgggatcatgacaatcgatctcgacccagtcatttacgattccaaattcgagaagcagttgggacaggtgatgctgctagttctgtgtgcagtgcagctccttctgatgagaactagttgggctttgtgcgaggccctgaccctcgccacaggccctatcacgaccctgtgggaaggtagccccggcaaattttggaatactacaatagcggtatcgatggctaacattttcagggggtcttatttagcaggagccggccttgctttttccatcatgaagagcgtggggaccggaaaacggggcactggttcacaaggggagacactgggagaaaagtggaagaaaaagctcaatcagctaagtcgaaaagagttcgacctgtacaagaaatctggcattaccgaagtcgatagaacggaggccaaggagggtttgaaacgcggcgaaatcacccatcacgcagtttccagggggagcgccaagctgcagtggtttgtggagcggaacatggtcataccagaaggacgtgtgatcgacctcggctgtgggagaggaggctggtcatattactgcgctggtcttaagaaagtaacagaggtgagggggtatactaagggaggccccggccatgaagagcctgttccgatgagtacctacgggtggaatattgtgaaactgatgagcggaaaggatgtcttctacttgcccccagagaaatgtgacacactgctctgcgatatcggtgaatcctctcctagccccactgtggaggaatcccgcaccattcgggtcttaaagatggtggagccttggctgaagaacaatcagttctgtatcaaagttcttaacccatatatgcccacagtaattgagcacctggaacgactacaaagaaagcacggcgggatgctcgtgaggaatcctctgtcacgcaactctacccatgagatgtactggatcagtaatggaactggcaacatagtcgcgtcggtgaatatggttagccggttgctgctcaacagatttacgatgacacaccgtaggccaaccattgaaaaagacgtggatcttggtgccgggactcggcatgtcaacgcagagcccgaaaccccgaatatggacgtgatcggagagcgcatcaagcgaattaaagaggaacacaactccacatggcactatgacgatgagaatccttacaagacgtgggcttatcatggctcttacgaagtaaaggccaccggctcagcaagctccatgataaacggggtggttaaactgttaactaagccatgggacgtcgtgcccatggtgacacagatggccatgaccgatactacacctttcggacagcaaagagtctttaaagagaaggttgacaccaggacaccacggagtatgcccggtactcgcagagtgatgggcatcaccgctgaatggctgtggaggacgttggggcgaaataaaaagccgcggctctgcacccgtgaggagttcacaaagaaagtaagaactaacgccgcgatgggagcagtgtttaccgaagagaatcagtgggattctgccaaggctgccgtcgaagacgaggatttctggaaactggtggaccgcgaaagggagctacacaagcttggcaaatgtggtagctgcgtttataacatgatggggaagcgggagaaaaagctgggagaatttggcaaggcaaaaggctcaagagctatttggtacatgtggctcggggcccgctacctggagttcgaagctttgggatttctgaatgaggatcattggttctccagggagaacagttatagcggtgtggaaggcgaggggctccacaagcttggatacatcctgcgagacatttctaaaatccctggcggtgccatgtatgcagatgacacagcggggtgggacactcggataaccgaagatgacttacataatgaggaaaagatcacgcagcagatggatcccgagcacagacaactggccaacgctatttttaaattgacataccagaataaggtcgtgaaggtacagaggccaacccctactggaacagttatggacatcatttcccgcaaagatcagcgtggctcaggccaagtggggacctatggactcaacactttcaccaatatggaggcccagctgatccggcagatggaaggtgagggcgtcctaagcaaggcagaccttgaaaacccccacctgccagagaaaaagataacacagtggctcgaaacgaaaggggtggagagactgaagaggatggctatttcgggagatgactgcgtggtcaagcccatcgatgaccgctttgccaacgcattgttagccctgaatgatatgggcaaagttcgaaaggacatccctcaatggcagccatctaaaggttggcatgattggcagcaggtgccgttctgtagtcaccatttccacgagctcattatgaaggacgggcggaaacttgtagtgccctgcagacctcaagacgaactgataggaagggcgcgcatctcccagggcgctggctggagcctaagagagaccgcctgtctggggaaggcatacgcccagatgtggtcactcatgtattttcaccggagggatttgcgtctggcttccaacgccatttgctctgcagtcccagtgcattgggttcccactagccgaacaacctggagtatccacgctcatcaccaatggatgactacagaagacatgcttaccgtgtggaatcgcgtctggattgaggataacccttggatggaagacaagacgccagtgacaacctgggagaatgtaccctacctgggaaaaagagaggatcagtggtgtggttccctcatcggcttaactagccgggccacctgggcgcagaacatacctacagctatccagcaagttaggtctctgattgggaatgaagagttcttggactacatgccgtcaatgaagcgctttagaaaagaagaggagagtgaaggagccatctggtga

SEQ ID NO: 15174 - RNA, 9873 nt, synthetic construct
  misc_feature 1..9873: note = derived and/or modified CDS sequence (opt3) from DENV-3__FJ898455__SS-prME
  source 1..9873: mol_type = other RNA
accagcctgtgcctcatgatgatgcttcccgccacactggctttccacttgacttcccgagacggagaacctaggatgatcgtggggaagaacgaacggggaaaatctttactgtttaagacggcatcaggtattaatatgtgtaccctgatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagaacgcaaacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaaccgggacttcgttgaaggattgtcaggtgctacgtgggtggatgtcgtgctggagcatggcgggtgcgtgactacaatggccaagaataaacccaccctcgacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctactgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacaatcgtcgttggagacgtgataggcgtgctggagcaggggaaacgcacgttaacaccccaaccaatggagctgaagtatagttggaagacttggggaaaagcgaagattgtaacagccgaaacccaaaattccagctttatcattgatggccctaacacacccgagtgcccatctgcttcaagagcatggaacgtctgggaagtggaggactacggtttcggggtttttactaccaatatctggcttaaattgagggaaatgtatacgcagctctgtgaccaccggctgatgagtgccgctgtgaaggatgagcgcgccgtccacgcagacatgggatactggatagagagccagaaaaacggctcctggaagctagaaaaggcgtctctgatcgaggtgaaaacatgcacctggcccaagtcgcatactctctggagcaatggtgttctggaatccgatatgattatccctaaatcacttgccggcccaattagtcagcacaactacagaccggggtatcatacccaaacagctggaccctggcacttgggcaagctggagttagacttcaattactgcgaggggactaccgtggtaatcacagaaaactgtggaacgaggggcccttctctccgtaccactacagtcagcggtaaactgatacacgagtggtgctgtcggtcctgcacccttccacccctgcgatatatgggggaagatggatgttggtacggcatggagattagacctatcaatgaaaaggaggagaacatggtgaagtcattggtgagcgccggttctggcaaagcagacaattttactatgggggtcctctgcctggctatcctattcgaagaggttatgaggggaaagttcggcaaaaagcatatgattgccggggcactgtttacattcgtgctcctgctttccggacagatcacctggcgcgatatggcccacacgttgattatgataggcagtaacgctagcgaccggatgggtatgggggtaacttatctggcgttaatcgccacctttaaaattcagccattcctcgcactgggatttttccttagaaagctgacatctagggaaaatctactcctgggcgtgggcttggctatggccaccactctgcaattacccgaggatatcgaacagatggccaacgggattgctctcggactgatggcacttaagctgatcacacagtttgagacctaccagttgtggacagccctcgtctccctgatgtgttcaaatactatattcaccctaacggtggcgtggcgcacagctaccctgatccttgccgttattagtctcctgccggtgtgccaaagctcgtccatgcgaaaaactgactggttgcctatgaccgtcgcagccatgggtgtgccacccctgcctttatttatcttctctctcaaggatacactgaaacggcgtagctggccccttaacgagggcgttatggctgtggggctggtctcaattttggcaagttcctttctcagaaatgacgtaccaatggccggacctctggtggcgggcggtctactgatcgcttgttatgttataactgggacctctgccgatcttacggtggaaaaggcagccgacgtcacatgggaggaagaggctgaacagaccggagtgagccataacctcatgattactgtagacgatgacggcacaatgaggatcaaagatgacgagaccgagaacatcctgactgtgttgttaaagacagccctgctcattgtctccggcatattcccctactcaatcccagcaaccctgcttgtttggcacacgtggcagaaacagactcaacgcagcggggtgctgtgggatgtgccgagtcctcccgaaacccagaaggctgagttggaagagggagtctaccggattaagcagcagggtatctttggcaaaacacaagtgggggttggagtacataaggagggcgtgttccacaccatgtggcacgtcacaagaggtgccgtgctaactcataatgggaaaaggctggaaccaaactgggcgaatgttaagaaagacctcatttcttatggaggcggctggaagctgtccgcccagtggcagaagggggaggaagtgcaagtcatcgcagtggagcccggcaagaaccctaagaatttccagaccatgccaggtatatttcagacgacaactggcgaaatcggggctattgcccttgatttcaaacccggaaccagcggctcgcctatcattaaccgagagggtaaggtagtcgggttatacggaaatggcgtggttaccaagaacggcgggtatgtgtcaggaatcgctcagaccaatgcagagccggacggtccaactcccgaactggaggaagagatgtttaagaagcgcaacctcaccataatggatttgcaccctggctctgggaaaacacggaagtacctgccagccattgtcagagaagccatcaaaaggcgtctccgcacgctgatccttgctcccactcgggtggttgcggcagagatggaggaagccctgaagggattgcctattagatatcaaaccacagctaccaaaagtgagcatactggcagggaaatcgtggacctaatgtgccacgccacattcaccatgcgactgctctccccggtccgggtgcccaattacaacttaatagtaatggatgaggcacattttacggacccagccagcattgctgcgcgcggttatatctctactagagtggggatgggagaagccgcagctattttcatgacagccacccctcccggcaccgcagatgcctttccacagagcaatgctcctatccaggacgaggagagggacatacccgaacggtcctggaactcaggcaatgagtggattactgatttcgccgggaagacagtttggtttgtcccaagtatcaaggcgggaaacgacatcgcaaactgtctgagaaagaatggtaagaaagtgattcagcttagcagaaagaccttcgatacagaataccagaagactaagctgaacgactgggattttgtggtcacgaccgacatctctgagatgggcgccaatttcaaggctgatcgcgtaattgacccgaggcgttgcctcaaacctgtgatattgacagatgggcccgagcgggttatcctggccggaccaatgcccgtgactgtcgcttccgcagcccagagaaggggccgcgtgggtcgaaaccctcagaaggaaaatgaccagtacattttcaccgggcaaccactcaacaatgatgaggaccacgctcactggacagaagccaaaatgctgcttgacaacatcaatacccccgagggcatcattcctgcactatttgaaccggagagagagaagtcagcggccatagatggagaatatcggctgaaaggcgagagtaggaagactttcgttgaattgatgcgccgtggggacttaccagtgtggctggctcataaagtcgccagcgagggaatcaagtacacggatagaaagtggtgctttgacggtgaacggaacaatcagattctcgaggagaacatggatgtggaaatctggaccaaagagggcgaaaggaagaaactgcgcccccgatggcttgacgcaagaacatattccgatcctctggctctcaaggagttcaaagactttgccgcagggcggaagtctattgccttggatctggtaactgaaatcggaagggtgccctcgcacctagctcatcgcaccagaaatgcgctggacaacctcgttatgcttcacacaagcgagcacggcggtagggcctaccggcatgcagtcgaggaactgccagagaccatggaaactttattgctgctcgggctgatgatacttctgacaggcggagctatgctattcttgatctcaggcaaggggattggaaaaacgtccatcggtctgatttgtgtggtggccagttctggcatgttatggatggccgatgtccctctacagtggatcgcaagcgctatagttctggagtttttcatgatggtgctccttattcccgagccagaaaagcagcgtacccctcaagacaatcagctggcctatgtagtgatcgggattttgactctggcggctatcgtcgccgcaaacgagatgggactcctggaaacaaccaaacgcgatcttggcatgtccaaggagccgggtgtggtttcacccacctcttacctcgacgtggacctgcacccagccagcgcttggacattgtatgcagtcgccactacggtaataacccctatgctgcgacatacaatcgaaaatagtactgcgaacgtgtccttagctgccattgcaaaccaggccgttgtgctaatggggctggataaaggctggcccatcagcaagatggacctcggagtcccacttctggctttgggctgctactctcaagtgaatcctctgaccctcacagccgcagtcctgcttttagtgacccactacgctattatcgggcccggactgcaggccaaggcgactagagaggcccagaaaaggacggcagctggcataatgaagaacccgacagttgatggtattatgaccatcgacctcgatccagtgatctatgactcaaaatttgagaagcagttggggcaagtaatgctgctagtgctgtgtgccgtccagctccttctgatgcggacttcctgggcattctgcgaggctttgaccctggccacaggacctattactaccctctgggaaggcagtcccggtaaattttggaatacaacgatcgccgttagcatggcgaacatattccgcggctcgtacctggctggggcaggattagccttttctattatgaagtccgtgggcaccgggaagagaggaactggcagccagggtgaaacacttggggagaaatggaagaaaaagctgaatcagctctcaaggaaagagttcgatctatataagaaaagtggaatcaccgaggtcgaccggactgaggctaaggaaggcctgaagcgaggtgagattacacatcacgccgtgtctagaggctccgcaaaattgcaatggttcgtagaacgcaacatggtgatcccagaggggagggttatagatctgggatgtggcagagggggatggagctactattgcgccggcctcaagaaagtgaccgaagtccgtggttacacgaaagggggacccggccacgaggagcctgtgccgatgtcaacctatggctggaatatcgtcaaacttatgagtgggaaggacgtgttttacctgcccccagaaaagtgtgatacattgctgtgcgacattggagagagctccccttctcccactgttgaagagagcagaaccatcagggtactcaaaatggtggagccttggttaaagaacaatcagttctgtattaaagtcctgaacccatacatgcccacagtgatcgaacatcttgagcgcctgcagcggaagcacggtggcatgctagttcgaaatcctctctccagaaactcaactcatgaaatgtattggatttctaatgggaccggaaacatcgtgagttcggtcaatatggtgagcaggctgttgctgaaccgctttacaatgacccaccggagaccaactatagagaaagatgtagacctcggcgctggtacgcgtcacgtgaacgcggaacccgagacaccgaatatggacgttattggggagaggatccggcgcatcaaggaagaacattcctctacctggcactacgatgacgaaaacccttataagacttgggcctaccatggatcatatgaggtcaaagcaaccggcagcgcttccagtatgattaatggcgtggtgaaacttctgacaaaaccatgggatgtcgttcccatggtgacgcagatggccatgaccgacactacacctttcgggcaacagcgagtatttaaggaaaaagtggataccagaactccaaggcccatgccgggaacacggaaggtcatggagataaccgcagagtggttatggcgcacactgggtagaaacaagaggcctcgattgtgcactcgggaagagttcatcaaaaaggtgcgtaccaatgccgctatgggcgccgtttttacggaagagaaccagtgggactctgcgagagcagccgtggaagatgaggagttctggaaactcgtcgaccgcgaaagggagctgcacaagctagggaaatgtggaagctgcgtgtacaatatgatgggcaagcgggagaagaaacttggtgagtttgggaaagctaaaggatcaagagccatttggtatatgtggctgggcgcacgctacctcgagttcgaagctctgggctttttgaacgaggatcattggttctccagggaaaatagttacagcggggtagagggagaaggtctgcacaagctcggctatatccttcgagacatttctaaaatccccgggggagccatgtacgctgatgacaccgccggctgggacacacggataactgaggatgacctgcacaacgaggaaaagatcacccaacagatggatccagagcatagacagttagcaaatgcgatttttaaactgacatatcagaacaaggttgtgaaggtccaaaggcctactcccaaaggtaccgtgatggacatcatttcccgcaaggatcagcgtgggtcaggacaggtgggcacgtacggcttgaatacattcaccaacatggaagcccagctcatccggcaaatggagggggaaggagtcctgagcaaagctgacctagagaatccacaccttctggagaagaaagttactcagtggctcgaaacaaagggtgtggagagactgaagaggatggccatatcgggcgatgactgcgtagtgaaacccattgatgaccgcttcgcaaacgctttgttagccctgaacgatatggggaaggtccgaaaagacatccctcagtggcagccatctaagggatggcatgattggcaacaggtgccgttttgtagtcaccacttccatgaactcatcatgaaagacggccggaaacttgttgtgccctgcagacctcaggacgagctgattggtagggcacgcatatcccagggggccggatggagcctaagagaaaccgcgtgtctgggcaaggcttatgcccaaatgtgggcactcatgtactttcaccggagggatttgcgtctggcctcaaatgctatctgctccgccgtcccagtgcattgggtacccacttctcgaaccacatggagcattcacgcacatcaccagtggatgacgaccgaggacatgcttactgtttggaaccgcgtgtggatcgaggataatccttggatggaagacaaaacaccagtcaccacttgggaggatgtgccctatctgggcaagagagaagaccagtggtgtgggagtctcattggattaacatcccgggctacctgggcccaaaacatcctgacggcgatacagcaggttaggagcttgatcggtaatgaggagttcctggattacatgccttctatgaaacgctttagaaaggaagaggaatcagagggcgctatttggtga

SEQ ID NO: 15175 - RNA, 9873 nt, synthetic construct
  misc_feature 1..9873: note = derived and/or modified CDS sequence (opt3) from DENV-3__GQ199891__SS-prME
  source 1..9873: mol_type = other RNA
accagcctgtgcctcatgatgatccttcccgcagctctggcattccacttgacatccagagacggcgagcctaggatgattgtggggaagaacgaacggggaaaatctttactgtttaagactgcatcaggtataaatatgtgtacgctaatcgcgatggatctcggcgaaatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggccgttatattcatcttactgatgcttgtgaccccatcgatgacaatgcgctgtgtcggcgtggggaacagagactttgtagaaggattgtcaggtgcgacctgggttgatgtggtcctggagcacggcgggtgcgtgacgactatggcaaagaataaacccacactagacattgagctccagaagaccgaagccactcagctggctacacttaggaaactgtgtatcgagggaaagattaccaacatcacgaccgatagccggtgccctacacagggcgaagccgtgttgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcaaaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgccggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgcttctagggcatggaacgtgtgggaagttgaggactatggttttggggtgttcaccacgaatatttggctgaaacttcgggaagtctacacacagttgtgtgaccaccgcctcatgtcagccgctgtgaaggatgagagagccgttcacgcagacatgggatactggatcgagagtcagaaaaacggcagctggaagctggaaaaagcgtccctaatagaggtgaagacctgcacttggcctaagtctcataccctgtggtcgaatggtgtactcgaaagcgatatgatcattccaaaatccctggccggcccgatctcacagcacaactataggcccgggtaccatacacaaactgctggaccttggcaccttggcaagttggagctggactttaattattgcgaggggaccacagtcgtgattacggaaaactgtggaacccgtggcccaagtttacggactacaaccgtgtctggtaaactcatccacgagtggtgctgtcgaagctgcactctgccccctcttagatacatgggggaagatggatgttggtatggcatggagataaggccaatttccgaaaaggaggagaatatggtcaaatcactggttagcgccggttctggcgaagtggacaacttcacaatgggggtattgtgcctcgcaatcctgtttgaggaagtgatgcgcggaaagttcggcaagaaacatatgatcgctggggtcttctttaccttcgtgctactgctctccggacagattacgtggcgggatatggcccacactctgatcatgattggcagtaatgcaagcgacagaatgggtatgggggttacctaccttgccttgatagctacatttaagatccagcccttcctggcgttaggatttttcctcaggaaactgacctctcgcgagaaccttctgctaggcgtgggcctcgccatggcaactacactgcaattgccggaagatattgagcagatggctaatgggatcgccctgggattaatggccctcaagctgattacccagtttgagacatatcagctttggactgctctgatctccttgacctgttcaaacacgatattcacactcaccgtcgcatggcgaactgccaccctgatcctagcgggtgtgagtctgcttcctgtttgccaaagctcgtccatgcggaaaacagactggctcccaatgactgtggctgccatgggcgtcccacctctgcccttgtttattttctctctgaaggataccttaaagcgtagaagctggccactcaatgaaggggtaatggcagtgggactggtttcaatccttgccagttccctgttgaggaacgacgtgcctatggctggccccctcgtcgccggtgggctgctaattgcctgttacgtgatcacgggaacatctgcggatctgaccgtagagaaagctgccgacgtgacttgggaagaggaagcagagcagacaggcgtcagccataaccttatgataaccgttgacgatgacggcactatgcgcattaaggatgacgagacagaaaatatcctcaccgtgctgttgaaaacggccttactgatcgtgtccgggatttttccatactcaataccggctactctcctggtctggcacacctggcagaagcagacacaacggagcggagtgctttgggatgttcctagtcccccagagacccagaaagccgaactggaggagggtgtatatagaatcaagcagcagggcattttcgggaaaacacaagtgggagtcggcgtgcagaaggaaggtgtttttcatactatgtggcacgtgaccagaggggcagtcttgacgtacaacggaaagcgactagagcccaattgggcttctgtgaaaaaggacctgatctcctatggcggcgggtggcgcctcagcgcccagtggcaaaaaggagaagaggtacaggtcattgcggtggaacctggtaagaaccccaagaatttccagacaatgcccggcactttccagaccacaaccggggagatcggagccatagcactggattttaagcctggcacttcgggttcaccgatcattaaccgggaggggaaggttgtgggactttacggcaatggcgtcgtgaccaaaaacgggggatatgtttctggtatcgctcaaacaaatgccgaaccagacggccccacgcctgagttagaagaggaaatgttcaagaaaagaaacctgactattatggatctccacccagggagtggaaagaccaggaaatacttgcccgctatcgtgcgtgaggcaataaagcgccggctgagaacactcattctggcccctaccagggtcgtggccgctgagatggaagaggcgcttaagggcctgccgatccgatatcagactacagcaaccaaatccgaacatacgggtcgggagatcgtagacttgatgtgccacgccacttttacaatgcgcctactgagccccgtgagagttccaaattacaacctcattatcatggatgaagctcatttcaccgaccctgcctctatagcagccagggggtacattagcacccgggtcggaatgggcgaggctgcggccatctttatgactgcaacacccccaggcaccgctgatgccttccctcagtccaatgcacccattcaggacgaggaacgagacatcccagagagatcatggaacagtgggaatgaatggataacagattttgccggaaagactgtgtggttcgtgccgagcattaaagctggtaacgacatcgccaactgtttacgcaagaatggcaaaaaggtcatccaactgtctaggaagacgtttgataccgagtatcagaaaacaaaacttaacgactgggatttcgtagtgactaccgacatttccgagatgggggcgaattttaaagcagatcgtgttatcgaccctcggagatgcctgaagcccgtgattctcacagatggaccagaaagggtcatattggccggccccatgcctgtgaccgctgcctcagctgcacagcgccgaggtagagttgggcggaacccacagaaagagaatgaccaatacatcttcactggccagcccctgaacaatgatgaagaccacgcccattggacggaggctaagatgctcctggacaacattaatacccctgaaggaatcatcccggcccttttcgagccagagagggaaaagagtgcagcgattgatggcgagtatcgcctaaaaggggaaagccgtaagacatttgtggagctgatgagacggggagacttgcccgtctggttagcccacaaagtggcttccgaaggtataaagtacactgataggaaatggtgcttcgacggccagcgcaacaatcagatcctggaggagaacatggatgtagaaatttggaccaaggagggggagaagaagaagctccgacctagatggctggacgcccggacatattctgatccccttgcactgaaagagtttaaggacttcgctgccggaaggaaatcgatcgcactcgatttggtgaccgaaattggccgcgttccaactcacctggcccatagaacaaggaatgctctagacaacctggtcatgctccacacgagcgagcatggtgggaaggcgtaccggcacgccgtggaggaacttcctgagaccatggaaactctgttattgctgggcctcatgatcctgcttacaggaggcgcaatgctgtttctcatatcagggaaaggaatcggtaagacctccattggcttgatctgtgtgattgctagttctgggatgctgtggatggccgagatccccttacaatggatagccagcgcaattgtcctagagttctttatgatggttctgctcatcccagaacctgagaagcagcgtaccccgcaggataatcaacttgcttatgtggtaattggaatcctgacattggccgcgataatcgctgccaacgaaatgggcctgctcgagactacgaaacgcgacctgggtatgtccaaggaacccggggtggtctcaccaacctcttaccttgatgtggacctccaccctgcaagcgcctggacactgtacgctgttgcaactaccgtgattacacccatgttgcgacataccatcgagaatagtactgccaacgtctccctggcggctattgccaaccaggcagtagtgttaatgggcctagacaaaggatggccaatcagcaagatggatctgggcgttcctctccttgccctggggtgctattctcaggtgaatcccttgacgctgacagctgccgtcctcctgcttataacccactacgcaattatcggaccgggcttacaggctaaagccactagagaggcgcaaaagaggaccgccgcaggtatcatgaagaacccaacagtggacgggattatgactatcgatctggaccctgtcatatatgattcaaaattcgaaaagcagctcggacaggtgatgttgctggttctatgtgctgtgcagctgctccttatgcggacctcctgggccctgtgcgaggcattgacactggctacgggccccattaccactctctgggaaggtagtccaggcaaattttggaatacaaccatcgccgtaagcatggccaacattttccgcgggtcgtacctggcgggagctggcttagcattttctatcatgaagtccgtggggactggaaaaagaggcacaggtagccaaggggagacccttggagaaaagtggaagaaaaagctgaatcagctctcaaggaaagagttcgacctatataagaaaagtggcataacggaggtcgatcggaccgaagccaaggagggtctgaaacgaggcgaaatcacacatcacgctgtttctagagggtccgccaagttgcagtggtttgtggagcgcaacatggtcattcccgaaggaagggtgatcgacctgggctgtgggcggggaggctggagctactattgcgcaggtctcaagaaagtaactgaggtgcgtgggtacaccaagggaggccctggccatgaggaaccggttcccatgtcaacatacgggtggaatattgtgaaacttatgagtggaaaggatgtcttctatctgccacctgagaaatgtgacactttgctgtgcgatatcggtgaaagctccccctctcctaccgtggaggagagcagaacaattagggtcctcaagatggtggaaccatggttaaagaacaatcagttctgtatcaaagttctgaacccctacatgcctaccgtaatagagcaccttgaacgcctgcaacggaagcacggcgggatgctagtgcgaaatccactctccagaaactcaactcatgagatgtattggatttctaatggaacgggcaacatcgtcgccagtgtgaatatggtttcgaggctgttgctgaaccgctttacaatgacccaccggagacccactatcgaaaaagacgtggatctcggtgctgggacccgtcatgtcaacgcggagccggagacacctaatatggacgtgattggagaaaggataaagcggatcaaagaggaacacaacagcacgtggcactacgacgatgagaatccatataagacctgggcctaccatggctcctatgaagtaaaggcaactggctctgcttcaagcatgattaacggggtggttaaacttctgacaaagccctgggacgtcgtgcctatggtgacccagatggccatgactgatacaaccccattcggacagcaacgcgtctttaaagagaaggttgacacacgaactcccagatccatgccgggtaccaggcgggtgatgggcatcacggcagagtggttatggcgcaccctggggagaaataaaaagcctaggttgtgcacacgagaagagttcactaagaaagtacggaccaacgccgctatgggagccgtgtttacagaagagaatcagtgggatagtgcgaaggcagccgtcgaagacgaggatttctggaaactcgtggaccgtgagagagaactgcacaagctaggcaaatgtggttcttgcgtttacaacatgatggggaagcgcgagaagaaacttggagaatttggcaaagctaaaggcagcagggccatttggtacatgtggctgggggcacggtatctcgagttcgaggctctgggatttttgaatgaagatcattggttctcaagagagaactcctacagtggtgtggaaggcgaggggctgcacaagctcggatatatccttcgcgacataagcaaaatccccggcggtgccatgtacgctgatgacactgccgggtgggacaccaggattacggaagatgacctgcataatgaggagaagatcacacagcagatggatccagaacaccgacaattagcaaacgcgatttttaaactgacctatcagaataaggtcgtgaaggtacagcggcctactcccacaggaaccgttatggacatcatatctagaaaagatcagaggggctccggccaagtggggacttacggattgaacaccttcacaaatatggaggcccagctcattcgccagatggaaggtgagggcgtcctgtcaaaggctgacctagaaaacccacaccttcccgagaaaaagatcacgcagtggctggagaccaaaggggtggaacgtctcaagcggatggccatcagcggagatgactgcgtggtcaagcctattgatgacagatttgcaaacgctctgttggccttaaatgatatgggcaaagttaggaaggacataccacaatggcagccgtcgaaaggttggcatgattggcaacaggtgcccttctgttctcaccatttccacgagctgatcatgaaggacgggcgcaaactcgtagtgccttgccgaccacaagacgaacttattggacgggcaagaatcagtcagggcgccggctggtccctgagggagactgcgtgtctagggaaggcttatgcccagatgtggagcctgatgtactttcaccgcagagatctccggttggcatcaaacgccatttgctccgctgtccccgtgcattgggttcctacatctaggaccacttggagcatccacgcccatcaccaatggatgacaaccgaagacatgctgacggtgtggaatcgtgtctggatagaggataacccatggatggaggacaagacacccgtgaccacttgggaaaatgtaccttaccttggaaaacgagaggatcagtggtgtggtagtctgatcggcctcacctcccgcgcaacatgggctcagaacattccgactgccatccagcaagttaggagcttaattgggaatgaagagttcctggactatatgccatctatgaagcggtttaggaaagaggaagagtcagaaggagcgatctggtga

SEQ ID NO: 15176 - RNA, 9873 nt, synthetic construct
  misc_feature 1..9873: note = derived and/or modified CDS sequence (opt3) from DENV-3__FJ898443__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggccgttatattcatcttactgatgcttgtgaccccatcgatgacaatgcgctgtgtcggcgtggggaacagagactttgtagaaggattgtcaggtgcgacctgggttgatgtggtcctggagcacggcgggtgcgtgacgactatggcaaagaataaacccacactagacattgagctccagaagaccgaagccactcaactggctacacttaggaaactgtgtatcgagggaaagattaccaacatcacgaccgatagccggtgccctacacagggcgaagccgtgttgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcagaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaacaggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcaccagatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcatacctggactgaacagtacaaatttcaagccgattctcccaagcggctagctaccgccattgcaggtgcttgggagaatggcgtctgtgggatccgaagcacaacgcgcatggaaaacctcctgtggaaacagatagccaatgagcttaactatatcttgtgggaaaataacattaagctgaccgttgtggtgggagacatcattggcgtactcgagcaggggaaaagaactctgacaccacagcctatggagttaaagtactcatggaaaacctggggaaaggcgaagatcgtcacagccgaaactcaaaacagttccttcataattgatggccccaataccccagagtgccccagcgcttctagggcatggaacgtgtgggaagttgaggactatggttttggggtgttcacgacaaatatctggctgaaacttcgggaagtctacacccagttgtgtgaccaccgcctcatgtcagccgctgtgaaggatgagagagccgttcacgcagacatgggatactggattgagagtcagaaaaacggcagctggaagctggaaaaagcgtccctaatcgaggtgaagacttgcacctggcctaagtctcatacactgtggtcgaatggtgtactcgaaagcgatatgataatcccaaaatccctggccggcccgatttcacagcacaactataggcccgggtaccatactcaaaccgctggaccttggcaccttggcaagttggagctggactttaattattgcgaggggacaacggtcgtgatcaccgaaaactgtggaactcgtggcccaagtttacggacaaccactgtgtctggtaaactcattcacgagtggtgctgtcgaagctgcacactgccccctcttagatacatgggggaagatggatgttggtatggcatggagatcaggccaatatccgaaaaggaggagaatatggtcaaatcactggttagcgccggttctggcaaggtggacaacttcaccatgggggtattgtgcctcgcaattctgtttgaagaggtgatgcgcggaaagttcggcaaaaagcatatgatcgctggggtcttctttacgttcgtgctactgctctccggacagatcacttggcgggatatggcccacaccctgattatgatcggcagtaatgcaagcgacagaatgggtatgggggttacataccttgccttgattgctacctttaaaatacagcccttcctggcgttaggatttttcctcaggaagctgacttctcgcgaaaaccttctgctaggcgtgggcctcgccatggcaacaaccctgcaattgccggaggatatcgaacagatggctaatgggattgccctgggattaatggccctcaaactgatcacacagtttgagacttatcagctttggaccgctctgatttccttgacgtgttcaaacacaatcttcaccctcactgtcgcatggcgaaccgccacactgatactagcgggtgtgagtctgcttcctgtttgccaaagctcgtccatgcggaagactgactggctcccaatgaccgtggctgccatgggcgtcccccctctgcccttgtttatcttctctctgaaggatacgttaaaacgtagaagctggccactcaatgagggggtaatggcagtgggactggtttcaattcttgccagttccctgttgaggaacgacgtgcctatggctggccccctcgtcgcaggtgggctgctaatcgcctgttacgtgattacaggaacctctgcggatctgactgtagaaaaggctgccgacgtgacatgggaggaagaggcagaacagaccggcgtcagccataaccttatgatcactgttgacgatgacggcacaatgcgcataaaagatgacgagaccgagaatattctcacggtgctgttgaagactgccttactgatcgtgtccgggatctttccatactcaattccggctaccctcctggtctggcacacatggcagaaacagacccaacggagcggagtgctttgggatgttcctagtcccccagaaacacagaaggccgagctggaagagggtgtatatagaataaaacagcagggcatcttcgggaagactcaagtgggagtcggcgtgcagaaggagggtgtttttcataccatgtggcacgtgacgaggggggcagtcttgacatacaacggaaaacgactagaacccaattgggcttctgtgaagaaagacctgatttcctatggcggcgggtggcgcctcagcgcccagtggcaaaagggagaggaagtacaggtcatcgcggtggagcctggtaaaaacccaaagaatttccagactatgcccggcaccttccagacaaccactggggaaattggagccatcgcactggattttaagcctggcacctcgggttcaccgataatcaaccgggaggggaaagttgtgggactttacggcaatggcgtcgtgacaaagaacgggggatatgtttctggtattgctcaaacgaatgccgagccagacggccccactcctgaattagaggaagagatgttcaaaaagagaaacctgaccatcatggatctccacccagggagtggaaaaacaaggaagtacttgcccgctattgtgcgtgaagcaatcaagcgccggctgagaaccctcatactggcccctactagggtcgtggccgctgagatggaggaagcgcttaaaggcctgccgattcgatatcagacaaccgcaacgaagtccgagcatactggtcgggaaatcgtagacttgatgtgccacgccacatttaccatgcgcctactgagccccgtgagagttccaaattacaacctcatcattatggatgaggctcatttcaccgaccctgcctctatcgcagccagggggtacataagcactcgggtcggaatgggcgaagctgcggccatttttatgacagcaacccccccaggcacagctgatgccttccctcagtccaatgcacccatccaggacgaggagcgagacattccagaaagatcatggaacagtgggaatgagtggatcactgattttgccggaaaaacggtgtggttcgtgccgagcataaaggctggtaacgacattgccaactgtttacgcaaaaatggcaagaaggtcatccaactgtctaggaaaacctttgatacagaatatcagaagactaaacttaacgactgggatttcgtagtgaccacagacatctccgagatgggggcgaattttaaggcagatcgtgttattgaccctcggagatgcctgaaacccgtgatcctcaccgatggaccagagagggtcattttggccggccccatgcctgtgactgctgcctcagctgcacagcgccgaggtagagttgggcggaacccacagaaggaaaatgaccaatacatattcacgggccagcccctgaacaatgatgaggaccacgcccattggaccgaagctaagatgctcctggacaacatcaatacacctgagggaattatcccggcccttttcgaaccagagagggagaaaagtgcagcgatcgatggcgaatatcgcctaaagggggagagccgtaaaacttttgtggaactgatgagacggggagacttgcccgtctggttagcccacaaggtggcttccgagggtattaaatacaccgataggaagtggtgcttcgacggccagcgcaacaatcagatactggaagagaacatggatgtagagatctggacaaaagaaggggagaagaagaaactccgacctagatggctggacgcccggacctattctgatccccttgcactgaaggaatttaaagacttcgctgccggaaggaagtcgattgcactcgatttggtgactgagatcggccgcgttccaacacacctggcccatagaacgaggaatgctctagacaacctggtcatgctccacaccagcgaacatggtgggaaagcgtaccggcacgccgtggaggagcttcctgaaactatggagacactgttattgctgggcctcatgattctgcttaccggaggcgcaatgctgtttctcatctcagggaagggaataggtaagacctccatcggcttgatttgtgtgatcgctagttctgggatgctgtggatggccgaaattcccttacaatggatcgccagcgcaatagtcctagagttctttatgatggttctgctcattccagagcctgaaaaacagcgtacaccgcaggataatcaacttgcttatgtggtaatcggaattctgactttggccgcgatcatagctgccaacgagatgggcctgctcgaaacgaccaagcgcgacctgggtatgtccaaagagcccggggtggtctcaccaacatcttaccttgatgtggacctccaccctgcaagcgcctggactctgtacgctgttgcaaccacagtgatcacccccatgttgcgacatactattgaaaatagtacggccaacgtctccctggcggctatcgccaaccaggcagtagtgttaatgggcctagacaagggatggccaattagcaaaatggatctgggcgttcctctccttgccctggggtgctattctcaggtgaatcccttgacactgaccgctgccgtcctcctgcttatcactcactacgcaataattggaccgggcttacaggctaaggccaccagagaggcgcaaaagaggacagccgcaggtatcatgaaaaacccaactgtggacgggatcatgaccattgatctggaccctgtcatctatgattcaaagttcgagaaacagctcggacaggtgatgttgctggttctatgtgctgtgcagctgctccttatgcggacatcctgggccctgtgcgaagcattgacgctggctaccggccccataactacactctgggagggtagtccaggcaagttttggaataccactattgccgtaagcatggccaacatcttccgcgggtcgtacctggcgggagctggcttagcattttctattatgaaatccgtggggacaggaaagagaggcaccggtagccaaggggaaacgcttggagagaagtggaaaatgaagctgaatcagctctcaaggaaagaattcgacctatataagaaaagtggcatcaccgaggtcgatcggacagaggccaaggaaggtctgaaacgaggcgagataactcatcacgctgtttctagagggtccgccaagttgcagtggtttgtggaacgcaacatggtcatccccgagggaagggtgattgacctgggctgtgggcggggaggctggagctactattgcgcaggtctcaagaaagtaaccgaagtgcgtgggtacacaaagggaggccctggccatgaggagccggttcccatgtcaacttacgggtggaatatcgtgaaacttatgagtggaaaggatgtcttctatctgccacctgaaaaatgtgacaccttgctgtgcgatattggtgagagctccccctctcctacagtggaagagagcagaaccatcagggtcctcaagatggtggagccatggttaaagaacaatcagttctgtattaaagttctgaacccctacatgcctactgtaatcgaacaccttgagcgcctgcaacggaagcacggcgggatgctagtgcgaaatccactctccagaaactcaacgcatgaaatgtattggatatctaatggaacaggcaacattgtcgccagtgtgaatatggtttcgaggctgttgctgaaccgctttaccatgactcaccggagacccaccatcgagaaagacgtggatctcggtgctgggacacgtcatgtcaacgcggaaccggagacgcctaatatggacgtgatcggagagaggattaagcggataaaagaagagcacaacagcacctggcactacgacgatgaaaatccatataagacttgggcctaccatggctcctatgaggtaaaggcaacaggctctgcttcaagcatgatcaacggggtggttaaacttctgaccaagccctgggacgtcgtgcctatggtgactcagatggccatgacagataccacaccattcggacagcaacgcgtctttaaagaaaaggttgacactcgaacccccagatccatgccgggtacgaggcgggtgatgggcattaccgcagagtggttatggcgcacactggggagaaataaaaagcctaggttgtgcactcgagaggaattcaccaagaaagtacggacaaacgccgctatgggagccgtgtttactgaggaaaatcagtgggatagtgcgaaggcagccgtcgaggacgaagatttctggaaactcgtggaccgtgagagagagctgcacaagctaggcaaatgtggttcttgcgtttacaacatgatggggaagcgcgaaaaaaagcttggagagtttggcaaggctaaaggcagcagggccatctggtacatgtggctgggggcacggtatctcgaattcgaggctctgggatttttgaatgaggatcattggttctcaagagaaaactcctacagtggtgtggagggcgaagggctgcacaagctcggatatattcttcgcgacatcagcaaaatacccggcggtgccatgtacgctgatgacaccgccgggtgggacacgaggatcacagaggatgacctgcataatgaagagaagattacccagcagatggatccagagcaccgacaattagcaaacgcgatctttaaactgacttatcagaataaggtcgtgaaggtacagcggcctacacccaccggaactgttatggacattatctctagaaaagatcagaggggctccggccaagtggggacctacggattgaacacattcacgaatatggaagcccagctcatacgccagatggagggtgaaggcgtcctgtcaaaggctgacctagagaacccacaccttcccgaaaaaaagattacccagtggctggagactaaaggggtggagcgtctcaagcggatggccatcagcggagatgactgcgtggtcaagcctatcgatgacagatttgcaaacgctctgttggccttaaatgatatgggcaaagttaggaaggacattccacaatggcagccgtcgaaaggttggcatgattggcagcaggtgcccttctgttctcaccatttccacgaactgataatgaaggacgggcgcaaactcgtagtgccttgccgaccacaagacgagcttatcggacgggcaagaattagtcagggcgccggctggtccctgagggaaacagcgtgtctagggaaggcttatgcccagatgtggagcctgatgtactttcaccgcagagatctccggttggcatcaaacgccatctgctccgctgtccccgtgcattgggttcctacctctaggactacatggagcattcacgcccatcaccaatggatgaccacggaggacatgctgacagtgtggaatcgtgtctggatcgaagataacccatggatggaggacaagacccccgtgactacctgggagaatgtaccttaccttggaaaacgagaagatcagtggtgtggtagtctgataggcctcacatcccgcgcaacttgggctcagaacatcccgaccgccattcagcaagttagaagcttaatcgggaatgaggaattcctggactatatgccatctatgaagcggtttaggaaagaggaggaattggagggagcgatttggtga

SEQ ID NO: 15177 - RNA, 9873 nt, synthetic construct
  misc_feature 1..9873: note = derived and/or modified CDS sequence (opt3) from DENV-3__FJ898444__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacgagcaaggcaaggcgcataacggtcgtcttataactgcaaatccagttgtgaccaaaaaggaagagcccgtaaacattgaagccgagccgcctttcggggaatcaaatatcgtcatcggcattggagataacgctttgaaaatcaattggtataagaagggcagcagtattgggaaaatgtttgaggccacagcacgcggagccagaaggatggctatactgggtgacactgcctgggatttcggctctgtggggggagttctcaactccctgggcaagatggtgcaccagatctttggtagcgcatacaccgcgcttttctcgggggtctcttgggtgatgaaaattggcatcggagtactgttgacgtggatcggcctcaattccaagaacacatcaatgagttttagctgcattgctatagggatcattaccctgtatttaggagccgtggttcaggcagacatgggctgtgtcgtgaattggaaaggtaaggagctgaagtgcgggtccggaatcttcgtgactaacgaagtccatacatggaccgagcagtacaaatttcaagccgattctcccaagcggctagctactgccattgcaggcgcttgggaaaatggtgtttgtggcatccgaagcaccacacgcatggagaacctcctgtggaaacagatagccaatgaacttaactatatcttgtgggagaataacattaagctgacggtggtggtaggggacatcattggagtcctcgagcagggcaaaagaaccctgactccacagcctatggaattaaagtactcatggaaaacatgggggaaggcgaagatcgtgaccgccgagacacaaaacagttccttcataattgatggacccaatactccagaatgccccagcgcttctagggcatggaacgtttgggaggtggaagactatggctttggtgtcttcaccacgaatatctggctgaaacttcgggaggtgtacacacagttgtgtgaccaccgcctcatgtcagccgctgttaaggatgagagagccgtgcacgcagacatggggtactggattgaaagtcagaaaaacggaagctggaagctggagaaagcgtccctaatcgaagtaaagacctgcacttggcctaagtctcataccctgtggtcgaatggcgtcctcgagagcgatatgataatcccaaaatccctggccggtccgatttcacagcacaactataggcccggctaccatacacaaactgctgggccttggcaccttggaaagttggagctggactttaattattgcgaaggcaccacagtggtgatcacggagaactgtgggacccgtggaccaagtttacggactacaaccgtctctggcaaactcattcacgaatggtgctgtcgaagctgcactctgccccctcttagatacatgggtgaggatgggtgttggtatggaatggaaatcaggccaatatccgagaaggaggaaaatatggttaaatcactggtgagcgccggctctggtgaggtagacaacttcacaatgggcgtgttgtgcctcgcaattctgtttgaagaggtcatgcgcgggaagttcggaaagaaacatatgatcgctggcgtgttctttaccttcgttctactgctctccgggcagatcacgtggcgggatatggcccacactctgattatgatcggaagtaatgcaagcgacagaatgggcatgggtgtgacctaccttgccttgattgctacatttaagatacagcccttcctggcgttagggtttttcctcaggaaactgacctctcgcgaaaaccttctgctaggagtcggcctcgccatggcaactacactgcaattgccggaggatatcgagcagatggctaatggcattgccctggggttaatggccctcaagctgatcacccagtttgaaacatatcagctttggactgctctgatttccttgacctgttcaaacacgatcttcacactcaccgtggcatggcgaactgccaccctgatactagcgggagttagtctgcttcctgtgtgccaaagctcgtccatgcggaaaacagactggctcccaatgactgtcgctgccatgggtgtaccccctctgcccttgtttatcttctctctgaaggataccttaaagcgtagaagctggccactcaatgagggcgtgatggcagttgggctggtgtcaattcttgccagttccctgttgaggaacgacgtccctatggctggacccctcgtggcaggcggtctgctaatcgcctgttacgtaattacggggacatctgcggatctgaccgtggaaaaagctgccgacgtcacttgggaggaagaggcagagcagacaggagttagccataaccttatgatcaccgtggacgatgacggcactatgcgcataaaggatgacgaaacagagaatattctcaccgtgctgttgaaaacggccttactgatcgtctccggcatctttccatactcaattccggctactctcctggtgtggcacacctggcagaagcagacacaacggagcggggttctttgggatgtacctagtcccccagaaacccagaaagccgagctggaggaaggagtgtatagaataaagcagcagggtatcttcggcaaaacacaagtcggggtgggagttcagaaggagggcgtgtttcatactatgtggcacgtcaccaggggtgcagtgttgacgtacaacgggaagcgactagaacccaattgggcttctgtaaaaaaggacctgatttcctatggaggcggctggcgcctcagcgcccagtggcaaaaaggggaggaagtccaggtgatcgcggttgagcctggaaagaacccaaaaaatttccagacaatgcccggtactttccagaccacaaccggcgagattggggccatcgcactggattttaagcctggaacttcgggctcaccgataatcaaccgggaaggtaaggtggtcgggctttacggaaatggcgtggttaccaaaaacggcgggtatgtgtctggaattgctcaaacaaatgccgagccagacggtcccacgcctgaattagaggaagagatgttcaagaaaagaaacctgactatcatggatctccacccaggcagtgggaagaccaggaaatacttgcccgctattgtccgtgaggcaatcaagcgccggctgagaacactcatactggcccctaccagggtggtagccgctgaaatggaggaagcgcttaagggactgccgattcgatatcagactacagcaaccaaatccgagcatacgggccgggaaatcgtggacttgatgtgccacgccacttttacaatgcgcctactgagccccgttagagtcccaaattacaacctcatcattatggatgaggctcatttcaccgaccctgcctctatcgcagccaggggttacataagcacccgggtggggatgggagaggctgcggccatttttatgactgcaacacccccaggcaccgctgatgccttccctcagtccaatgcacccatccaggacgaagagcgagacattccagaaagatcatggaacagtggcaatgagtggatcacagattttgccgggaagactgtgtggttcgtcccgagcataaaagctggaaacgacattgccaactgtttacgcaagaatggtaaaaaggtaatccaactgtctaggaagacgtttgataccgagtatcagaaaacaaagcttaacgactgggatttcgtggttactaccgacatctccgaaatgggcgcgaattttaaagcagatcgtgtgattgaccctcggagatgcctgaagcccgtcatcctcacagatgggccagagagggtgattttggccggacccatgcctgttaccgctgcctcagctgcacagcgccgaggcagagtgggtcggaacccacagaaagaaaatgaccaatacatattcactgggcagcccctgaacaatgatgaggaccacgcccattggacggaagctaagatgctcctggacaacatcaatacccctgagggcattatcccggcccttttcgagccagaaagggagaagagtgcagcgatcgatggagaatatcgcctaaaaggcgagagccgtaagacatttgtcgaactgatgagacggggggacttgcccgtgtggttagcctacaaagtagcttccgagggaattaagtatactgataggaaatggtgcttcgacggtcagcgcaacaatcagatactggaggaaaacatggatgtggagatctggaccaaggaaggcgagaaaaagaagctccgacctagatggctggacgcccggacatactctgatccccttgcactgaaagaatttaaggacttcgctgccgggaggaaatcgattgcactcgatttggttaccgagatcggacgcgtcccaactcacctggcccacagaacaaggaatgctctagacaacctggtgatgctccatacgagcgagcacggcggtaaggcgtatcggcatgccgtggaagagcttcctgaaaccatggagactctgttattgctggggctcatgattctgcttacaggcggagcaatgctgtttctcatctcaggcaaagggataggaaagacctccatcggtttgatttgtgtcatcgctagttctggcatgctgtggatggccgagattcccttacaatggatcgccagcgcaatagttctagaattctttatgatggtgctgctcattccagagcctgaaaagcagcgtaccccgcaggataatcaacttgcttacgtagtgatcgggattctgacattggccgcgatcatagctgccaacgagatgggactgctcgaaactacgaaacgcgacctgggcatgtcccgagagcccggtgtcgtgtcaccaacctcttaccttgatgttgacctccaccctgcaagcgcctggacactgtatgctgtggcaactaccgtcatcacacccatgttgagacacaccattgagaatagtactgccaacgtatccctggcggctatcgccaaccaggcagtggttttaatggggctagacaagggctggccaattagcaaaatggatctgggagtgcctctccttgccctgggctgctactctcaggtcaatcccttgacgctgacagctgccgtgctcctgcttatcacccattatgcaataattgggccgggattacaggctaaggccactagggaagcgcaaaaacggaccgccgcaggcatcatgaagaacccaacagtcgacggtatcatgactattgatctggaccctgtgatctacgattcaaagttcgagaaacagctcgggcaggttatgttgctggtgctatgtgctgtacagctgctccttatgcgcacctcctgggccctgtgcgaagcattgacactggctacgggacccataaccactctctgggagggcagtccaggtaagttttggaatacaaccattgccgtgagcatggccaacatcttcagaggctcgtatctggcgggggctggattagcattttctattatgaaatccgtcggcactgggaagaggggaacaggcagccaaggtgaaacccttggggagaaatggaagaagaaactgaatcagctctcacggaaggagttcgacctatacaaaaagagtggaatcacggaagttgatcgaaccgaggccaaagaaggcctgaagaaaggtgagataacacaccatgctgtgtctagaggctccgccaagttgcagtggtttgtcgaacgcaacatggtgatccccgaggggagggtaattgacctgggatgtggccgggggggatggagctattactgcgcaggcctcaagaaagtgactgaggttcgtggttacaccaaggggggacctggccacgaagagccggtgcccatgtcaacatatggctggaatatcgtcaaacttatgagtgggaaggatgtgttctacctgccacctgaaaaatgtgacactttgctgtgcgatattggagagagctccccctctcctaccgtcgaggaaagcagaacaatcagggtgctcaagatggttgagccatggttaaagaacaatcagttctgtattaaagtactgaacccctatatgcctaccgtgatcgaacatcttgagcgcctgcaacggaagcacggtggcatgctagtccgaaatccactctccagaaactcaactcacgaaatgtactggatatctaatgggacgggaaacattgtggccagtgttaatatggtgtcgaggctgttgctgaaccgctttacaatgacccatcggagacccactatcgagaaagacgtcgatctcggcgctggtacccgtcacgtgaacgcggagccggaaacacctaatatggacgtaatcggggagaggattaagcggataaaagaagagcataacagcacgtggcactatgacgatgaaaatccatacaagacctgggcctatcacggatcctacgaggtgaaggcaactggctctgcttcaagcatgatcaacggcgttgtcaaacttctgacaaagccctgggacgtggtgcctatggtcacccagatggccatgactgatacaaccccattcgggcagcaacgcgtttttaaagagaaggtggacacacgaactcccagaccgatgcctggaaccaggcgggtaatgggtattacggcagaatggttatggcgcaccctgggcagaaataaaaagcccaggttgtgcacacgagaggaattcactaagaaagtgcggaccaacgccgctatgggggccgtctttacagaggaaaatcagtgggattccgcgaaggcagccgtggaggacgaggatttctggaaactcgttgaccgtgaaagagagctgcataagctaggaaaatgtggcagttgcgtgtacaacatgatgggtaagcgcgaaaaaaagcttggggagtttggaaaggctaaaggctctagggccatctggtatatgtggctgggcgcacggtacctcgagttcgaagctctggggtttttgaatgaggatcactggttcagcagagaaaactcatattccggagtcgagggtgaaggcctgcataagctcgggtacattcttcgcgacatcagtaaaataccaggaggcgccatgtatgctgatgacactgccggttgggacaccaggatcacggaggatgacctgcacaatgaggaaaagattacacagcagatggatcctgagcatcgacaattagcaaacgcgatctttaaactgacctaccagaataaggtggtaaaggttcagcggcccactccaacagggaccgtgatggacattatcagcagaaaagatcagaggggatctggccaagtcggcacttatgggttgaacaccttcacaaatatggaagcccagctcatacgccagatggagggagaaggtgtgctgtccaaggctgacctagagaacccccaccttcctgagaaaaagattacgcagtggctggaaaccaaaggcgtggagcgtctcaagcggatggccatctcaggggatgactgcgtcgttaagccaatcgatgacagatttgcaaacgctctgttggccttaaatgatatgggaaaagtgaggaaggacattccgcaatggcagcccagcaaaggctggcacgattggcagcaggtacctttctgttcgcatcacttccatgaactgataatgaaggacggtcgcaaactcgtggtcccatgccgaccccaagacgagcttatcgggcgggcaagaatttctcagggagccggctggagtctgagggaaactgcgtgtctaggcaaggcttacgcccagatgtggtccctgatgtactttcaccgcagagatctccggttggcaagcaacgccatctgctcagctgtgcctgttcactgggtgccaacatccaggaccacttggtctattcatgcccaccatcaatggatgacaaccgaggacatgctgacggtctggaatcgtgtgtggatcgaggataacccctggatggaagacaagacacctgtaaccacttgggagaatgttccgtatcttgggaaacgagaagatcagtggtgtggaagcctgataggtctcaccagtcgcgcaacatgggctcagaacatcccaactgccattcagcaagtgagatccttaatcggcaatgaggagttcctggactacatgcccagcatgaagcggtttaggaaagaagaggaatctgagggggcgatttggtga

SEQ ID NO: 15178 - RNA, 9873 nt, synthetic construct
  misc_feature 1..9873: note = derived and/or modified CDS sequence (opt3) from DENV-3__FJ898445__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggccgttatattcaccttactgatgcttgtgacaccatcgatgaccatgcgctgtgtcggcgtggggaacagagactttgtagaaggattgtcaggtgcgacgtgggttgatgtggtcctggagcacggcgggtgcgtgactacaatggcaaagaataaacccaccctagacatcgagctccagaagactgaagccacacaactggctacccttaggaaactgtgtattgagggaaagatcacgaacattaccacagatagccggtgccctactcagggcgaagccgtgttgccagaggaacaggaccagaattatgtctgtaaacacacctacgttgatcgcggttgggggaacggatgcggcctcttcggcaaggggagtctggtgacatgcgcaaagtttcaatgtttagagcccatcgagggaaaagtagtgcagtatgaaaatctgaagtacactgtcataattaccgtgcatacaggtgaccagcaccaggttggcaacgagacccaaggggtgactgctgaaatcacgcctcaggcctccacaaccgaggcgattctcccagaatatggaactcttggcctggagtgctctccgcgaaccggtttggacttcaatgagatgatcctactgacaatgaaaaacaaggcctggatggtccatagacagtggtttttcgatctccccctgccttggaccagcggggcaactacagaaacgccaacctggaataggaaagagcttctggtgacttttaagaacgctcacgccaaaaagcaagaagtagttgtgttgggctcccaggagggagctatgcacacagccctcaccggcgcaacagaaatccagaattcagggggaactagtattttcgccggtcatctgaagtgtcggttaaaaatggacaagctggagctaaaaggcatgagctacgctatgtgcaccaacacgtttgtcctcaagaaagaggtgtctgaaacccagcacgggacaatactgatcaaggtcgagtacaagggagaagatgtgccctgtaaaattcctttctccactgaggacggccaaggtaaggcgcataacgggcgtcttatcaccgcaaatccagttgtgacaaaacgcgaggaacccgtaaacatagaggccgaaccgcctttcggcgagtcaaatattgtcatcggaatcggcgataacgctttgaagattaattggtataaaaaggggagcagtatcggaaagatgtttgaagccactgcaagaggtgccaggcggatggctattctgggcgacaccgcctgggatttcgggtctgtgggaggcgttctcaactccctgggtaaaatggtgcaccagatatttgggagcgcatacacggcgcttttctcgggcgtctcttgggtgatgaagatcggaattggcgtactgttgacatggatcgggctcaattccaaaaacacctcaatgagttttagctgcatcgctattggaataatcactctgtatttaggcgccgtggttcaggcagacatgggttgtgtcattaattggaaggggaaagagctgaagtgcggatccggcatcttcgtgacaaacgaggtgcatacctggactgaacagtacaagtttcaagccgattctcccaaacgactagctaccgccattgcaggtgcttgggagaatggcgtctgtgggatccgcagcacaacgagaatggaaaacctcctgtggaagcagatagccaatgagcttaactatatcttgtgggaaaataacattaaactgaccgttgtggtgggagacatcattggcgtactcgagcaggggaagaggactctgacaccacagcctatggagttaaaatactcatggaagacctggggaaaagcgaagatcgtcacagccgaaactcaaaacagttccttcataattgatggccccaataccccagagtgccccagcgcttctcgggcatggaacgtgtgggaagttgaggactatggttttggggtgttcacgacaaatatctggctgaagcttcgcgaagtctacacccagttgtgtgaccacagactcatgtcagccgctgtgaaagatgagagggccgttcacgcagacatgggatactggatggagagtcagaagaacggcagctggaaactggaaaaggcgtccctaattgaggtgaaaacttgcacctggcctaagtctcatacactgtggtcgaatggtgtactcgaaagcgatatgatcataccaaagtccctggccggcccgatctcacagcacaactatcgtcccgggtaccatactcaaaccgctggaccttggcaccttggcaaattggagctggactttaattattgcgaggggacaacggtcgtgattaccgaaaactgtggaactcggggcccaagtttacgaacaaccactgtgtctggtaagctcatccacgagtggtgctgtagaagctgcacactgccccctcttaggtacatgggggaagatggatgttggtatggcatggagattcgcccaatctccgaaaaagaggagaatatggtcaagtcactggttagcgccggttctggcgaagtggacaacttcaccatgggggtattgtgcctcgcaatactgtttgaggaagtgatgcggggaaaattcggcaagaagcatatgattgctggggtcttctttacgttcgtgctactgctctccggacagatcacttggagagatatggcccacaccctgatcatgattggcagtaatgcaagcgacaggatgggtatgggggttacataccttgccttgatcgctacctttaaaattcagcccttcctggcgttaggatttttcctccgcaagctgacttctcgagagaaccttctgctaggcgtgggcctcgccatggcaacaaccctgcaattgccggaagatatagagcagatggctaatgggatcgccctgggattaatggccctcaaactgattacacagtttgagacttatcagctttggaccgctctgatctccttgacgtgttcaaacacaattttcaccctcactgtcgcatggcggaccgccacactgatcctagcgggtgtgagtctgcttcctgtttgccaaagctcgtccatgcgtaagactgactggctcccaatgaccgtggctgccatgggcgtcccccctctgcccttgtttatattctctctgaaagatacgttaaagagaaggagctggccactcaatgaaggggtaatggcagtgggactggtttcaatccttgccagttccctgttgcgcaacgacgtgcctatggctggccccctcgtcgcaggtgggctgctaattgcctgttacgtgatcacaggaacctctgcggatctgactgtagagaaggctgccgacgtgacatgggaagaggaagcagagcagaccggcgtcagccataaccttatgattactgttgacgatgacggcacaatgcggatcaaagatgacgagaccgaaaatatactcacggtgctgttgaagactgccttactgattgtgtccgggatctttccatactcaatcccggctaccctcctggtctggcacacatggcagaaacagacccaaagaagcggagtgctttgggatgttcctagtcccccagagacacagaaggccgaactggaggagggtgtatataggattaaacagcagggcatattcgggaagactcaagtgggagtcggcgtgcagaaagaaggtgtttttcataccatgtggcacgtgacgcgaggggcagtcttgacatacaacggaaagcgcctagagcccaattgggcttctgtgaagaaagacctgatctcctatggcggcgggtggcggctcagcgcccagtggcaaaagggagaagaggtacaggtcattgcggtggaacctggtaaaaacccaaagaatttccagactatgcccggcaccttccagacaaccactggggagatcggagccattgcactggattttaaacctggcacctcgggttcaccgatcataaacagagaggggaaggttgtgggactttacggcaatggcgtcgtgacaaagaacgggggatatgtttctggtatcgctcaaacgaatgccgaaccagacggccccactcctgagttagaagaggaaatgttcaaaaagaggaacctgaccattatggatctccacccagggagtggaaaaacacgtaagtacttgcccgctatcgtgcgcgaggcaattaaacggagactgaggaccctcatcctggcccctactcgagtcgtggccgctgagatggaagaggcgcttaagggcctgccgatacggtatcagacaaccgcaacgaagtccgaacatactggtcgcgagattgtagacttgatgtgccacgccacatttaccatgagactactgagccccgtgagggttccaaattacaacctcatcatcatggatgaagctcatttcaccgaccctgcctctattgcagcccgggggtacatcagcactcgagtcggaatgggcgaggctgcggccatatttatgacagcaacccccccaggcacagctgatgccttccctcagtccaatgcacccattcaggacgaggaaagagacatcccagagcgctcatggaacagtgggaatgaatggattactgattttgccggaaaaacggtgtggttcgtgccgagcatcaaggctggtaacgacatagccaactgtttaaggaaaaatggcaagaaagtcattcaactgtctcgtaagacctttgatacagagtatcagaagactaaacttaacgactgggatttcgtagtgaccacagacatctccgagatgggggcgaattttaaggcagatcgggttatcgaccctagaaggtgcctgaaacccgtgattctcaccgatggaccagaacgcgtcatcttggccggccccatgcctgtgactgctgcctcagctgcacagcgaagaggtcgggttgggaggaacccacagaaggagaatgaccaatacattttcacgggccagcccctgaacaatgatgaagaccacgcccattggaccgaggctaaaatgctcctggacaacataaatacacctgaaggaatcattccggcccttttcgagccagagcgcgaaaagagtgcagcgatcgatggcgagtatcgtctaaagggggaaagcagaaaaacttttgtggagctgatgcggaggggagacttgcccgtctggttagcctacaaggtggcttccgaaggtatcaaatataccgatcgcaagtggtgcttcgacggccagcgaaacaatcagattctggaggagaacatggatgtagaaatatggacaaaagagggggaaaagaaaaagctcagacctcggtggctggacgccaggacctactctgatccccttgcactgaaggagtttaaagacttcgctgccggacgcaagtcgatcgcactcgatttggtgactgaaattggcagagttccaacacacctggcccacaggacgcggaatgctctagacaacctggtcatgctccataccagcgagcacggtgggaaagcgtatcgtcatgccgtggaggaacttcctgagactatggaaacactgttattgctgggcctcatgatcctgcttaccggaggcgcaatgctgtttctcatttcagggaagggaatcggtaaaacctccataggcttgatctgtgtgattgctagttctgggatgctgtggatggccgagatccccttacaatggattgccagcgcaatcgtcctagagttctttatgatggttctgctcataccagaacctgagaagcagcgcacaccgcaggataatcaacttgcttacgtggtaattggaatcctgactttggccgcgattatcgctgccaacgaaatgggcatgctggagacgaccaagcgagacctcggtatgtccaaagaacccggggtggcatcaccaacatcttacctggatgtcgaccttcaccctgccagcgcttggactctctatgcagtggccaccacagttataacccccatgctgagacacactatcgagaatagtacggcgaacgtgtccttggctgccattgcaaaccaggccgtcgtactgatgggcttagacaagggatggccaatcagcaaaatggatctaggcgtgcctctgctcgctcttgggtgctactctcaggttaatcccctgacattgaccgccgcagtgctgctcctgattactcattatgctatcataggaccgggccttcaggccaaggcgaccagggaggcccaaaaacggacagcagctggtattatgaagaacccaactgtcgacgggatcatgaccatcgatttagaccctgtgatttacgattcaaagttcgaaaaacagctgggacaggtcatgctcttggtgctgtgtgccgttcagctactgctcatgcgcacatcctgggcactttgcgaggctctgacgttggccaccggccccatcactacactgtgggaaggtagtccaggcaagttttggaataccactatagccgtgagcatggcgaacattttcagagggtcgtatctcgctggagcaggcctggccttttctatcatgaaatccgtagggacaggaaagaggggcaccggtagccaaggggagacgttaggagaaaaatggaagaagaaacttaatcagctgtcacggaaggagttcgacctctacaaaaagagtggcattaccgaggtggatcgaacagaagctaaagagggtctaaagagaggcgaaatcactcaccatgccgtctctcgcgggtccgcaaaactgcagtggtttgttgagaggaacatggtgatacccgaaggacgggtcatcgacttgggctgtgggcgtggaggctggagctattactgcgccggtctgaagaaggtgaccgaggtaagagggtacacaaaaggaggccctggccacgaggaaccggtgcccatgtcaacttatgggtggaatattgttaagctcatgagtggaaaagatgtgttctaccttccacctgagaagtgtgacaccctgttgtgcgatatcggtgaaagctccccctctcctacagtcgaggagagcaggaccattcgcgtgctgaaaatggtcgaaccatggctcaagaacaatcagttctgtatcaaggtgttaaacccctatatgcctactgttattgagcatctggaacggcttcaacgaaaacacggcgggatgctggtaagaaatccactatccaggaactcaacgcacgagatgtactggatctctaatggaacaggcaacatagtggctagtgtcaatatggtgtcgcgcctcctgttgaaccggtttaccatgactcatagacgtcccaccattgaaaaggacgttgatctgggtgcggggacaaggcacgtgaacgccgagccggagacgcctaatatggacgtcatcggagaacggatcaaacgcattaaggaggaacataacagcacctggcactatgacgatgagaatccatacaaaacttgggcatatcacggctcctacgaagtgaaggctacaggctctgcctcaagcatgataaacggggtagtgaagctccttaccaaaccctgggacgttgtccctatggtgatccagatggcaatgactgatacaaccccattcggacagcaacgagtgtttaaggagaaagtcgacacaagaactcccaggtccatgccgggtacccggcgcgttatgggcattacggccgagtggctgtggagaaccttagggaggaataagaaacctcgactgtgcacacgggaagagttcactcgtaaggtgagaaccaacgctgccatgggagcggtatttacagaagagaatcagtgggatagtgcaaaggccgctgtggaagacgaggatttctggaaattggtcgaccgcgagagggaactccataagctgggcaaatgtggttcttgcgtgtacaacatgatggggaagcgggagaaaaagctaggagaatttggcaaagccaagggcagcagagcaatctggtatatgtggcttggggctcgctacctggagttcgaggccctcggatttctgaatgaagatcactggttctcaagggagaactcctatagtggtgttgaaggcgaggggttgcataagctgggatacattctccgagacatcagcaaaatacccggcggtgctatgtatgccgatgacactgcagggtgggacacccggatcacggaagatgaccttcacaatgaggagaagattacacagcagatggatccagaacatagacaactggcgaacgccatctttaaattaacctaccagaataaggtggtcaaagtgcagaggcctactcccacaggaaccgtaatggacattatctctcgcaaggatcagcgtggctccggccaagttgggacttatggactgaacaccttcacaaatatggaggctcagttgatacggcagatggaaggtgagggcgtgctctcaaaggccgacctggaaaacccacacctacccgagaaaaagattacgcagtggcttgagaccaaaggggtcgaaagactgaagaggatggcaatcagcggagatgactgcgtggtgaaacctatcgatgaccgctttgctaacgccctcctggcattgaatgatatgggcaaggtccgaaaggacattccacaatggcagccgtcgaaaggttggcacgattggcagcaggttcccttctgttctcatcacttccatgagttaataatgaaggacgggcggaaactggtggtaccttgcagaccacaagacgaactcatcggaagggcccgcattagtcagggcgcgggctggtcccttagagagactgcttgtctggggaaggcctacgcacagatgtggagcctaatgtactttcaccggagggatctgcgtctcgcctcaaacgctatctgctccgccgtgcccgtccactgggtgcctacatctcgaaccacttggagcattcatgcacaccatcaatggatgacaaccgaagacatgttgacggtttggaatcgcgtgtggatcgaggataacccatggatggaggacaaaacacccgtcaccacttgggaaaatgtgccttatctgggaaagagagaggatcagtggtgtggtagtcttataggcctgacctcccgggctacatgggcccagaacatcccgactgcgattcagcaagtaaggagcctcatcgggaatgaagagttcttagactacatgccatctatgaagcgctttagaaaagaggaagagtcagaaggagctatttggtga

SEQ ID NO: 15179 - RNA, 9873 nt, synthetic construct
  misc_feature 1..9873: note = derived and/or modified CDS sequence (opt3) from DENV-3__GQ868571__SS-prME
  source 1..9873: mol_type = other RNA
accagcctgtgcctcatgatgatccttcccgcagctctggcattccacttgacatccagggacggcgagcctaggatgattgtggggaagaacgaacggggaaaatctttactgtttaagactgcatcaggtataaatatgtgtacgctaatcgcgatggatctcggcgaaatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggccgttatattcatcttactgatgcttgtgaccccatcgatgacaatgcgctgtgtcggcgtggggaacagagactttgtagaaggattgtcaggtgcgacctgggttgatgtggtcctggagcacggcgggtgcgtgacgactatggcaaagaataaacccacactagacattgagctccagaagaccgaagccactcagctggctacacttaggaaactgtgtatcgagggaaagattaccaacatcacgaccgatagccggtgccctacacagggcgaagccgtgttgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcaaaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgccggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgcttctagggcatggaacgtgtgggaagttgaggactatggttttggggtgttcaccacgaatatttggctgaaacttcgggaagtctacacacagttgtgtgaccaccgcctcatgtcagccgctgtgaaggatgagagagccgttcacgcagacatgggatactggatcgagagtcagaaaaacggcagctggaagctggaaaaagcgtccctaatagaggtgaagacctgcacttggcctaagtctcataccctgtggtcgaatggtgtactcgaaagcgatatgatcattccaaaatccctggccggcccgatctcacagcacaactataggcccgggtaccatacacaaactgctggaccttggcaccttggcaagttggagctggactttaattattgcgaggggaccacagtcgtgattacggaaaactgtggaacccgtggcccaagtttacggactacaaccgtgtctggtaaactcatccacgagtggtgctgtcgaagctgcactctgccccctcttagatacatgggggaagatggatgttggtatggcatggagataaggccaatttccgaaaaggaggagaatatggtcaaatcactggttagcgccggttctggcgaagtggacaacttcacaatgggggtattgtgcctcgcaatcctgtttgaggaagtgatgcgcggaaagttcggcaagaaacatatgatcgctggggtcttctttaccttcgtgctactgctctccggacagattacgtggcgggatatggcccacactctgatcatgattggcagtaatgcaagcgacagaatgggtatgggggttacctaccttgccttgatagctacatttaagatccagcccttcctggcgttaggatttttcctcaggaaactgacctctcgcgagaaccttctgctaggcgtgggcctcgccatggcaactacactgcaattgccggaagatattgagcagatggctaatgggatcgccctgggattaatggccctcaagctgattacccagtttgagacatatcagctttggactgctctgatctccttgacctgttcaaacacgatattcacactcaccgtcgcatggcgaactgccaccctgatcctagcgggtgtgagtctgcttcctgtttgccaaagctcgtccatgcggaaaacagactggctcccaatgactgtggctgccatgggcgtcccacctctgcccttgtttattttctctctgaaggataccttaaagcgtagaagctggccactcaatgaaggggtaatggcagtgggactggtttcaatccttgccagttccctgttgaggaacgacgtgcctatggctggccccctcgtcgccggtgggctgctaattgcctgttacgtgatcacgggaacatctgcggatctgaccgtagagaaagctgccgacgtgacttgggaagaggaagcagagcagacaggcgtcagccataaccttatgataaccgttgacgatgacggcactatgcgcattaaggatgacgagacagaaaatatcctcaccgtgctgttgaaaacggccttactgatcgtgtccgggatttttccatactcaataccggctactctcctggtctggcacacctggcagaagcagacacaacggagcggagtgctttgggatgttcctagtcccccagagacccagaaagccgaactggaggagggtgtatatagaatcaagcagcagggcattttcgggaaaacacaagtgggagtcggcgtgcagaaggaaggtgtttttcatactatgtggcacgtgaccagaggggcagtcttgacgtacaacggaaagcgactagagcccaattgggcttctgtgaaaaaggacctgatctcctatggcggcgggtggcgcctcagcgcccagtggcaaaaaggagaagaggtacaggtcattgcggtggaacctggtaagaaccccaagaatttccagacaatgcccggcactttccagaccacaaccggggagatcggagccatagcactggattttaagcctggcacttcgggttcaccgatcattaaccgggaggggaaggttgtgggactttacggcaatggcgtcgtgaccaaaaacgggggatatgtttctggtatcgctcaaacaaatgccgaaccagacggccccacgcctgagttagaagaggaaatgttcaagaaaagaaacctgactattatggatctccacccagggagtggaaagaccaggaaatacttgcccgctatcgtgcgtgaggcaataaagcgccggctgagaacactcattctggcccctaccagggtcgtggccgctgagatggaagaggcgcttaagggcctgccgatccgatatcagactacagcaaccaaatccgaacatacgggtcgggagatcgtagacttgatgtgccacgccacttttacaatgcgcctactgagccccgtgagagttccaaattacaacctcattatcatggatgaagctcatttcaccgaccctgcctctatagcagccagggggtacattagcacccgggtcggaatgggcgaggctgcggccatctttatgactgcaacacccccaggcaccgctgatgccttccctcagtccaatgcacccattcaggacgaggaacgagacatcccagagagatcatggaacagtgggaatgaatggataacagattttgccggaaagactgtgtggttcgtgccgagcattaaagctggtaacgacatcgccaactgtttacgcaagaatggcaaaaaggtcatccaactgtctaggaagacgtttgataccgagtatcagaaaacaaaacttaacgactgggatttcgtagtgactaccgacatttccgagatgggggcgaattttaaagcagatcgtgttatcgaccctcggagatgcctgaagcccgtgattctcacagatggaccagaaagggtcatattggccggccccatgcctgtgaccgctgcctcagctgcacagcgccgaggtagagttgggcggaacccacagaaagagaatgaccaatacatcttcactggccagcccctgaacaatgatgaagaccacgcccattggacggaggctaagatgctcctggacaacattaatacccctgaaggaatcatcccggcccttttcgagccagagagggaaaagagtgcagcgattgatggcgagtatcgcctaaaaggggaaagccgtaagacatttgtggagctgatgagacggggagacttgcccgtctggttagcccacaaagtggcttccgaaggtataaagtacactgataggaaatggtgcttcgacggccagcgcaacaatcagatcctggaggagaacatggatgtagaaatttggaccaaggagggggagaagaagaagctccgacctagatggctggacgcccggacatattctgatccccttgcactgaaagagtttaaggacttcgctgccggaaggaaatcgatcgcactcgatttggtgaccgaaattggccgcgttccaactcacctggcccatagaacaaggaatgctctagacaacctggtcatgctccacacgagcgagcatggtgggaaggcgtaccggcacgccgtggaggaacttcctgagaccatggaaactctgttattgctgggcctcatgatcctgcttacaggaggcgcaatgctgtttctcatatcagggaaaggaatcggtaagacctccattggcttgatctgtgtgattgctagttctgggatgctgtggatggccgagatccccttacaatggatagccagcgcaattgtcctagagttctttatgatggttctgctcatcccagaacctgagaagcagcgtaccccgcaggataatcaacttgcttatgtggtaattggaatcctgacattggccgcgataatcgctgccaacgaaatgggcatgctggagactacgaaacgcgacctcggtatgtccaaggaacccggggtggtctcaccaacctcttacctggatgtggaccttcaccctgcaagcgcctggacactctacgctgttgcaactaccgtgattacacccatgctgcgacataccatcgagaatagtactgccaacgtctccttggcggctattgccaaccaggcagtagtgctgatgggcttagacaaaggatggccaatcagcaagatggatctaggcgttcctctgctcgcccttgggtgctattctcaggtgaatcccctgacgttgacagctgccgtcctgctcctgataacccactacgcaattatcggaccgggccttcaggctaaagccactagagaggcgcaaaagaggaccgccgcaggtatcatgaagaacccaacagtggacgggattatgactatcgatttagaccctgtcatatatgattcaaaattcgaaaagcagctgggacaggtgatgctcttggttctgtgtgctgtgcagctactgctcatgcggacctcctgggccctttgcgaggcactgacattggctacgggccccattaccactctgtgggaaggtagtccaggcaaattttggaatacaaccatcgccgtaagcatggccaacattttccgcgggtcgtacctcgcgggagctggcctggcattttctatcatgaagtccgtggggactggaaaaagaggcacaggtagccaaggggagaccttaggagaaaagtggaagaagaaacttaatcagctgtcaaggaaagagttcgacctctataagaaaagtggcataacggaggtcgatcggaccgaagccaaagagggtctaaaacgaggcgaaatcacacatcacgctgtttctagagggtccgccaagctgcagtggtttgtggagcgcaacatggtcattcccgaaggaagggtgatcgacttgggctgtgggcggggaggctggagctactattgcgcaggtctgaagaaagtaactgaggtgcgtgggtacaccaagggaggccctggccatgaggaaccggttcccatgtcaacatacgggtggaatattgtgaaactcatgagtggaaaggatgtcttctatcttccacctgagaaatgtgacactctgttgtgcgatatcggtgaaagctccccctctcctaccgtggaggagagcagaacaattagggtcctgaagatggtggaaccatggctcaagaacaatcagttctgtatcaaagttttaaacccctacatgcctaccgtaatagagcacctggaacgccttcaacggaagcacggcgggatgctggtgcgaaatccactatccagaaactcaactcatgagatgtattggatttctaatggaacgggcaacatcgtcgccagtgtgaatatggtttcgaggctcctgttgaaccgctttacaatgacccaccggagacccactatcgaaaaagacgtggatctgggtgctgggacccgtcatgtcaacgcggagccggagacacctaatatggacgtgattggagaaaggataaagcggatcaaagaggaacacaacagcacgtggcactacgacgatgagaatccatataagacctgggcctaccatggctcctatgaagtaaaggcaactggctctgcttcaagcatgattaacggggtggttaaactccttacaaagccctgggacgtcgtgcctatggtgacccagatggccatgactgatacaaccccattcggacagcaacgcgtctttaaagagaaggttgacacacgaactcccagatccatgccgggtaccaggcgggtgatgggcatcacggcagagtggctgtggcgcaccttagggagaaataaaaagcctaggctgtgcacacgagaagagttcactaagaaagtacggaccaacgccgctatgggagccgtgtttacagaagagaatcagtgggatagtgcgaaggcagccgtcgaagacgaggatttctggaaattggtggaccgtgagagagaactccacaagctgggcaaatgtggttcttgcgtttacaacatgatggggaagcgcgagaaaaagctaggagaatttggcaaggctaaaggcagcagggccatttggtacatgtggcttggggcacggtatctggagttcgaggctctcggatttctgaatgaagatcattggttctcaagagagaactcctacagtggtgtggaaggcgaggggttgcacaagctgggatatatcctccgcgacataagcaaaatccccggcggtgccatgtacgctgatgacactgccgggtgggacaccaggattacggaagatgaccttcataatgaggagaagatcacacagcagatggatccagaacaccgacaactggcaaacgcgatttttaaattaacctatcagaataaggtcgtgaaggtacagcggcctactcccacaggaaccgttatggacatcatatctagaaaagatcagaggggctccggccaagtggggacttacggactgaacaccttcacaaatatggaggcccagttgattcgccagatggaaggtgagggcgtcctctcaaaggctgacctggaaaacccacacctacccgagaaaaagatcacgcagtggcttgagaccaaaggggtggaacgtctgaagcggatggccatcagcggagatgactgcgtggtcaagcctattgatgacagatttgcaaacgctctcctggccttgaatgatatgggcaaagttaggaaggacataccacaatggcagccgtcgaaaggttggcatgattggcaacaggtgcccttctgttctcaccatttccacgagttaatcatgaaggacgggcgcaaactggtagtgccttgccgaccacaagacgaactcattggacgggcaagaatcagtcagggcgccggctggtcccttagggagactgcgtgtctggggaaggcttatgcccagatgtggagcctaatgtactttcaccgcagagatctgcggctcgcatcaaacgccatttgctccgctgtccccgtgcattgggttcctacatctaggaccacttggagcatccacgcccatcaccaatggatgacaaccgaagacatgttgacggtgtggaatcgtgtctggatagaggataacccatggatggaggacaagacacccgtgaccacttgggaaaatgtaccttacctgggaaaacgagaggatcagtggtgtggtagtcttatcggcctgacctcccgcgcaacatgggctcagaacattccgactgccatccagcaagttagaagcctcattgggaatgaagagttcttagactatatgccatctatgaagcggtttaggaaagaggaagagtcagaaggagcgatctggtga

SEQ ID NO: 15180 - RNA, 9873 nt, synthetic construct
  misc_feature 1..9873: note = derived and/or modified CDS sequence (opt3) from DENV-3__GU131951__SS-prME
  source 1..9873: mol_type = other RNA
accagcctgtgcctcatgatgatccttccagcagctctggcattccacttgacttccagagacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatgagcaagaataaacccacactagacattgagctccagaagaccgaagcgactcaactggcaacacttaggaaactgtgtatcgagggaaagattaccaacatcacgaccgatagtcggtgccctacacagggcgaagccgtcttgccagaggaacaggaccagaattatgtttgtaaacacacttacgtggatcgcggttgggggaacggatgcggcctcttcggcaaggggtccctggtaacctgcgctaagtttcaatgtttagagcccatagagggaaaagtggtccagtatgaaaatctgaagtacacagtgattatcactgttcataccggtgaccagcaccaggtgggcaacgagacacaaggggtcaccgccgaaattactcctcaggcatctacgacagaggctatcctcccagaatatggaacccttggcctggagtgcagcccgcgaactggtttggacttcaatgagatgatcctactgaccatgaaaaacaaggcctggatggtgcatagacagtggtttttcgatctccccctgccttggacatccggggcgaccactgaaacaccaacgtggaataggaaagagcttctggtaacctttaagaacgcccacgccaagaagcaagaagttgtggtcttgggctcacaggagggagctatgcacactgccctcacaggcgctaccgaaattcagaatagtgggggaacaagcatattcgccggtcatctgaagtgtcggttaaaaatggacaagctggagctaaaaggcatgtcttacgcaatgtgcactaacacctttgtgctcaagaaagaggtctccgaaacgcagcacgggaccatcctgattaaggtggagtacaagggagaagatgttccctgtaaaatccctttctcaacagaggacggccaaggtaaggcccataacgggcgtcttataactgctaatccagtggtaaccaaaaaggaggaacccgtcaacattgaggcggaaccgcctttcggcgagagcaatatcgtgatcggaattggcgataacgcattgaaaatcaattggtataagaaggggagttctattggaaaaatgtttgaagccacagctcgcggtgccagaaggatggcaatactgggcgacactgcctgggatttcgggtccgttggaggcgtgctcaacagcctgggtaagatggtccaccagatctttgggtcggcttacaccgcccttttctctggcgtgtcctgggtaatgaaaattggaatcggcgtgctgttgacgtggatcgggctcaattcaaagaacacaagtatgagcttttcctgcattgcaataggaatcattaccctgtatttaggcgcggttgtccaggctgacatgggttgtgtgatcaattggaaagggaaggagctgaagtgcggatctggcattttcgtgactaacgaggtccatacatggaccgaacagtacaaatttcaagccgatagccccaagcggctagcaactgccatcgctggtgcctgggagaatggcgtttgtgggatacgatcaaccacacgcatggaaaacctcctgtggaaacagatcgcaaatgagcttaactatattttgtgggaaaataacatcaagctgacggtggtggtaggagacattatcggcgtcctcgagcaggggaaaagaaccctgactccacagcctatggagttaaagtacagttggaaaacatggggaaaggctaagatagtgaccgccgaaacacaaaactccagcttcattatcgatggccccaatactccagagtgcccctctgcgtcaagggcctggaacgtttgggaagtggaggactatggttttggggtcttcaccacgaatatttggctgaaacttcgggaagtgtacacacagttgtgtgaccaccgcctcatgagtgctgcagttaaggatgagagagccgtgcacgctgacatgggatactggatcgagagccagaaaaacggctcctggaagctggaaaaagcctctctaatagaggtaaagacctgcacttggcctaagtcgcataccctgtggagcaatggtgtcctcgaatccgatatgatcattccaaaatcactggcaggcccgatcagtcagcacaactataggcccgggtaccatacacaaactgcgggaccttggcaccttggcaagttggagctggactttaattattgcgaggggaccacagtggtgattacggaaaactgtggaacccgtggcccatctttacggactacaaccgtcagcggtaaactcatccacgagtggtgctgtcgatcctgcactctgccccctcttagatacatgggggaagatggatgttggtatggcatggagataaggccaatttcagaaaaggaggagaatatggttaaaagcctggtgtctgccggttccggcgaagtagacaacttcacaatgggggtgttgtgcctcgctatcctgtttgaggaagtcatgcgcggaaagttcggcaagaaacatatgatcgccggggtgttctttaccttcgttctactgctcagtggacagattacgtggcgggatatggcacacactctgatcatgattggcagcaatgcttctgacagaatgggtatgggggtgacctaccttgccttgatagcaacatttaagatccagcccttcctggccttaggatttttcctcaggaaactgacctcccgcgagaaccttctgctaggcgtcggcctcgctatggcgactacactgcaattgccggaagatattgagcagatggccaatgggatcgcactgggattaatggctctcaagctgattacccagtttgagacatatcagctttggactgccctgatctcattgacctgtagtaacacgatattcacactcaccgtggcctggcgaactgctaccctgatcctagccggtgttagcctgcttcctgtgtgccaatcgtcctctatgcggaaaacagactggctcccaatgactgtcgccgcgatgggcgtaccccctctgcccttgtttattttcagcctgaaggataccttaaagcgtagatcatggccactcaatgaaggggtgatggctgttggactggtgagtatccttgcctcctctctgttgaggaacgacgtccctatggcaggccccctcgtggccggtgggctgctaattgcttgttacgtaatcacgggaacaagcgcagatctgaccgtggagaaagccgcggacgtcacttgggaagaggaagctgagcagacaggcgtttcccataaccttatgataaccgtggacgatgacggcactatgcgcattaaggatgacgagacagaaaatatcctcaccgtgctgttgaaaacggccttactgatcgtctcagggatttttccatacagcataccggcaactctcctggtgtggcacacctggcagaagcagacacaacggagtggagttctttgggatgtaccttctcccccagaggcccagaaagctgaactggaggagggtgtgtatagaatcaagcagcagggcattttcgggaaaacccaagtcggagtgggcgttcagaaggaaggtgtgtttcatacaatgtggcacgtcactcgaggggcagtgttgacctacaacggaaagaggctagagcccaattgggcatccgtcaagaaggacctgatcagctatggcggcgggtggcgcctctcggctcagtggcaaaaaggagaagaggtccaggtgattgccgttgaacctggtaagaaccccaaaaatttccagacgatgcccggcacattccagactaccacaggggagatcggagcgatagccctggattttaagcctggcacctcaggttctccgatcattaaccgggaggggaaggtggtcggactttacggcaatggcgtggttactaaaaacgggggatatgtgagtggtatcgcacaaaccaatgctgaaccagacggccccacacctgagttagaagaggaaatgttcaagaaaagaaacctgacgattatggatctccacccagggtccggaaagactaggaaatacttgcccgccatcgtccgtgaggctataaagcgccggctgagaaccctcattctggcacctacaagggtggtagccgccgagatggaagaggctcttaagggcctgccgatccgatatcagaccactgcgacaaaaagcgaacataccggtcgggagatcgtggacttgatgtgccacgcaacgtttactatgcgcctactgtctcccgttagagtcccaaattacaacctcattatcatggatgaagcccatttcacagaccctgctagcatagccgcaagggggtacatttccacccgggtgggaatgggcgaggccgctgcgatctttatgaccgccactcccccaggcacagcagatgctttccctcagtcaaatgcccccattcaggacgaggaacgagacatcccagagagaagttggaacagcgggaatgaatggataaccgattttgcaggaaagacagtgtggttcgtcccgtctattaaagccggtaacgacatcgctaactgtttacgcaagaatggcaaaaaggtaatccaactgtccaggaagacttttgatacggagtatcagaaaaccaaacttaacgactgggatttcgtggttacaactgacatttcagagatgggggccaattttaaagcggatcgtgtgatcgaccctcggagatgcctgaagcccgtcattctcaccgatggaccagaaagggtgatattggcaggccccatgcctgttacagccgctagtgccgctcagcgccgaggtagagtggggcggaacccacagaaagagaatgaccaatacatcttcaccggccagcccctgaacaatgatgaagaccacgcacattggactgaggccaagatgctcctggacaacattaatacgcctgaaggaatcatcccggctcttttcgagccagagagggaaaagagcgccgcaattgatggcgagtatcgcctaaaaggggaatcccgtaagacctttgtcgagctgatgagacggggagacttgcccgtgtggttagcgcacaaagtagcctctgaaggtataaagtacacagataggaaatggtgcttcgacggccagcgcaacaatcagatcctggaggagaacatggatgtggaaatttggactaaggagggggagaaaaagaagctccgacctagatggctggacgctcggacctattcggatccccttgccctgaaagagtttaaggacttcgcagctggaaggaaaagcatcgccctcgatttggttacagaaattggccgcgtcccatcacacctggcacatagaaccaggaatgccctagacaacctggtgatgctccacacttccgagcatggtgggaaggcttaccggcacgcggtggaggaacttcctgagacaatggaaacgctgttattgctgggcctcatgatcctgcttaccggaggcgccatgctgtttctcataagtgggaaaggaatcggtaagacttctattggcttgatctgtgtcattgcaagctccgggatgctgtggatggctgagatccccttacaatggatagcctcagccattgttctagagttctttatgatggtgctgctcatcccagaacctgagaagcagcgtacaccgcaggataatcaacttgcatatgtagtgattggaatcctgaccttggctgccataatcgcggctaacgaaatgggcctgctcgagaccacaaaacgcgacctgggtatgtctaaggaacccggggtcgtgagcccaacaagttaccttgatgttgacctccaccctgcctccgcatggacgctgtacgccgtggctaccacagtcattactcccatgttgcgacataccatcgagaatagcacagcaaacgtatctctggccgcgattgctaaccaggccgtggttttaatgggcctagacaaaggatggccaatctcaaagatggatctgggcgtgcctctccttgcactggggtgctattcccaggtcaatcccttgaccctgactgccgctgtgctcctgcttataacgcactacgccattatcggaccgggcttacaggcaaaagctacaagagaggcccaaaagaggaccgcggccggtatcatgaagaacccaactgtcgacgggattatgaccatcgatctggaccctgtgatatatgatagtaaattcgaaaagcagctcggacaggttatgttgctggtgctatgtgcagtacagctgctccttatgcggacaagctgggctctgtgcgaggccttgactctggcaaccggccccattacaacgctctgggaaggttcgccaggcaaattttggaataccactatcgctgtgtctatggccaacattttccgcgggtcctacctggccggagcgggcttagcttttagcatcatgaagtcagtcgggacaggaaaaagaggcaccggtagtcaaggggagactcttggagaaaagtggaagaaaaagctgaatcagctctctaggaaagagttcgacctatataagaaatccggcataacagaggttgatcggaccgaagcaaaggagggtctgaaacgaggcgaaatcacgcatcacgccgtgagcagagggtcagctaagttgcagtggtttgtcgagcgcaacatggtgacccccgaaggaagggtaattgacctgggctgtgggcggggaggctggagttactattgcgccggtctcaagaaagtgacagaggttcgtgggtacactaagggaggccctggccatgaggaaccggtgcccatgagcacctacgggtggaatatcgtcaaacttatgtccggaaaggatgtgttctatctgccacctgagaaatgtgacacattgctgtgcgatattggtgaatctagcccctcccctatcgtcgaggagtcaagaactattagggtgctcaagatggttgaaccatggttaaagaacaatcagttctgtatcaaagtactgaacccctacatgcctaccgtgatagagcaccttgaacgcctgcaacggaagcacggcgggatgctagtccgaaatccactctctagaaacagtacacatgagatgtattggatttcgaatggaaccggcaacatcgtggcaagcgttaatatggtgtccaggctgttgctgaaccgctttactatgacgcaccggagacccacaatcgaaaaagacgtcgatctcggtgccgggacccgtcatgtgaacgctgagccggagactcctaatatggacgtaattggagaaaggataaagcggatcaaagaggaacacaactctacctggcactacgacgatgagaatccatataagacatgggcgtaccatggctcatatgaagtgaaggccacgggcagcgcatccagtatgattaacggggttgtcaaacttctgaccaagccctgggacgtggtgcctatggtcactcagatggctatgacagataccactccattcggacagcaacgcgtttttaaagagaaggtggacacacgaacccccagatctatgccgggtacaaggcgggtaatgggcatcactgccgagtggttatggcgcaccctggggagaaataaaaagcctaggttgtgcacgcgagaagagttcaccaagaaagtgcggacaaacgcagccatgggagctgtctttactgaagagaatcagtgggatagcgccaaggcggcagtggaagacgaggatttctggaaactcgttgaccgtgagagagaactgcacaagctaggcaaatgtggttcatgcgtgtacaacatgatggggaagcgcgagaagaaacttggagaatttggcaaagccaaaggctccagggctatttggtacatgtggctgggggcccggtatctcgagttcgaggcactgggatttttgaatgaagatcattggttcagtagagagaacagctactctggtgtcgaaggcgaggggctgcacaagctcggatatatccttcgcgacatatccaaaatccccggcggtgctatgtacgccgatgacaccgctgggtgggacacaaggattactgaagatgacctgcataatgaggagaagatcacccagcagatggatccagaacaccgacaattagccaacgcaatttttaaactgacgtatcagaataaggtggtaaaggttcagcggcctacacccaccggaactgtgatggacatcatatcaagaaaagatcagaggggcagcggccaagtcgggacatacggattgaacaccttcactaatatggaggcgcagctcattcgccagatggaaggtgagggcgtgctgtcgaaggccgacctagaaaacccacaccttcccgagaaaaagatcacccagtggctggagacaaaaggggtggaacgtctcaagcggatggctatctctggagatgactgcgtcgttaagcctattgatgacagatttgccaacgcactgttggctttaaatgatatgggcaaagtgaggaaggacataccacaatggcagccgagtaaaggttggcatgattggcagcaggtacccttctgttcccaccatttccacgagctgatcatgaaggacgggcgcaaactcgtggtcccttgccgaccacaagacgaacttattggacgggccagaatcagccagggcgcaggctggtcactgagggagacggcctgtctagggaaggcgtatgctcagatgtggtccctgatgtactttcaccgcagagatctccggttggcctctaacgcaatttgcagcgccgtgcccgttcattgggtgcctaccagtaggactacatggtccatccacgctcatcaccaatggatgaccactgaagacatgctgacagtctggaatcgtgtgtggatagaggataacccatggatggaggacaagacccccgtaacgacatgggaaaatgttccttaccttggaaaacgagaggatcagtggtgtggtagcctgatcggcctcacctctcgcgccacttgggcacagaacattccgaccgctatccagcaagtgagatcattaattgggaatgaagagttcctggactatatgccaagtatgaagcggtttaggaaagaggaagagtccgaaggagccatctggtga

SEQ ID NO: 15181 - RNA, 9873 nt, synthetic construct
  misc_feature 1..9873: note = derived and/or modified CDS sequence (opt3) from DENV-3__GQ868572__SS-prME
  source 1..9873: mol_type = other RNA
accagcctgtgcctcatgatgatccttccagccgctctggcattccacttgacatccagagacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggccgttatattcatcttactgatgcttgtgaccccatcgatgacaatgcgctgtgtcggcgtggggaacagagactttgtagaaggattgtcaggtgcgacctgggttgatgtggtcctggagcacggcgggtgcgtgacgactatggcaaagaataaacccacactagacattgagctccagaagaccgaagccactcaactggctacacttaggaaactgtgtatcgagggaaagattaccaacatcacgaccgatagccggtgccctacacagggcgaagccgtgttgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcaaaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgtgccctgtaaaatccctttctccacagaggacggccaaggtaaggttcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggagaaaaagaagctccgacctagatggctggacgctcggacatattctgatccccttgccctgaaagagtttaaggacttcgcagctggaaggaaatcgatcgccctcgatttggttaccgaaattggccgcgtcccaactcacctggcacatagaacaaggaatgccctagacaacctggtgatgctccacacgagcgagcatggtgggaaggcttaccggcacgcggtggaggaacttcctgagaccatggaaactctgttattgctgggcctcatgatcctgcttacaggaggcgccatgctgtttctcatatcagggaaaggaatcggtaagacctccattggcttgatctgtgtcattgcaagttctgggatgctgtggatggctgagatccccttacaatggatagccagcgccattgttctagagttctttatgatggtgctgctcatcccagaacctgagaagcagcgtaccccgcaggataatcaacttgcatatgtagtgattggaatcctgacattggctgccataatcgcggctaacgaaatgggcctgctcgagactacgaaacgcgacctgggtatgtccaaggaacccggggtcgtgtcaccaacctcttaccttgatgttgacctccaccctgccagcgcatggacactgtacgccgtggctactaccgtcattacacccatgttgcgacataccatcgagaatagtactgcaaacgtatccctggccgcgattgctaaccaggccgtggttttaatgggcctagacaaaggatggccaatcagcaagatggatctgggcgtgcctctccttgcactggggtgctattctcaggtcaatcccttgacgctgacagccgctgtgctcctgcttataacccactacgccattatcggaccgggcttacaggcaaaagctactagagaggcccaaaagaggaccgcggccggtatcatgaagaacccaacagtcgacgggattatgactatcgatctggaccctgtgatatatgattcaaaattcgaaaagcagctcggacaggttatgttgctggtgctatgtgcagtacagctgctccttatgcggacctcctgggctctgtgcgaggccttgacactggcaacgggccccattaccactctctgggaaggtagtccaggcaaattttggaatacaaccatcgctgtgagcatggccaacattttccgcgggtcgtacctggccggagcgggcttagctttttctatcatgaagtccgtcgggactggaaaaagaggcacaggtagccaaggggagacccttggagaaaagtggaagaaaaagctgaatcagctctcaaggaaagagttcgacctatataagaaaagtggcataacggaggttgatcggaccgaagcaaaggagggtctgaaacgaggcgaaatcacacatcacgccgtgtctagagggtccgctaagttgcagtggtttgtcgagcgcaacatggtgattcccgaaggaagggtaatcgacctgggctgtgggcggggaggctggagctactattgcgccggtctcaagaaagtgactgaggttcgtgggtacaccaagggaggccctggccatgaggaaccggtgcccatgtcaacatacgggtggaatattgtcaaacttatgagtggaaaggatgtgttctatctgccacctgagaaatgtgacactttgctgtgcgatatcggtgaaagctccccctctcctaccgtcgaggagagcagaacaattagggtgctcaagatggttgaaccatggttaaagaacaatcagttctgtatcaaagtactgaacccctacatgcctaccgtgatagagcaccttgaacgcctgcaacggaagcacggcgggatgctagtccgaaatccactctccagaaactcaactcatgagatgtattggatttctaatggaacgggcaacatcgtggcaagtgttaatatggtgtcgaggctgttgctgaaccgctttacaatgacccaccggagacccactatcgaaaaagacgtcgatctcggtgccgggacccgtcatgtgaacgctgagccggagacacctaatatggacgtaattggagaaaggataaagcggatcaaagaggaacacaacagcacgtggcactacgacgatgagaatccatataagacctgggcgtaccatggctcctatgaagtgaaggccactggctctgcatcaagcatgattaacggggttgtcaaacttctgacaaagccctgggacgtggtgcctatggtcacccagatggctatgactgatacaaccccattcggacagcaacgcgtttttaaagagaaggtggacacacgaactcccagatccatgccgggtaccaggcgggtaatgggcatcacggccgagtggttatggcgcaccctggggagaaataaaaagcctaggttgtgcacacgagaagagttcactaagaaagtgcggaccaacgcagccatgggagctgtctttacagaagagaatcagtgggatagtgccaaggcggcagtggaagacgaggatttctggaaactcgttgaccgtgagagagaactgcacaagctaggcaaatgtggttcttgcgtgtacaacatgatggggaagcgcgagaagaaacttggagaatttggcaaagccaaaggcagcagggctatttggtacatgtggctgggggcccggtatctcgagttcgaggcactgggatttttgaatgaagatcattggttctcaagagagaactcctacagtggtgtcgaaggcgaggggctgcacaagctcggatatatccttcgcgacataagcaaaatccccggcggtgctatgtacgccgatgacactgctgggtgggacaccaggattacggaagatgacctgcataatgaggagaagatcacacagcagatggatccagaacaccgacaattagccaacgcaatttttaaactgacctatcagaataaggtggtaaaggttcagcggcctactcccacaggaaccgtgatggacatcatatctagaaaagatcagaggggctccggccaagtcgggacttacggattgaacaccttcacaaatatggaggcgcagctcattcgccagatggaaggtgagggcgtgctgtcaaaggccgacctagaaaacccacaccttcccgagaaaaagatcacgcagtggctggagaccaaaggggtggaacgtctcaagcggatggctatcagcggagatgactgcgtcgttaagcctattgatgacagatttgccaacgcactgttggctttaaatgatatgggcaaagtgaggaaggacataccacaatggcagccgtcgaaaggttggcatgattggcagcaggtacccttctgttctcaccatttccacgagctgatcatgaaggacgggcgcaaactcgtggtcccttgccgaccacaagacgaacttattggacgggccagaatcagtcagggcgcaggctggtccctgagggagactgcctgtctagggaaggcgtatgctcagatgtggagcctgatgtactttcaccgcagagatctccggttggcctcaaacgcaatttgctccgccgtgcccgttcattgggtgcctacatctaggaccacttggagcatccacgctcatcaccaatggatgacaaccgaagacatgctgacggtctggaatcgtgtgtggatagaggataacccatggatggaggacaagacacccgtaaccacttgggaaaatgttccttaccttggaaaacgagaggatcagtggtgtggtagtctgatcggcctcacctcccgcgccacatgggcacagaacattccgactgctatccagcaagtgaggagcttaattgggaatgaagagttcctggactatatgccatctatgaagcggtttaggaaagaggaagagtcagaaggagccatctggtga

SEQ ID NO: 15182 - RNA, 9873 nt, synthetic construct
  misc_feature 1..9873: note = derived and/or modified CDS sequence (opt3) from DENV-3__GQ868573__SS-prME
  source 1..9873: mol_type = other RNA
accagcttctgcctgatgatgatcctccccgcagctcttgcatttcacctgacatccagagacggcgaacctaggatgattgtggggaagaacgaacggggaaagtctttgttattcaagactgcatcaggtattaatatgtgtacgctgatcgcgatggatctcggcgaaatgtgcgacgataccgtcacatacaaatgtccacatattactgaagttgagccggaagacatcgattgctggtgtaacctcaccagtacatgggtgacctatgggacttgcaatcaggctggagagcaccgccgagacaagcgtagcgtagccctggcaccccatgtgggcatgggtcttgatacaagaacccagacgtggatgtccgccgagggggcttggaggcaggtcgaaaaagtggagacttgggcactgcggcaccctggatttaccattttggccctcttcctggctcattacatcggcacatctctgactcagaaggccgttatatttatcctcttaatgctggtgaccccatcgatgacaatgcgctgtgtcggcgtggggaacagagacttcgtagaaggactttcaggtgcgacctgggttgatgtggtcttggagcacggcgggtgcgtgacgactatggcaaagaataaacccacactggacattgagttgcagaagaccgaagccactcaactcgctacactgaggaaactttgtatcgagggaaagattaccaacatcacgaccgatagccggtgccctacacagggcgaagccgtgctgccagaggaacaggaccagaattatgtctgtaaacacacttacgttgatcgcggttgggggaacggatgcggcttgtttggcaaggggagtctcgtgacctgcgcaaagttccaatgtctggagcccatagagggaaaagtagtgcagtatgaaaatttaaagtacacagtcattatcactgtgcataccggtgaccagcaccaggttggcaacgagacacaaggggtgaccgctgaaattactcctcaggcctccacgacagaggcgatcctgccagaatatggaaccctcggccttgagtgctctccgcgaactggtctggactttaatgagatgatcttgctaaccatgaaaaacaaggcctggatggtccatagacagtggttctttgatctgcccctcccttggacaagcggggcaaccactgaaacaccaacgtggaataggaaagagctgcttgtgaccttcaagaacgctcacgccaaaaagcaagaagtagttgtgctgggctcccaggagggagctatgcacactgccttgacaggcgcaaccgaaattcaaaattcagggggaacaagtatatttgccggtcatctcaagtgtcggctgaaaatggacaagttagagctgaaaggcatgagctacgctatgtgcactaacaccttcgtcctaaagaaagaggtgtctgaaacgcagcacgggaccatcctcattaaggtcgagtacaagggagaagatgtgccctgtaaaatccctttctccacagaggacggccaaggtaaggcgcataacgggcgtctgataactgcaaatccagttgtgaccaaaaaggaggaacccgtaaacattgaggccgaaccgccttttggcgagtcaaatatcgtcatcggaattggcgataacgctcttaaaatcaattggtataagaaggggagcagtattggaaaaatgttcgaagccacagcacgcggtgccagaaggatggctatattgggcgacactgcctgggattttgggtctgtgggaggcgttctgaactccctcggtaagatggtgcaccagatcttcgggagcgcatacaccgcgctgttttcgggcgtctcttgggtgatgaaaattggaatcggcgtacttctgacgtggatcgggctaaattccaagaacacatcaatgagtttcagctgcattgctataggaatcattaccctctatctgggcgccgtggttcaggcagacatgggttgtgtcatcaattggaaagggaaggagttaaagtgcggatccggcatttttgtgactaacgaggtgcatacatggaccgaacagtacaaattccaagccgattctcccaagcggctggctactgccatcgccggtgcttgggagaatggcgtctgtgggatacgaagcaccacacgcatggaaaacctactctggaaacagatcgccaatgagctgaactatattctttgggaaaataacatcaagttgacggttgtggtgggagacattatcggcgtactggagcaggggaaaagaaccctcactccacagcctatggagctgaagtactcatggaaaacatggggaaaggcgaagatagtcaccgccgaaacacaaaacagttcctttattatcgatggccccaatactccagagtgccccagcgcttctagggcatggaacgtgtgggaagttgaggactatggtttcggggtgtttaccacgaatatttggttaaaactgcgggaagtctacacacagctttgtgaccaccgcttgatgtcagccgctgtgaaggatgagagagccgttcacgcagacatgggatactggatcgagagtcagaaaaacggcagctggaagctcgaaaaagcgtccctgatagaggtgaagacctgcacttggcctaagtctcataccctatggtcgaatggtgtactggaaagcgatatgatcattccaaaatccctcgccggcccgatctcacagcacaactataggcccgggtaccatacacaaactgctggaccttggcacctgggcaaacttgagttggacttcaattattgcgaggggaccacagtcgtgattacggaaaactgtggaacccgtggcccaagtctgcggactacaaccgtgtctggtaaattaatccacgagtggtgctgtcgaagctgcactctcccacctctgagatacatgggggaagatggatgttggtatggcatggagataaggccaatttccgaaaaggaggagaatatggtcaaatcacttgttagcgccggttctggcgaagtggacaactttacaatgggggtactgtgcttggcaatcctcttcgaggaagtgatgcgcggaaagttcggcaagaaacatatgatcgctggggtctttttcacctttgtgctgctactgtccggacagattacgtggcgggatatggcccacactctcatcatgattggcagtaatgcaagcgacagaatgggtatgggggttacctacctggcccttatagctacattcaagatccagccctttttggcgctgggattctttttaaggaaactcacctctcgcgagaacctgcttctgggcgtgggcctagccatggcaactacactccaactgccggaagatattgagcagatggctaatgggatcgccttgggactgatggccttaaagctcattacccagttcgagacatatcagctgtggactgctcttatctccctgacctgttcaaacacgatatttacattgaccgtcgcatggcgaactgccaccctcatcctggcgggtgtgagtctactgcctgtttgccaaagctcgtccatgcggaaaacagactggcttccaatgactgtggctgccatgggcctaccccctctgcccttgttcatattttctctgaaggataccttaaagcgtagaagctggccactcaatgaaggggtcatggcagtaggactggtgtcaatccttgccagttccctgttgaggaacgacgttcctatggctggccccctcgtggccggtgggctgctaattgcctgttacgtcatcacgggaacatctgcggatctgaccgtggagaaagctgccgacgtaacttgggaagaggaagcagagcagacaggcgtgagccataaccttatgataaccgtcgacgatgacggcactatgcgcattaaggatgacgagacagaaaatatcctcaccgttctgttgaaaacggccttactgatcgtgtccgggattttcccatactcaataccggctactctcctggtgtggcacacctggcagaagcagacacaacggagcggagtcctttgggatgtgcctagtcccccagagacccagaaagccgaactggaggagggtgtttatagaatcaagcagcagggcatttttgggaaaacacaagtaggagtgggcgtccagaaggaaggtgtgttccatactatgtggcacgttaccagaggggcagtgttgacgtacaacggaaagcgactagagcccaattgggcttctgtcaaaaaggacctgatctcctatggcggcgggtggcgcctcagcgcccagtggcaaaaaggagaagaggtgcaggtaattgcggtcgaacctggtaagaaccccaagaatttccagacaatgcccggcacttttcagaccacaaccggggagatcggagccatagcactggatttcaagcctggcacttcgggttcaccgatcattaaccgggaggggaaggtggttggactttacggcaatggcgtggtcaccaaaaacgggggatatgtgtctggtatcgctcaaacaaatgccgaaccagacggccccacgcctgagttagaagaggaaatgtttaagaaaagaaacctgactattatggatctccacccagggagtggaaagaccaggaaatacttgcccgctatcgttcgtgaggcaataaagcgccggctgagaacactcattctggcccctaccagggtggtcgccgctgagatggaagaggcgcttaagggcctgccgatccgatatcagactacagcaaccaaatccgaacatacgggtcgggagatcgtggacttgatgtgccacgccactttcacaatgcgcctactgagccccgtaagagtgccaaattacaacctcattatcatggatgaagctcattttaccgaccctgcctctatagcagccagggggtacattagcacccgggttggaatgggcgaggctgcggccatcttcatgactgcaacacccccaggcaccgctgatgcctttcctcagtccaatgcacccattcaggacgaggaacgagacatcccagagagatcatggaacagtgggaatgaatggataacagatttcgccggaaagactgtctggtttgtgccgagcattaaagctggtaacgacatcgccaactgtttacgcaagaatggcaaaaaggtgatccaactgtctaggaagacgttcgataccgagtatcagaaaacaaaacttaacgactgggattttgtcgtaactaccgacatttccgagatgggggcgaatttcaaagcagatcgtgtgatcgaccctcggagatgcctgaagcccgttattctcacagatggaccagaaagggtgatattggccggccccatgcctgtcaccgctgcctcagctgcacagcgccgaggtagagtggggcggaacccacagaaagagaatgaccaatacatcttcactggccagcccctgaacaatgatgaagaccacgcccattggacggaggctaagatgctcctggacaacattaatacccctgaaggaatcatcccggccctttttgagccagagagggaaaagagtgcagcgattgatggcgagtatcgcctaaaaggggaaagccgtaagacattcgttgagctgatgagacggggagacttgcccgtgtggttagcccacaaagtcgcttccgaaggtataaagtacactgataggaaatggtgctttgacggccagcgcaacaatcagatcctggaggagaacatggatgtggaaatttggaccaaggagggggagaagaagaagctccgacctagatggctggacgcccggacatattctgatccccttgcactgaaagagttcaaggactttgctgccggaaggaaatcgatcgcactcgatttggtaaccgaaattggccgcgtgccaactcacctggcccatagaacaaggaatgctctagacaacctggttatgctccacacgagcgagcatggtgggaaggcgtaccggcacgccgtcgaggaacttcctgagaccatggaaactctgttattgctgggcctcatgatcctgcttacaggaggcgcaatgctgttcctcatatcagggaaaggaatcggtaagacctccattggcttgatctgtgtgattgctagttctgggatgctgtggatggccgagatccccttacaatggatagccagcgcaattgtgctagagtttttcatgatggtcctgctcatcccagaacctgagaagcagcgtaccccgcaggataatcaacttgcttatgttgtgattggaatcctgacattggccgcgataatcgctgccaacgaaatgggcctgctcgagactacgaaacgcgacctgggtatgtccaaggaacccggggtagtgtcaccaacctcttaccttgatgtcgacctccaccctgcaagcgcctggacactgtacgctgtggcaactaccgttattacacccatgttgcgacataccatcgagaatagtactgccaacgtgtccctggcggctattgccaaccaggcagtcgtattaatgggcctagacaaaggatggccaatcagcaagatggatctgggcgtgcctctccttgccctggggtgctattctcaggttaatcccttgacgctgacagctgccgtgctcctgcttataacccactacgcaattatcggaccgggcttacaggctaaagccactagagaggcgcaaaagaggaccgccgcaggtatcatgaagaacccaacagtcgacgggattatgactatcgatctggaccctgtgatatatgattcaaaatttgaaaagcagctcggacaggtcatgttgctggtgctatgtgctgttcagctgctccttatgcggacctcctgggccctgtgcgaggcattgacactggctacgggccccattaccactctctgggaaggtagtccaggcaaattctggaatacaaccatcgccgtgagcatggccaacatttttcgcgggtcgtacctggcgggagctggcttagcattctctatcatgaagtccgtagggactggaaaaagaggcacaggtagccaaggggagacccttggagaaaagtggaagaaaaagctgaatcagctctcaaggaaagagtttgacctatataagaaaagtggcataacggaggtggatcggaccgaagccaaggagggtctgaaacgaggcgaaatcacacatcacgctgtctctagagggtccgccaagttgcagtggttcgttgagcgcaacatggtgattcccgaaggaagggtcatcgacctgggctgtgggcggggaggctggagctactattgcgcaggtctcaagaaagtgactgaggtacgtgggtacaccaagggaggccctggccatgaggaaccggtgcccatgtcaacatacgggtggaatattgttaaacttatgagtggaaaggatgtgttctatctgccacctgagaaatgtgacactttgctgtgcgatatcggtgaaagctccccctctcctaccgtcgaggagagcagaacaattagggtgctcaagatggtcgaaccatggttaaagaacaatcagttttgtatcaaagtgctgaacccctacatgcctaccgttatagagcaccttgaacgcctgcaacggaagcacggcgggatgctagtacgaaatccactctccagaaactcaactcatgagatgtattggatttctaatggaacgggcaacatcgtggccagtgtcaatatggtgtcgaggctgttgctgaaccgcttcacaatgacccaccggagacccactatcgaaaaagacgttgatctcggtgctgggacccgtcatgtgaacgcggagccggagacacctaatatggacgtcattggagaaaggataaagcggatcaaagaggaacacaacagcacgtggcactacgacgatgagaatccatataagacctgggcctaccatggctcctatgaagtgaaggcaactggctctgcttcaagcatgattaacggggtagtgaaacttctgacaaagccctgggacgttgtccctatggtgacccagatggccatgactgatacaaccccatttggacagcaacgcgtgttcaaagagaaggtcgacacacgaactcccagatccatgccgggtaccaggcgggttatgggcatcacggcagagtggttatggcgcaccctggggagaaataaaaagcctaggttgtgcacacgagaagagtttactaagaaagtgcggaccaacgccgctatgggagccgtattcacagaagagaatcagtgggatagtgcgaaggcagccgtggaagacgaggatttttggaaactcgtcgaccgtgagagagaactgcacaagctaggcaaatgtggttcttgcgtgtacaacatgatggggaagcgcgagaagaaacttggagagttcggcaaagctaaaggcagcagggccatttggtacatgtggctgggggcacggtatctcgagtttgaggctctgggattcttgaatgaagatcattggttttcaagagagaactcctacagtggtgttgaaggcgaggggctgcacaagctcggatatatccttcgcgacataagcaaaatccccggcggtgccatgtacgctgatgacactgccgggtgggacaccaggattacggaagatgacctgcataatgaggagaagatcacacagcagatggatccagaacaccgacaattagcaaacgcgattttcaaactgacctatcagaataaggtggtcaaggtgcagcggcctactcccacaggaaccgtaatggacatcatatctagaaaagatcagaggggctccggccaagttgggacttacggattgaacacctttacaaatatggaggcccagctcattcgccagatggaaggtgagggcgtgctgtcaaaggctgacctagaaaacccacaccttcccgagaaaaagatcacgcagtggctggagaccaaaggggtcgaacgtctcaagcggatggccatcagcggagatgactgcgtggtgaagcctattgatgacagattcgcaaacgctctgttggccttaaatgatatgggcaaagtcaggaaggacataccacaatggcagccgtcgaaaggttggcatgattggcagcaggttcccttctgttctcaccattttcacgagctgatcatgaaggacgggcgcaaactcgtggtaccttgccgaccacaagacgaacttattggacgggcaagaatcagtcagggcgccggctggtccctgagggagactgcgtgtctagggaaggcttatgcccagatgtggagcctgatgtacttccaccgcagagatctccggttggcatcaaacgccatttgctccgctgtgcccgtccattgggtgcctacatctaggaccacttggagcatccacgcccatcaccaatggatgacaaccgaagacatgctgacggtttggaatcgtgtgtggatagaggataacccatggatggaggacaagacacccgtcaccacttgggaaaatgtgccttaccttggaaaacgagaggatcagtggtgtggtagtctgatcggcctcacctcccgcgcaacatgggctcagaacattccgactgccatccagcaagtaaggagcttaattgggaatgaagagtttctggactatatgccatctatgaagcggttcaggaaagaggaagagtcagaaggagcgatctggtga

SEQ ID NO: 15183 - RNA, 9873 nt, synthetic construct
  misc_feature 1..9873: note = derived and/or modified CDS sequence (opt3) from DENV-3__GQ868574__SS-prME
  source 1..9873: mol_type = other RNA
accagcctgtgcctcatgatgatccttcccgcagctctggcattccacttgacatccagggacggcgagcctaggatgattgtggggaagaacgaacggggaaagtctttactgtttaagactgcatcaggtataaatatgtgtacgctaatcgcgatggatctcggcgaaatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggccgttatattcatcttactgatgcttgtgaccccatcgatgacaatgcgctgtgtcggcgtggggaacagagactttgtagaaggattgtcaggtgcgacctgggttgatgtggtcctggagcacggcgggtgcgtgacgactatggcaaagaataaacccacactagacattgagctccagaagaccgaagccactcaactggctacacttaggaaactgtgtatcgagggaaagattaccaacatcacgaccgatagccggtgccctacacagggcgaagccgtgttgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcaaaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgccggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgcttctagggcatggaacgtgtgggaagttgaggactatggttttggggtgttcaccacgaatatttggctgaaacttcgggaagtctacacacagttgtgtgaccaccgcctcatgtcagccgctgtgaaggatgagagagccgttcacgcagacatgggatactggatcgagagtcagaaaaacggcagctggaagctggaaaaagcgtccctaatagaggtgaagacctgcacttggcctaagtctcataccctgtggtcgaatggtgtactcgaaagcgatatgatcattccaaaatccctggccggcccgatctcacagcacaactataggcccgggtaccatacacaaactgctggaccttggcaccttggcaagttggagctggactttagttattgcgaggggaccacagtcgtgattacggaaaattgtggaacccgtggcccatctttacggactacaaccgtgagcggtaaactcatccacgagtggtgctgtcgatcctgcactctgccccctcttagatacatgggggaagatggatgttggtatggcatggagataaggccaatttcagaaaaggaggagaacatggtcaaaagcctggtttctgccggttccggcgaagtggacaatttcacaatgggggtattgtgcctcgcaatcctgtttgaggaagtgatgcgcggaaagttcggcaagaaacatatgatcgctggggtcttctttaccttcgtgctactgctcagtggacagattacgtggcgggatatggcccacactctgatcatgattggcagcaacgcatctgacagaatgggtatgggggttacctaccttgccttgatagctacatttaagatccagcccttcctggcgttaggatttttcctcaggaaactgacctcccgcgagaatcttctgctaggcgtgggcctcgccatggcaactacactgcaattgccggaagatattgagcagatggctaacgggatcgccctgggattaatggccctcaagctgattacccagtttgagacatatcagctttggactgctctgatctcattgacctgtagtaatacgatattcacactcaccgtcgcatggcgaactgccaccctgatcctagcgggtgtgagcctgcttcctgtttgccaatcgtcctctatgcggaaaacagactggctcccaatgactgtggctgccatgggcgtcccacctctgcccttgtttattttcagcctgaaggataccttaaagcgtagatcatggccactcaacgaaggggtaatggcagtgggactggttagtatccttgcctcctctctgttgaggaatgacgtgcctatggctggccccctcgtcgccggtgggctgctaattgcctgttacgtgatcacgggaacaagcgcggatctgaccgtagagaaagctgccgacgtgacttgggaagaggaagcagagcagacaggcgtctcccataaccttatgataaccgttgacgatgacggcactatgcgcattaaggatgacgagacagaaaacatcctcaccgtgctgttgaaaacggccttactgatcgtgtcagggatttttccatacagcataccggctactctcctggtctggcacacctggcagaagcagacacaacggagtggagtgctttgggatgttccttctcccccagagacccagaaagccgaactggaggagggtgtatatagaatcaagcagcagggcattttcgggaaaacacaagtgggagtcggcgtgcagaaggaaggtgtttttcatactatgtggcacgtgaccagaggggcagtcttgacgtacaatggaaagcgactagagcccaactgggcttccgtgaaaaaggacctgatcagctatggcggcgggtggcgcctctcggcccagtggcaaaaaggagaagaggtacaggtcattgcggtggaacctggtaagaatcccaagaacttccagacaatgcccggcactttccagaccacaaccggggagatcggagccatagcactggattttaagcctggcacttcaggttctccgatcattaatcgggaggggaaggttgtgggactttacggcaacggcgtcgtgaccaaaaatgggggatatgttagtggtatcgctcaaacaaacgccgaaccagacggccccacgcctgagttagaagaggaaatgttcaagaaaagaaatctgactattatggatctccacccagggtccggaaagaccaggaaatacttgcccgctatcgtgcgtgaggcaataaagcgccggctgagaacactcattctggcccctaccagggtcgtggccgctgagatggaagaggcgcttaagggcctgccgatccgatatcagactacagcaaccaaaagcgaacatacgggtcgggagatcgtagacttgatgtgccacgccacttttacaatgcgcctactgtctcccgtgagagttccaaactacaatctcattatcatggatgaagctcatttcaccgaccctgccagcatagcagccagggggtacatttccacccgggtcggaatgggcgaggctgcggccatctttatgactgcaacacccccaggcaccgctgatgccttccctcagtcaaacgcacccattcaggacgaggaacgagacatcccagagagaagttggaatagcgggaacgaatggataacagattttgccggaaagactgtgtggttcgtgccgtctattaaagctggtaatgacatcgccaactgtttacgcaagaacggcaaaaaggtcatccaactgtccaggaagacgtttgataccgagtatcagaaaacaaaacttaatgactgggatttcgtagtgactaccgacatttcagagatgggggcgaactttaaagcagatcgtgttatcgaccctcggagatgcctgaagcccgtgattctcacagatggaccagaaagggtcatattggccggccccatgcctgtgaccgctgccagtgctgcacagcgccgaggtagagttgggcggaatccacagaaagagaacgaccaatacatcttcactggccagcccctgaataacgatgaagaccacgcccattggacggaggctaagatgctcctggacaatattaacacccctgaaggaatcatcccggcccttttcgagccagagagggaaaagagcgcagcgattgatggcgagtatcgcctaaaaggggaatcccgtaagacatttgtggagctgatgagacggggagacttgcccgtctggttagcccacaaagtggcttctgaaggtataaagtacactgataggaaatggtgcttcgacggccagcgcaataaccagatcctggaggagaatatggatgtagaaatttggaccaaggagggggagaagaagaagctccgacctagatggctggacgcccggacatattcggatccccttgcactgaaagagtttaaggacttcgctgccggaaggaaaagcatcgcactcgatttggtgaccgaaattggccgcgttccaactcacctggcccatagaacaaggaacgctctagacaatctggtcatgctccacacgtcagagcatggtgggaaggcgtaccggcacgccgtggaggaacttcctgagaccatggaaactctgttattgctgggcctcatgatcctgcttacaggaggcgcaatgctgtttctcatatccgggaaaggaatcggtaagaccagtattggcttgatctgtgtgattgcttctagcgggatgctgtggatggccgagatccccttacaatggatagcctccgcaattgtcctagagttctttatgatggttctgctcatcccagaacctgagaagcagcgtaccccgcaggataaccaacttgcttatgtggtaattggaatcctgacattggccgcgataatcgctgccaatgaaatgggcatgctggagactacgaaacgcgacctcggtatgtcaaaggaacccggggtggcatctccaaccagctacctggatgtcgaccttcaccctgccagtgcttggacactctacgcagtggccactaccgttattacacccatgctgcgacataccatcgagaactccactgcgaatgtgagcttggctgccattgcaaaccaggccgtcgtactgatgggcttagacaaaggatggccaatctctaagatggatctaggcgtgcctctgctcgctcttgggtgctattcacaggttaaccccctgacgttgacagccgcagtgctgctcctgataacccactacgctattatcggaccgggccttcaggccaaagcgactagagaggcccaaaagaggaccgcagctggtatcatgaagaatccaacagtcgacgggattatgactatcgatttagaccctgtgatatatgattccaaattcgaaaagcagctgggacaggtcatgctcttggtgctgtgtgccgttcagctactgctcatgcggaccagttgggcactttgcgaggctctgacattggccacgggccccattaccactctgtgggaaggtagcccaggcaaattttggaacacaaccatcgccgtgtcgatggcgaatattttccgcgggtcttacctcgctggagcaggcctggccttttccatcatgaaaagcgtagggactggaaaaagaggcacaggttcacaaggggagaccttaggagaaaagtggaagaagaaacttaaccagctgagtaggaaagagttcgacctctataagaaatctggcataacggaggtggatcggaccgaagctaaagagggtctaaaacgaggcgaaatcacacatcacgccgtctccagagggagcgcaaagctgcagtggtttgttgagcgcaatatggtgattcccgaaggaagggtcatcgacttgggctgtgggcggggaggctggtcatactattgcgccggtctgaagaaagtgactgaggtacgtgggtacaccaagggaggccctggccatgaggaaccggtgcccatgagtacatacgggtggaacattgttaaactcatgagcggaaaggatgtgttctatcttccacctgagaaatgtgacactctgttgtgcgatatcggtgaatcctctcccagccctaccgtcgaggagtccagaacaattagggtgctgaagatggtcgaaccatggctcaagaataaccagttctgtatcaaagtgttaaatccctacatgcctaccgttatagagcacctggaacgccttcaacggaagcacggcgggatgctggtacgaaacccactatcaagaaattctactcatgagatgtattggattagtaacggaacgggcaatatcgtggcttcggtcaacatggtgagcaggctcctgttgaatcgctttacaatgacccaccggagacccactatcgaaaaagacgttgatctgggtgcggggacccgtcatgtgaacgccgagccggagacacctaacatggacgtcattggagaaaggataaagcggatcaaagaggaacacaattccacgtggcactacgacgatgagaacccatataagacctgggcataccatggctcttatgaagtgaaggctactggctcagccagctccatgattaatggggtagtgaaactccttacaaagccctgggacgttgtccctatggtgacccagatggcaatgactgatacaaccccattcggacagcaacgcgtgtttaaagagaaggtcgacacacgaactcccagaagtatgccgggtaccaggcgggttatgggcatcacggccgagtggctgtggcgcaccttagggagaaacaaaaagcctaggctgtgcacacgagaagagttcactaagaaagtgcggaccaatgctgccatgggagcggtatttacagaagagaaccagtgggattctgcaaaggccgctgtggaagacgaggatttctggaaattggtcgaccgtgagagagaactccacaagctgggcaaatgtggtagctgcgtgtacaatatgatggggaagcgcgagaaaaagctaggagaatttggcaaggccaaaggctcaagggcaatttggtacatgtggcttggggctcggtatctggagttcgaggccctcggatttctgaacgaagatcattggttctccagagagaatagttacagcggtgttgaaggcgaggggttgcacaagctgggatatatcctccgcgacatatctaaaatccccggcggtgctatgtacgccgatgacactgcagggtgggacaccaggattacggaagatgaccttcataacgaggagaagatcacacagcagatggatccagaacaccgacaactggcgaatgccatttttaaattaacctatcagaacaaggtggtcaaggtgcagcggcctactcccacaggaaccgtaatggacatcatatccagaaaagatcagaggggctcaggccaagttgggacttacggactgaataccttcacaaacatggaggctcagttgattcgccagatggaaggtgagggcgtgctcagcaaggccgacctggaaaatccacacctacccgagaaaaagatcacgcagtggcttgagaccaaaggggtcgaacgtctgaagcggatggcaatctcgggagatgactgcgtggtgaagcctattgatgacagatttgctaacgccctcctggcattgaacgatatgggcaaagtcaggaaggacataccacaatggcagccgtctaaaggttggcatgattggcagcaggttcccttctgtagtcaccatttccacgagttaatcatgaaggacgggcgcaaactggtggtaccttgccgaccacaagacgaactcattggacgggccagaatctcccagggcgcgggctggagccttagggagactgcttgtctggggaaggcctatgcacagatgtggtcactaatgtactttcaccgcagagatctgcggctcgcctccaatgctatttgctctgccgtgcccgtccattgggtgcctacaagcaggaccacttggagtatccacgcacatcaccaatggatgacaaccgaagacatgttgacggtttggaaccgtgtgtggatagaggataatccatggatggaggacaagacacccgtcaccacttgggaaaacgtgccttacctgggaaaacgagaggatcagtggtgtggttcccttatcggcctgaccagccgcgctacatgggcccagaatattccgactgcgatccagcaagtaagatctctcattgggaacgaagagttcttagactatatgccatcaatgaagcggtttaggaaagaggaagagagtgaaggagctatctggtga

SEQ ID NO: 15184 - RNA, 9873 nt, synthetic construct
  misc_feature 1..9873: note = derived and/or modified CDS sequence (opt3) from DENV-3__GQ868575__SS-prME
  source 1..9873: mol_type = other RNA
accagcctgtgcctcatgatgatccttcccgcagctctggcattccacttgacatccagagacggcgagcctagaatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtcgcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggccgttatattcatcttactgatgcttgtgaccccatcgatgacaatgcgctgtgtcggcgtggggaacagagactttgtagaaggattgtcaggtgcgacctgggttgatgtggtcctggagcacggcgggtgcgtgacgactatggcaaagaataaacccacactagacattgagctccagaagaccgaagccactcagctggctacacttaggaaactgtgtatcgagggaaagattaccaacatcacgaccgatagccggtgccctacacagggcgaagccgtgttgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcaaaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgccggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacttcagttttattatcgatggccccaatactccagagtgcccctccgctagcagggcatggaacgtgtgggaagttgaggactatggtttcggggtgtttaccacgaatatttggctgaaacttcgggaagtctacacacagttgtgtgaccaccgcctcatgtctgccgctgtgaaggatgagagagccgttcacgcagacatgggatactggatcgagtcacagaaaaacggcagttggaagctggaaaaagcgagcctaatagaggtgaagacctgcacttggcctaagtcccataccctgtggtctaatggtgtactcgaatcggatatgatcattccaaaaagcctggccggcccgatctcccagcacaactataggcccgggtaccatacacaaactgctggaccttggcaccttggcaagttggagctggacttcaattattgcgaggggaccacagtcgtgattacggaaaactgtggaacccgtggcccatcattacggactacaaccgtgagtggtaaactcatccacgagtggtgctgtcgatcttgcactctgccccctcttagatacatgggggaagatggatgttggtatggcatggagataaggccaattagcgaaaaggaggagaatatggtcaaatccctggtttcagccggtagcggcgaagtggacaactttacaatgggggtattgtgcctcgcaatcctgttcgaggaagtgatgcgcggaaagttcggcaagaaacatatgatcgctggggtctttttcacctttgtgctactgctctctggacagattacgtggcgggatatggcccacactctgatcatgattggctccaatgcaagtgacaagatgggtatgggggttacctaccttgccttgatagctacattcaaaatccagccctttctggcgttaggattctttctcagaaagctgaccagcagggagaaccttctgctaggcgtgggcctcgccatggcaactacactgcaattgccggaagatattgagcagatggctaatgggatcgccctgggattaatggccctcaaactgattacccagttcgagacatatcagctttggactgctctgatctctttgacctgttccaacacgatatttacactcaccgtcgcatggcgcactgccaccctgatcctagcgggtgtgtcactgcttcctgtttgccaaagtagctcgatgcgaaagacagactggctcccaatgactgtggctgccatgggcgtaccccctctgcccttgttcatttttgggctgaaggataccttaaaacggcgttcctggccactcaatgaaggagtaatggcagtgggcctggtttctatccttgccagctcactgttgagaaacgacgtgcctatggctggtcccctcgtcgcagggggactgctaattgcctgttacgtgatcacgggcacaagtgcggatctgaccgtagagaaggctgccgacgtgacttgggaagaggaagcagagcagacaggcgtctcccataaccttatgataaccgttgacgatgacgggactatgaggattaaagatgacgagacagaaaatatcctcaccgtgctgttgaagacggccttactgatcgtgtctggaattttcccatacagcataccggctactctcctggtctggcacacctggcagaaacagacacaacgctccggtgtgctttgggatgttccttcacccccagagacccagaaggccgaactggaggagggcgtatatcggatcaaacagcaggggatttttggaaagacacaagtgggcgtcggtgtgcagaaggaaggggttttccatactatgtggcacgtgaccagaggagcagtcttgacgtacaacggcaaaaggctagagcccaattgggctagcgtgaagaaagacctgatcagttatggcgggggatggcgactctctgcccagtggcaaaagggtgaagaggtacaggtcattgcggtggaacctggcaaaaacccaaagaatttccagacaatgcccgggacttttcagaccacaaccggagagatcggcgccatagcactggatttcaagcctggtacttccgggagcccgatcattaaccgcgagggaaaagttgtgggcctttacggcaatggggtcgtgaccaagaacggaggttatgtttcgggcatcgctcaaacaaatgccgaaccagacgggcccacgcctgagttagaagaggaaatgtttaaaaagcggaacctgactattatggatctccacccaggatcaggcaaaaccagaaagtacttgcccgctatcgtgagggaggcaataaagcgtcgcctgcggacactcattctggcccctaccagagtcgtggccgctgagatggaagaggcgcttaaaggtctgccgatcaggtatcagactacagcaaccaagtctgaacatacggggcgagagatcgtagacttgatgtgccacgccactttcacaatgcggctactgagtcccgtgcgcgttccaaattacaacctcattatcatggatgaagctcattttaccgaccctgcctccatagcagccagaggatacattagcaccagggtcggcatgggcgaggctgcggccatcttcatgactgcaacacccccagggaccgctgatgcctttcctcagtctaatgcacccattcaggacgaggaacgggacatcccagagcgaagctggaactccggaaatgaatggataacagatttcgccggtaaaactgtgtggtttgtgccgtcaattaaggctggcaacgacatcgccaactgtttaaggaagaatgggaagaaggtcatccaactgagtcgcaaaacgttcgataccgagtatcagaagacaaaacttaacgactgggattttgtagtgactaccgacattagcgagatgggagcgaatttcaaggcagatagggttatcgaccctcgtcggtgcctgaaacccgtgattctcacagatggcccagaaagagtcatattggccggtcccatgcctgtgaccgctgcctctgctgcacagaggcgcgggcgagttggcagaaacccacagaaggagaatgaccaatacatcttcactggacagcccctgaacaatgatgaagaccacgcccattggacggaggctaagatgctcctggacaacattaatacccctgaaggcatcatcccggccctttttgagccagagcgggaaaaatccgcagcgattgatggggagtataggctaaagggagaatcacgcaaaacattcgtggagctgatgcgtagaggtgacttgcccgtctggttagcccacaaggtggctagtgaaggcataaaatacactgatcggaagtggtgctttgacgggcagaggaacaatcagatcctggaggagaacatggatgtagaaatttggaccaaagagggagaaaagaagaaactccgccctcgatggctggacgccagaacatatagcgatccccttgcactgaaggagttcaaagactttgctgccggccggaagtccatcgcactcgatttggtgaccgaaattggtagggttccaactcacctggcccatcgcacaagaaatgctctagacaacctggtcatgctccacacgtctgagcatgggggcaaagcgtacaggcacgccgtggaggaacttcctgagaccatggaaactctgttattgctgggactcatgatcctgcttacaggcggggcaatgctgttcctcatatcgggaaagggtatcggcaagaccagcattgggttgatctgtgtgattgcttcatccggaatgctgtggatggccgagatccccttacaatggatagccagtgcaattgtcctagagtttttcatgatggttctgctcatcccagaacctgagaaacagcggaccccgcaggataatcaacttgcttatgtggtaattggcatcctgacattggccgcgataatcgctgccaacgaaatgggtctgctcgagactacgaagcgtgacctggggatgtctcgcgaacccggcgtggtcagcccaacctcctaccttgatgtggacctccaccctgcatcagcctggacactgtacgctgttgcaactaccgtgattacacccatgttgcgacataccatcgaaaattctactgccaacgtcagcctggcggctattgccaaccaggcagtagtgttaatgggactagacaaaggctggccaatcagtaagatggatctgggggttcctctccttgccctgggatgctattcccaggtgaatcccttgacgctgacagctgccgtcctcctgcttataacccactacgcaattatcggcccgggtttacaggctaaagccactagagaggcgcaaaagaggaccgccgcagggatcatgaagaacccaacagtggacggaattatgactatcgatctggaccctgtcatatatgatagcaaatttgaaaagcagctcggccaggtgatgttgctggttctatgtgctgtgcagctgctccttatgcggacctcttgggccctgtgcgaggcattgacactggctacgggtcccattaccactctctgggaaggctcaccagggaaattctggaatacaaccatcgccgtatccatggccaacatttttcgcggaagttacctggcgggcgctgggttagcattcagcatcatgaagtcggtgggaactggcaaaagaggtacagggtctcaaggagagacccttggcgaaaagtggaagaaaaagctgaatcagctctccaggaaagagtttgacctatataagaaaagcggtataacggaggtcgatcggaccgaagccaaggagggcctgaaacgaggggaaatcacacatcacgctgtttcaagaggaagtgccaagttgcagtggttcgtggagcgcaacatggtcattcccgaaggcagggtgatcgacctggggtgtggacggggcggttggtcttactattgcgcagggctcaagaaagtaactgaggtgcgtggatacaccaagggcggccctgggcatgaggaaccggttcccatgtccacatacggatggaatattgtgaaacttatgagcggtaaggatgtcttctatctgccacctgagaaatgtgacactttgctgtgcgatatcggcgaatcaagtcccagccctaccgtggaggagtccagaacaattagggtcctcaagatggtggaaccatggttaaagaacaatcagttttgtatcaaagttctgaacccctacatgcctaccgtaatagagcaccttgaacgcctgcaacggaagcacgggggaatgctagtgcgaaatccactctctagaaacagcactcatgagatgtattggatttccaatggcacgggtaacatcgtcgcctcagtgaatatggtttctaggctgttgctgaaccgcttcacaatgacccaccggagacccactatcgaaaaagacgtggatctcggggctggaacccgtcatgtcaacgcggagccggagattcctaatatggacgtgataggcgaaaggatcaagcggattaaagaggaacacaacagtacatggcactacgacgatgagaatccatataagacgtgggcctaccatggctcgtatgaagtaaaggcaaccgggagcgcttcctctatgatcaacggagtggttaaacttctgactaagccctgggacgtcgtgcctatggtgacacagatggccatgaccgatactacaccatttggtcagcaacgcgtcttcaaagagaaggttgacacccgaacacccagatcaatgccgggcactaggcgggtgatggggattaccgcagagtggttatggcgcacgctgggaagaaataaaaagcctaggttgtgcacccgagaagagtttacaaagaaagtacggactaacgccgctatgggcgccgtgttcaccgaagagaatcagtgggatagcgcgaaggcagccgtcgaagacgaggatttttggaaactcgtggaccgtgagagagaactgcacaagctaggtaaatgtgggtcctgcgtttacaacatgatgggaaagcgcgagaagaaacttggcgagttcggcaaagctaaagggagtagggccatctggtacatgtggctgggagcacggtatctcgagtttgaggctctgggtttcttgaatgaagatcattggttttctagagagaacagctactcaggcgtggaaggggagggactgcacaagctcggctatatacttcgcgacatctccaaaattcccggtggggccatgtacgctgatgacacagccggatgggacactaggatcaccgaagatgacctgcataatgaggagaagattacgcagcagatggatccagaacaccgacaattagcaaacgcgatcttcaaactgacatatcagaataaggtcgtgaaggtacagcggcctacccccactggcacagttatggacataattagtagaaaagatcagaggggcagcgggcaagtgggaacctacggtttgaacacttttaccaatatggaggcccagctcatccgccagatggaaggcgagggggtcctgtctaaggctgacctagaaaacccacaccttcccgagaaaaagatcacacagtggctggagacgaaaggagtggaacgtctcaagcggatggccatttccggcgatgactgcgtggtcaagcctatagatgacagattcgcaaacgctctgttggccttaaatgatatgggtaaagttaggaaggacatcccacaatggcagccgtcaaaagggtggcatgattggcaacaggtgcccttctgtagccaccattttcacgagctgattatgaaggacggacgcaaactcgtagtgccttgccgaccacaagacgaacttatcggccgggcaagaatttcgcagggcgccgggtggtctctgagggagaccgcgtgtctaggaaaggcttatgcccagatgtggagtctgatgtacttccaccgcagagatctccggttggcatccaacgccatctgcagcgctgtccccgtgcattgggttcctacttcaaggacaacctggtccatacacgcccatcaccaatggatgactacagaagacatgctgaccgtgtggaatcgtgtctggatcgaggataacccatggatggaggacaagacgcccgtgacaacctgggaaaatgtaccttaccttggtaaacgagaggatcagtggtgtggctctctgattgggctcactagccgcgcaacctgggctcagaacatcccgacagccattcagcaagttagaagtttaatcggaaatgaagagtttctggactatatgccatccatgaagcggttcaggaaagaggaagagagcgaaggcgcgatttggtga

SEQ ID NO: 15185 - RNA, 9873 nt, synthetic construct
  misc_feature 1..9873: note = derived and/or modified CDS sequence (opt3) from DENV-3__GU131953__SS-prME
  source 1..9873: mol_type = other RNA
accagcctgtgcctcatgatgatccttcccgcagctctggcattccacttgacatcccgggacggcgaacctaggatgattgtggggaagaacgaacggggaaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggccgttatattcatcttactgatgcttgtgaccccatcgatgacaatgcgctgtgtcggcgtggggaaccgggactttgtagaaggattgtcaggtgcgacctgggttgatgtggtcctggagcacggcgggtgcgtgacgactatggcaaagaataaacccacactagacattgagctccagaagaccgaagccactcagctggctacacttaggaaactgtgtatcgagggaaagattaccaacatcacgaccgatagccggtgccctacacagggcgaagccgtgttgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcaaaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgccggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgcttctagggcatggaacgtgtgggaagttgaggactatggttttggggtgttcaccacgaatatttggctgaaacttcgggaagtctacacacagttgtgtgaccaccgcctcatgtcagccgctgtgaaggatgagagagccgttcacgcagacatgggatactggatcgagagtcagaaaaacggcagctggaagctggaaaaagcgtccctaatagaggtgaagacctgcacttggcctaagtctcataccctgtggtcgaatgccgtactcgaaagcgatatgatcattccaaaatccctggctggtccgatctcacagcacaactataggcccggctaccatacacaaactgccgggccttggcaccttggaaagttggagctggactttaattattgcgagggcaccacagtcgtgattacggaaaactgtgggacccgtggaccaagtttacggactacaaccgtgtctggcaaactcatccacgagtggtgctgtcgaagctgcactctgccccctcttagatacatgggtgaagatgggtgttggtatggaatggagataaggccaatttccgaaaaggaggagaatatggtcaaatcactggttagcgcaggctctggtgaagtggacaacttcacaatgggcgtattgtgcctcgctatcctgtttgaggaagtgatgcgcgggaagttcggaaagaaacatatgatcgccggcgtcttctttaccttcgtgctactgctctccgggcagattacgtggcgggatatggcacacactctgatcatgattggaagtaatgccagcgacagaatgggcatgggtgttacctaccttgctttgatagcgacatttaagatccagcccttcctggccttagggtttttcctcaggaaactgacctctcgcgagaaccttctgctaggagtgggcctcgcaatggctactacactgcaattgccggaagatattgagcagatggccaatggcatcgccctggggttaatggctctcaagctgattacccagtttgagacatatcagctttggactgcactgatctccttgacctgttcaaacacgatattcacactcaccgtcgcctggcgaactgcgaccctgatcctagctggagtgagtctgcttcctgtttgccaaagctcgtccatgcggaaaacagactggctcccaatgactgtggccgcaatgggtgtcccacctctgcccttgtttattttctctctgaaggataccttaaagcgtagaagctggccactcaatgaaggcgtaatggccgtggggctggtttcaatccttgctagttccctgttgaggaacgacgtgcctatggcaggacccctcgtcgccggcggtctgctaattgcgtgttacgtgatcacggggacatctgctgatctgaccgtagagaaagccgcagacgtgacttgggaagaggaagccgagcagacaggagtcagccataaccttatgataaccgttgacgatgacggcactatgcgcattaaggatgacgagacagaaaatatcctcaccgtgctgttgaaaacggctttactgatcgtgtccggcatttttccatactcaataccggccactctcctggtctggcacacctggcagaagcagacacaacggagcggggtgctttgggatgttcctagtcccccagagacccagaaagcagaactggaggagggagtatatagaatcaagcagcagggtattttcggcaaaacacaagtgggggtcggagtgcagaaggaaggcgtttttcatactatgtggcacgtgaccaggggtgctgtcttgacgtacaacgggaagcgactagagcccaattgggcctctgtgaaaaaggacctgatctcctatggaggcggctggcgcctcagcgcgcagtggcaaaaaggggaagaggtacaggtcattgccgtggaacctggaaagaaccccaagaatttccagacaatgcccggtactttccagaccacaaccggcgagatcggggcaatagctctggattttaagcctggaacttcgggctcaccgatcattaaccgggagggtaaggttgtggggctttacggaaatggcgtcgtgaccaaaaacggcgggtatgtttctggaatcgcccaaacaaatgctgaaccagacggtcccacgcctgagttagaagaggaaatgttcaagaaaagaaacctgactattatggatctccacccaggcagtgggaagaccaggaaatacttgcccgcaatcgtgcgtgaggccataaagcgccggctgagaacactcattctggcccctaccagggtcgtggctgcggagatggaagaggcacttaagggactgccgatccgatatcagactacagccaccaaatccgaacatacgggccgggagatcgtagacttgatgtgccacgctacttttacaatgcgcctactgagccccgtgagagttccaaattacaacctcattatcatggatgaagcccatttcaccgaccctgcatctatagccgctaggggttacattagcacccgggtcgggatgggagaggcggccgcaatctttatgactgctacacccccaggcaccgccgatgcattccctcagtccaatgcccccattcaggacgaggaacgagacatcccagagagatcatggaacagtggcaatgaatggataacagattttgctgggaagactgtgtggttcgtgccgagcattaaagccggaaacgacatcgcgaactgtttacgcaagaatggtaaaaaggtcatccaactgtctaggaagacgtttgataccgagtatcagaaaacaaaacttaacgactgggatttcgtagtgactaccgacatttccgagatgggcgcaaattttaaagccgatcgtgttatcgaccctcggagatgcctgaagcccgtgattctcacagatgggccagaaagggtcatattggctggacccatgcctgtgaccgccgcttcagcagcccagcgccgaggcagagttggtcggaacccacagaaagagaatgaccaatacatcttcactgggcagcccctgaacaatgatgaagaccacgctcattggacggaggccaagatgctcctggacaacattaatacccctgaaggcatcatcccggcacttttcgagccagagagggaaaagagtgcggccattgatggagagtatcgcctaaaaggcgaaagccgtaagacatttgtggagctgatgagaagaggggacttgcccgtctggttagctcacaaagtggcctccgaaggaataaagtacactgataggaaatggtgcttcgacggtcagcgcaacaatcagatcctggaggagaacatggatgtagaaatttggaccaaggagggcgagaagaagaagctccgacctagatggctggacgcacggacatattctgatccccttgctctgaaagagtttaaggacttcgccgcagggaggaaatcgatcgccctcgatttggtgaccgaaattggacgcgttccaactcacctggctcatagaacaaggaatgcgctagacaacctggtcatgctccacacgagcgagcatggcggtaaggcctaccggcacgcagtggaggaacttcctgagaccatggaaactctgttattgctggggctcatgatcctgcttacaggcggagctatgctgtttctcatatcaggcaaagggatcggaaagacctccattggtttgatctgtgtgattgccagttctggcatgctgtggatggccgagatccccttacaatggatagcaagcgctattgtcctagagttctttatgatggttctgctcatcccagaacctgagaagcagcgtaccccgcaggataatcaacttgcctatgtggtaattgggatcctgacattggcggctataatcgccgcaaacgaaatgggactgctcgagactacgaaacgcgacctgggcatgtccaaggaacccggtgtggtctcaccaacctcttaccttgatgtggacctccaccctgccagcgcttggacactgtacgcagttgccactaccgtgattacacccatgttgcgacataccatcgagaatagtactgcgaacgtctccctggctgccattgcaaaccaggccgtagtgttaatggggctagacaaaggctggccaatcagcaagatggatctgggagttcctctccttgctctgggctgctattctcaggtgaatcccttgacgctgacagccgcagtcctcctgcttataacccactacgctattatcgggccgggattacaggccaaagcgactagagaggcccaaaagaggaccgcagctggcatcatgaagaacccaacagtggacggtattatgactatcgatctggaccctgtcatatatgattcaaaattcgaaaagcagctcggacaggtgatgttgctggttctatgtgccgtgcagctgctccttatgcggacctcctgggcactgtgcgaggctttgacactggccacgggacccattaccactctctgggaaggcagtccaggtaaattttggaatacaaccatcgccgtaagcatggcgaacattttccgcggctcgtacctggctggggcaggattagccttttctatcatgaagtccgtgggcactgggaaaagaggaacaggcagccaaggtgagacccttggggaaaagtggaagaaaaagctgaatcagctctcaaggaaagagttcgacctatataagaaaagtggaataacggaggtcgatcggaccgaagctaaggagggcctgaaacgaggtgaaatcacacatcacgccgtttctagaggctccgcaaagttgcagtggtttgtggagcgcaacatggtcattcccgaagggagggtgatcgacctgggatgtggcagaggcgggtggagctactattgcgccgggctcaagaaagtaactgaggtgcgtggttacaccaaagggggacctggccatgaggaaccggttcccatgtcaacatacggctggaatattgtgaaacttatgagtgggaaggatgtcttctatctgccacctgagaaatgtgacactttgctgtgcgatatcggagaaagctccccctctcctaccgtggaggagagcagaacaattagggtcctcaagatggtggaaccatggttaaagaacaatcagttctgtatcaaagttctgaacccctacatgcctaccgtaatagagcaccttgaacgcctgcaacggaagcacggtggcatgctagtgcgaaatccactctccagaaactcaactcatgagatgtattggatttctaatgggacgggaaacatcgtcgctagtgtgaatatggtttcgaggctgttgctgaaccgctttacaatgacccaccggagacccactatcgaaaaagacgtggatctcggcgcgggtacccgtcatgtcaacgccgagccggagacacctaatatggacgtgattggggaaaggataaagcggatcaaagaggaacacaacagcacgtggcactacgacgatgagaatccatataagacctgggcataccatggatcctatgaagtaaaggctactggctctgcctcaagcatgattaacggcgtggttaaacttctgacaaagccctgggacgtcgtgcctatggtgacccagatggcaatgactgatacaaccccattcgggcagcaacgcgtctttaaagagaaggttgacacacgaactcccagatccatgccgggaaccaggcgggtgatggagatcacggccgaatggttatggcgcaccctgggtagaaataaaaagcctaggttgtgcacacgagaggagttcactaagaaagtacggaccaacgctgccatgggcgcggtgtttacagaggaaaatcagtgggatagtgcaaaggccgctgtcgaggacgaggatttctggaaactcgtggaccgtgaaagagagctgcacaagctagggaaatgtggatcttgcgtttacaacatgatgggcaagcgcgagaagaaacttggtgagtttgggaaggccaaaggaagcagggcaatttggtacatgtggctgggcgctcggtatctcgagttcgaagccctgggctttttgaatgaggatcattggttctcaagagaaaactcctacagtggggtggagggagaaggtctgcacaagctcggctatatccttcgcgacataagcaaaatccccgggggagctatgtacgccgatgacactgcaggctgggacaccaggattacggaggatgacctgcataatgaggaaaagatcacacagcagatggatccagagcaccgattactggcgaacgccatttttaaattgacctatcaaaataaggtcgtgaaggtacagcggcctactcccacaggtaccgttatggacatcatatctagaaaagatcagagggggtccggacaggtgggcacttacggcctcaacaccttcacaaatatggaagctcaactgattcgccagatggagggggaaggagtcctatcaaaggccgaccttgagaacccacacctgagcgagaaaaaggtgacgcagtggctcgaaaccaaaggtgtggagcgtctgaagcggatggcaatctcgggcgatgactgcgtcgttaagcccatcgatgacagatttgctaacgccttgttagcactgaatgatatggggaaagtgaggaaggacattcctcagtggcaaccatctaaaggatggcatgattggcagcaggtaccgttctgtagtcaccatttccacgaactcataatgaaggacggccgcaaacttgtggtcccctgccgacctcaggacgagctgatcggtcgggccagaatttcccaaggggcgggatggagcctaagggaaactgcttgtctgggcaaggcctatgcacagatgtggtcactcatgtactttcaccgcagagatttgcggctggcctccaacgctatctgctctgccgtgccagttcattgggtgcccacaagcaggaccacttggagtattcacgcacatcaccagtggatgacaaccgaggacatgcttacggtctggaatcgtgtgtggatcgaggataacccttggatggaagacaagacaccagtaaccacttgggagaatgttccctacctgggcaaacgagaagatcaatggtgtgggtccctcataggattaaccagccgcgctacatgggcccagaacatccctactgcgattcaacaggtgagatctctgatcggtaatgaggagttcttggactatatgccgtcaatgaagcggtttaggaaagaagaggaaagtgagggcgctatttggtga

SEQ ID NO: 15186 - RNA, 9873 nt, synthetic construct
  misc_feature 1..9873: note = derived and/or modified CDS sequence (opt3) from DENV-3__GQ868577__SS-prME
  source 1..9873: mol_type = other RNA
accagcctgtgcctcatgatgatccttccagccgctctggcattccacttgacatccagagacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaagatcgtgggactttacggcaatggcgtcgtgaccaaaaacgggggatatgtttctggtattgcacaaacaaatgctgaaccagacggccccacgcctgagttagaagaggaaatgttcaagaaaagaaacctgactatcatggatctccacccagggagtggaaagaccaggaaatacttgcccgccatagtgcgtgaggctattaagcgccggctgagaacactcatcctggcacctaccagggtcgtggccgccgagatggaagaggctcttaagggcctgccgatccgatatcagactacagcgaccaaatccgaacatacgggtcgggagattgtagacttgatgtgccacgcaacttttacaatgcgcctactgagccccgtgagagttccaaattacaacctcatcataatggatgaagcccatttcaccgaccctgcttctattgccgcaagggggtacatcagcacccgggtcggaatgggcgaggccgctgcgatttttatgactgccacacccccaggcaccgcagatgctttccctcagtccaatgcccccatccaggacgaggaacgagacataccagagagatcatggaacagtgggaatgaatggattacagattttgcaggaaagactgtgtggttcgtgccgagcatcaaagccggtaacgacatcgctaactgtttacgcaagaatggcaaaaaggtcattcaactgtctaggaagacgtttgataccgagtatcagaaaacaaaacttaacgactgggatttcgtagtgactaccgacatctccgagatgggggccaattttaaagcggatcgtgttattgaccctcggagatgcctgaagcccgtgatactcacagatggaccagaaagggtcatcttggcaggccccatgcctgtgaccgccgcttcagccgctcagcgccgaggtagagttgggcggaacccacagaaagagaatgaccaatacattttcactggccagcccctgaacaatgatgaagaccacgcacattggacggaggccaagatgctcctggacaacatcaatacccctgaaggaatcattccggctcttttcgagccagagagggaaaagagtgccgcaatagatggcgagtatcgcctaaaaggggaaagccgtaagacatttgtggagctgatgagacggggagacttgcccgtctggttagcgtacaaagtggcctccgaaggtatcaagtatactgataggaaatggtgcttcgacggccagcgcaacaatcagattctggaggagaacatggatgtagaaatctggaccaaggagggggagaaaaagaagctccgacctagatggctggacgctcggacatactctgatccccttgccctgaaagagtttaaggacttcgcagctggaaggaaatcgattgccctcgatttggtgaccgaaatcggccgcgttccaactcacctggcacacagaacaaggaatgccctagacaacctggtcatgctccatacgagcgagcacggtgggaaggcttatcggcatgcggtggaggaacttcctgagaccatggaaactctgttattgctgggcctcatgatactgcttacaggaggcgccatgctgtttctcatctcagggaaaggaattggtaagacctccatcggcttgatttgtgtgatcgcaagttctgggatgctgtggatggctgagatacccttacaatggattgccagcgccatcgtcctagagttctttatgatggttctgctcattccagaacctgagaagcagcgtaccccgcaggataatcaacttgcatacgtggtaatcggaatactgacattggctgccatcattgcggctaacgaaatgggcctgctcgagactacgaaacgcgacctgggtatgtccaaggaacccggggtggtctcaccaacctcttaccttgatgtggacctccaccctgccagcgcatggacactgtatgccgttgctactaccgtgatcacacccatgttgcgacacaccattgagaatagtactgcaaacgtctccctggccgcgatcgctaaccaggccgtagtgttaatgggcctagacaaaggatggccaataagcaagatggatctgggcgttcctctccttgcactggggtgctactctcaggtgaatcccttgacgctgacagccgctgtcctcctgcttattacccattatgccatcatcggaccgggcttacaggcaaaagctactagagaggcccaaaagaggaccgcggccggtattatgaagaacccaacagtggacgggatcatgactatagatctggaccctgtcatttacgattcaaaattcgaaaagcagctcggacaggtgatgttgctggttctatgtgcagtgcagctgctccttatgcggacctcctgggctctgtgcgaggccttgacactggcaacgggccccatcaccactctctgggaaggtagtccaggcaaattttggaatacaaccattgctgtaagcatggccaacatcttccgcgggtcgtatctggccggagcgggcttagctttttctataatgaagtccgtggggactggaaaaagaggcacaggtagccaaggggagacccttggagaaaagtggaagaaaaagctgaatcagctctcaaggaaagagttcgacctatacaagaaaagtggcatcacggaggtcgatcggaccgaagcaaaggagggtctgaaacgaggcgaaattacacaccatgccgtttctagagggtccgctaagttgcagtggtttgtggagcgcaacatggtcatccccgaaggaagggtgattgacctgggctgtgggcggggaggctggagctattactgcgccggtctcaagaaagtaactgaggtgcgtgggtacaccaagggaggccctggccacgaggaaccggttcccatgtcaacatatgggtggaatatcgtgaaacttatgagtggaaaggatgtcttctacctgccacctgagaaatgtgacactttgctgtgcgatattggtgaaagctccccctctcctaccgtggaggagagcagaacaatcagggtcctcaagatggtggaaccatggttaaagaacaatcagttctgtataaaagttctgaacccctatatgcctaccgtaattgagcatcttgaacgcctgcaacggaagcacggcgggatgctagtgcgaaatccactctccagaaactcaactcacgagatgtactggatctctaatggaacgggcaacatcgtcgcaagtgtgaatatggtttcgaggctgttgctgaaccgctttacaatgacccatcggagacccactattgaaaaagacgtggatctcggtgccgggacccgtcacgtcaacgctgagccggagacacctaatatggacgtgataggagaaaggatcaagcggattaaagaggaacataacagcacgtggcactatgacgatgagaatccatacaagacctgggcgtatcacggctcctacgaagtaaaggccactggctctgcatcaagcatgatcaacggggtggttaaacttctgacaaagccctgggacgtcgtgcctatggtgacccagatggctatgactgatacaaccccattcggacagcaacgcgtctttaaagagaaggttgacacacgaactcccagatccatgccgggtaccaggcgggtgatgggcattacggccgagtggttatggcgcaccctggggagaaataaaaagcctaggttgtgcacacgagaagagttcactaagaaagtacggaccaacgcagccatgggagctgtgtttacagaagagaatcagtgggatagtgccaaggcggcagtcgaagacgaggatttctggaaactcgtggaccgtgagagagaactgcataagctaggcaaatgtggttcttgcgtttacaacatgatggggaagcgcgagaagaaacttggagaatttggcaaagccaaaggcagcagggctatctggtatatgtggctgggggcccggtacctcgagttcgaggcactgggatttttgaatgaagatcactggttctcaagagagaactcctatagtggtgtggaaggcgaggggctgcataagctcggatacatacttcgcgacatcagcaaaattcccggcggtgctatgtatgccgatgacactgctgggtgggacaccaggatcacggaagatgacctgcacaatgaggagaagattacacagcagatggatccagaacatcgacaattagccaacgcaatctttaaactgacctaccagaataaggtcgtgaaggtacagcggcctactcccacaggaaccgttatggacataatttctagaaaagatcagaggggctccggccaagtggggacttatggattgaacaccttcacaaatatggaggcgcagctcatccgccagatggaaggtgagggcgtcctgtcaaaggccgacctagaaaacccacaccttcccgagaaaaagatcgctcagtggctggagacgaaaggggtggaacgtctcaagcggatggccattagcggagatgactgcgtggtcaagcctatagatgacagatttgcaaacgctctgttggccttaaatgatatgggcaaagttaggaaggacatcccacaatggcagccgtcgaaaggttggcacgattggcaacaggtgcccttctgttctcatcacttccatgagctgattatgaaggacgggcgcaaactcgtagtgccttgccgaccacaagacgaacttatcggacgggcaagaattagtcagggcgccggctggtccctgagggagaccgcgtgtctagggaaggcttacgcccagatgtggagcctgatgtactttcaccgcagagatctccggttggcatcaaacgccatctgctccgctgtccccgtgcactgggttcctacttctaggacaacctggagcatacatgcccaccatcaatggatgactacagaagacatgctgaccgtgtggaatcgtgtctggatcgaggataacccatggatggagaataagacgcccgtgacaacctgggaaaacgtaccttatcttggaaaacgagaggaccagtggtgtggtagtctgattggcctcacttcccgcgcaacctgggctcagaatatcccgacagccattcagcaagttaggagcttaatcgggaacgaagagttcctggattacatgccatctatgaagcggtttaggaaagaggaagagtcagaaggagcgatttggtga

SEQ ID NO: 15187 - RNA, 9873 nt, synthetic construct
  misc_feature 1..9873: note = derived and/or modified CDS sequence (opt3) from DENV-3__GU131954__SS-prME
  source 1..9873: mol_type = other RNA
accagcctgtgcctcatgatgatccttccagccgctctggcattccacttgacatccagggacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgtacaaagtagcctccgaaggtataaagtatactgataggaaatggtgcttcgacggccagcgcaacaatcagatcctggaggagaacatggatgtggaaatttggaccaaggagggggagaaaaagaagctccgacctagatggctggacgctcggacatactctgatccccttgccctgaaagagtttaaggacttcgcagctggaaggaaatcgatcgccctcgatttggttaccgaaattggccgcgtcccaactcacctggcacacagaacaaggaatgccctagacaacctggtgatgctccatacgagcgagcacggtgggaaggcttatcggcatgcggtggaggaacttcctgagaccatggaaactctgttattgctgggcctcatgatcctgcttacaggaggcgtcatgctgtttctcatatcagggaaaggaatcggtaagacctccattggcttgatctgtgttattgccagttctgggatgctgtggatggcagagatccccttacaatggatagctagcgccattgtgctagagttctttatgatggtactgctcatcccagaacctgagaagcagcgtaccccgcaggataatcaacttgcctacgtggtcattggaatcctgacattggcagctataatcgccgcgaacgaaatgggcctgctcgagactacgaaacgcgacctgggtatgaccaaggaacccggggctgtgtccccaacatcataccttgatgttgacctccaccctgcctctgcatggactctgtatgccgtggctaccacagtcattacccccatgttgcgacacactatcgagaatagcacggcaaacgtaagtctggccgcgattgctaaccaggccgtggttttaatgggcctagacaaaggatggccaatctccaagatggatctgggcgtgcctctccttgcactggggtgctacagccaggtcaatcccttgacactgaccgccgctgtgctcctgcttataactcattatgccattatcggaccgggcttacaggcaaaagctaccagagaggcccaaaagaggacagcggccggtatcatgaagaacccaactgtcgacgggattatgaccatcgatctggaccctgtgatatacgattctaaattcgaaaagcagctcggacaggttatgttgctggtgctatgtgcagtacagctgctccttatgcggacatcatgggctctgtgcgaggccttgacgctggcaaccggccccattactacactctgggaaggttccccaggcaaattttggaataccactatcgctgtgagtatggccaacattttccgcgggagctatctggccggagcgggcttagctttttcgatcatgaagtctgtcgggacaggaaaaagaggcaccggttcccaaggggagacgcttggagaaaagtggaagaaaaagctgaatcagctcagcaggaaagagttcgacctatacaagaaatcaggcataaccgaggttgatcggacagaagcaaaggagggtctgaaacgaggcgaaatcactcaccatgccgtgagtagagggtctgctaagttgcagtggtttgtcgagcgcaacatggtgattcccgaaggaagggtaatcgacctgggctgtgggcggggaggctggtcctattactgcgccggtctcaagaaagtgaccgaggttcgtgggtacacaaagggaggccctggccacgaggaaccggtgcccatgagcacttatgggtggaatattgtcaaacttatgtcaggaaaggatgtgttctacctgccacctgagaaatgtgacaccttgctgtgcgatatcggtgaaagtagcccctcccctacagtcgaggagtctagaaccattagggtgctcaagatggttgaaccatggttaaagaacaatcagttctgtatcaaagtactgaacccctatatgcctactgtgatagagcatcttgaacgcctgcaacggaagcacggcgggatgctagtccgaaatccactcagcagaaactccacgcacgagatgtactggatttcaaatggaacaggcaacatcgtggcatctgttaatatggtgagtaggctgttgctgaaccgctttaccatgactcatcggagacccaccatcgaaaaagacgtcgatctcggtgccgggacacgtcacgtgaacgctgagccggagacgcctaatatggacgtaattggagaaaggataaagcggatcaaagaggaacataactcgacctggcactatgacgatgagaatccatacaagacttgggcgtatcacggcagctacgaagtgaaggccacaggctccgcatcttcaatgattaacggggttgtcaaacttctgaccaagccctgggacgtggtgcctatggtcactcagatggctatgacagataccacaccattcggacagcaacgcgtttttaaagagaaggtggacactcgaacccccagaagcatgccgggtacgaggcgggtaatgggcatcaccgccgagtggttatggcgcacactggggagaaataaaaagcctaggttgtgcactcgagaagagttcaccaagaaagtgcggacaaacgcagccatgggagctgtctttactgaagagaatcagtgggattccgccaaggcggcagtggaagacgaggatttctggaaactcgttgaccgtgagagagaactgcataagctaggcaaatgtggtagttgcgtgtacaacatgatggggaagcgcgagaagaaacttggagaatttggcaaagccaaaggctctagggctatttggtatatgtggctgggggcccggtacctcgagttcgaggcactgggatttttgaatgaagatcactggttcagcagagagaactcatattccggtgtcgaaggcgaggggctgcataagctcggatacatccttcgcgacataagtaaaatccccggcggtgctatgtatgccgatgacaccgctgggtgggacacgaggattacagaagatgacctgcacaatgaggagaagatcacccagcagatggatccagaacatcgacaattagccaacgcaatttttaaactgacttaccagaataaggtggtaaaggttcagcggcctacacccaccggaactgtgatggacatcataagcagaaaagatcagaggggctctggccaagtcgggacctatggattgaacacattcacgaatatggaggcgcagctcattcgccagatggaaggtgagggcgtgctgtccaaggccgacctagaaaacccacaccttcccgagaaaaaggtgacccagtggctggagactaaaggggtcgaacgtctcaagcggatggctatctcaggagatgactgcgttgtgaagcctatcgatgacagatttgccaacgcactgttggctttaaatgatatgggcaaagtaaggaaggacattccacaatggcagccgagcaaaggttggcacgattggcaacaggtgcccttctgttcgcatcacttccatgagctgataatgaaggacgggcgcaaactcgtcgtgccttgccgaccacaagacgaacttatcggacgggccagaatttctcagggcgcaggctggagtctgagggagacagcctgtctagggaaggcgtacgctcagatgtggtccctgatgtactttcaccgcagagatctccggttggccagcaacgcaatctgctcagccgttcccgtgcactgggtccctacctccaggactacatggtctattcatgctcaccatcaatggatgaccacggaagacatgctgacagtgtggaatcgtgtatggatcgaggataacccatggatggaggacaagacccccgttactacctgggaaaatgtgccttatcttggaaaacgagaggatcagtggtgtggtagcctgataggcctcacaagtcgcgccacttgggcacagaacatcccgaccgctattcagcaagtcagatccttaatcgggaatgaagagttcctggactacatgccaagcatgaagcggtttaggaaagaggaagagtctgaaggagccatttggtga

SEQ ID NO: 15188 - RNA, 9873 nt, synthetic construct
  misc_feature 1..9873: note = derived and/or modified CDS sequence (opt3) from DENV-3__GQ868578__SS-prME
  source 1..9873: mol_type = other RNA
accagcctgtgcctcatgatgatccttcccgccgctctggcattccacttgacatccagggacggcgaacctaggatgattgtggggaagaacgaacggggaaagtctttactgtttaagactgcctcaggtataaatatgtgtacgctcatcgcgatggatctcggcgagatgtgcgacgataccgtcacatacaaatgtccacacattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagtccatagagggaaaagtggtccagtatgaaaatctgaagtacacagtgattatcactgttcataccggtgaccagcaccaggtgggcaacgagacacaaggggtcaccgcagaaattactccccaggcttctacgacagaggccatcctccctgaatatggaacccttggcctggagtgcagcccacgaactggtttggacttcaatgagatgatcctactgaccatgaaaaacaaggcgtggatggtgcatagacagtggtttttcgatctcccgctgccctggacatccggggccaccactgaaacacctacgtggaataggaaagagcttctggtaacctttaagaacgcacacgctaaaaagcaagaagttgtggtcttgggctcacaggagggagccatgcacactgctctcacaggcgccaccgaaattcagaatagtgggggaacaagcatattcgcaggtcatctgaagtgtcggttaaaaatggacaagctggagctaaaaggcatgtcttacgccatgtgcactaacacctttgtgctcaagaaagaggtctccgaaacgcagcacgggaccatcctgattaaggtggagtacaagggagaagatgttccatgtaaaatccccttctcaacagaggacggccaaggtaaggctcataacgggcgtcttataactgcgaatcctgtggtaaccaaaaaggaggaaccagtcaacattgaggcagaacccccgttcggcgagagcaatatcgtgatcggaattggcgataacgccttgaaaatcaattggtataagaaggggagttctattggaaaaatgtttgaagctacagcccgcggtgcaagaaggatggccatactgggcgacactgcttgggatttcgggtccgttggaggcgtgctcaacagcctgggtaagatggtccaccagatctttgggtcggcctacaccgcacttttctctggcgtgtcctgggtaatgaaaattggaatcggcgtgctgttgacgtggatcgggctcaattcaaagaacacaagtatgagcttttcctgcattgcgataggaatcattaccctgtatttaggcgctgttgtccaggccgacatgggttgtgtgatcaattggaaagggaaggagctgaagtgcggatctggcattttcgtgactaacgaggtccatacatggaccgaacagtacaaatttcaagcagatagccctaagcggctagccactgctatcgccggtgcatgggagaatggcgtttgtgggatacgatcaaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccccagccaatggagttaaagtacagttggaaaacatggggaaaggccaagatagtgaccgcggaaacacaaaactccagcttcattatcgatggccctaatactcccgagtgcccatctgcctcaagggcttggaacgtttgggaagtggaggactatggttttggggtcttcaccacgaatatttggctgaaacttcgggaagtgtacacacagttgtgtgaccaccgcctcatgagtgcagccgttaaggatgagagagctgtgcacgccgacatgggatactggatcgagagccagaaaaacggctcctggaagctggaaaaagcatctctaatagaggtaaagacctgcaagtggcccaaatcgcatactctgtggagcaatggtgtcctcgaatccgatatgatcattcctaagtcactggcgggcccaatcagtcagcacaactataggccggggtaccatacccaaacagccggaccctggcaccttggcaaattggagctggactttaattattgcgaggggactaccgtggtgattacagaaaactgtggaacgcgtggcccttctttacggaccactacagtcagcggtaagctcatccacgagtggtgctgtcgatcctgcaccctgccaccccttagatacatgggggaagatggatgttggtatggcatggagataaggcctacttcagaaaaagaggagaatatggttaagagcctggtgtctgctggttccggcgaagtagacaacttcacaatgggggtgttgtgcctcgccattctgtttgaggaagtcatgcgcggaaagttcggcaaaaagcatatgatcgcaggggtgctattcacctttgttctgctcctgagtggacagatcacgtggcgggatatggctcacactcttattatgatcggcagcaatgcctctgacagaatgggtatgggggtgacctacttggcactgattgccacattcaaaatacagccatttttagctctcggattctttctgaggaaacttacctcccgcgagaacctgctactcggcgtcggcctggcgatggccactacattgcaactgcccgaagatatcgagcagatggcaaatgggattgctttaggactcatggccctgaaacttatcacccagttcgagacatatcagctgtggactgccttgatttcactcacctgtagtaacacgatctttacactgaccgtggcttggcgaactgcaaccctaatactggccggtgttagccttctcccggtgtgccaatcgtcctctatgcggaagacagactggctgcctatgactgtcgcggctatgggcgtaccacccttgcctctgttcatctttagcttaaaggataccctcaaacgtagatcatggcccctgaatgaaggggtgatggccgttggacttgtgagtattctggcatcctctttgctcaggaacgacgtcccaatggccggccctctggtggctggtgggctactgatcgcatgttacgtaattacgggaacaagcgccgatcttaccgtggagaaggcggctgacgtcacttgggaagaggaagccgagcagacaggcgtttcccataacctcatgatcaccgtggacgatgacggcactatgcgcataaaagatgacgagacagaaaatattctgaccgtgttgttaaagacggcactgctcatcgtctcagggatcttcccctacagcattccagccactctgcttgtgtggcacacctggcagaaacagacacaacggagtggagttctgtgggatgtaccgtctcctcccgagacccagaaggctgaattggaggagggtgtgtatagaataaaacagcagggcatctttgggaagacacaagtcggagtgggcgttcagaaggaaggtgtgttccatactatgtggcacgtcaccagaggggccgtgctaacgtacaacggaaaacgactggagccaaattgggcatccgtaaagaaagacctcattagctatggcggcgggtggcgcctgtcggctcagtggcaaaagggagaagaggtccaggtgatcgccgttgaacccggtaaaaaccctaagaattttcagacaatgccaggcactttccagaccacaaccggggagattggagcgatcgcccttgatttcaagcccggcacttcaggttctcctataatcaaccgggaggggaaaattgtgggattatacggcaatggcgtcgtgaccaagaacgggggatatgttagtggtatcgcacaaacaaatgctgaaccggacggcccaacgcccgagctggaagaggaaatgtttaaaaagagaaacctcactattatggatttgcaccctgggtccggaaaaaccaggaagtacctgccagccatcgtgcgtgaggctataaagcgccggctcagaacactgattcttgcacccaccagggtcgtggccgccgagatggaagaggctctgaaaggcttgcctatccgatatcagactacagcgaccaagagcgaacatacgggtcgggagatcgtagacctaatgtgccacgcaactttcacaatgcgcctgctctctccggtgagagttcccaattacaacttaattatcatggatgaagcccattttaccgacccagctagcatagccgcaagggggtacatttccacccgggtcggaatgggcgaggccgctgcgatcttcatgactgccacacctcccggcaccgcagatgcttttccacagtcaaatgcccctattcaggacgaggaacgagacatccccgagagaagttggaacagcgggaatgaatggataacagatttcgcaggaaaaactgtgtggtttgtgccatctattaaggccggtaacgacatcgctaactgtctgcgcaaaaatggcaagaaggtcatccaactttccaggaaaacgttcgataccgagtatcagaagacaaaactgaacgactgggattttgtagtgactaccgacatttcagagatgggggccaatttcaaggcggatcgtgttatcgacccgcggagatgcctcaaacctgtgattttgacagatggacccgaaagggtcatactggcaggcccaatgcccgtgaccgccgctagtgccgctcagcgccgaggtagagttgggcggaaccctcagaaggagaatgaccaatacatctttactggccagccactcaacaatgatgaagaccacgcacattggacggaggccaagatgctgcttgacaacattaatacccccgaaggaatcatccctgctctattcgagccggagagggaaaagagcgccgcaattgatggcgagtatcgcctgaagggggagtcccgtaaaacattcgtggagttgatgagacggggagacttaccagtctggctggcgtacaaggtggcctctgaaggtataaaatatactgataggaagtggtgctttgacggccagcgcaacaatcagatcctcgaggagaacatggatgtagaaatttggaccaaagagggggaaaagaagaaactgcgacccagatggcttgacgctcggacatactcggatcctctggccctcaaggagttcaaagactttgcagctggaaggaaaagcatcgccttggatctggtgaccgaaattggccgcgttcccactcacctagcacacagaacaaggaatgccctggacaacctcgtcatgcttcatacgtcagagcacggtgggaaggcttatcggcatgcggtggaggaactgccagagaccatggaaactttattgctgctcggcctgatgatccttctgacaggaggcgccatgctattcttgatatccgggaagggaatcggtaagaccagtattggcctgatctgtgtgattgcatctagcgggatgttatggatggctgagatccctctacaatggatagcctccgccattgtcctggagtttttcatgatggttctccttatccccgaaccagagaaacagcgtacccctcaggataatcaactggcatacgtggtaattggaatcttgacactggctgccataatcgcggctaacgaaatgggcctcctggagactacgaagcgcgaccttggtatgtcaaaagaaccgggggtggtctctcccaccagctacctcgatgtggacctgcacccagccagtgcatggacattgtatgccgttgctactaccgtgattacacctatgctgcgacacaccatcgaaaattccactgcaaacgtcagcttagccgcgattgctaaccaggccgtagtgctaatgggcctggacaagggatggcccatctctaaaatggatctcggcgttccacttctggcattggggtgctactcacaggtgaatcctctgacgctcacagccgctgtcctgcttttaataacccattatgccattatcggacccggcctgcaggcaaaggctactagagaggcccaaaagaggaccgcggccggtatcatgaaaaacccgacagtggacgggattatgactatcgatctcgacccagtcatatacgattccaagtttgaaaaacagttgggacaggtgatgctgctagttctgtgtgcagtgcagctccttctgatgcggaccagttgggctttgtgcgaggccctgacactcgcaacgggccctattaccactctgtgggaaggtagccccggcaagttctggaatacaaccatcgctgtatcgatggccaacatttttcgcgggtcttatttagccggagcgggccttgctttctccatcatgaaaagcgtggggactggaaagagaggcacaggttcacaaggggagaccctgggagaaaagtggaaaaagaaactcaatcagctaagtaggaaggagtttgacctgtacaaaaagtctggcataacggaggtcgatcggaccgaagcaaaagagggtttgaagcgaggcgaaatcacacaccatgccgtttccagagggagcgctaagctgcagtggttcgtggagcgcaacatggtcattccagaaggaagggtgatcgacctcggctgtgggcggggaggctggtcatattactgcgccggtcttaaaaaggtaactgaggtgcgtgggtacaccaaaggaggccccggccacgaggaacctgttccgatgagtacatatgggtggaatattgtgaagctgatgagcggaaaagatgtcttttacttgcccccagagaagtgtgacactctgctctgcgatatcggtgaatcctctcctagccccaccgtggaggagtccagaacaattagggtcttaaagatggtggaaccttggctgaaaaacaatcagttctgtatcaaggttcttaacccatatatgcccaccgtaatagagcatctggaacgcctacaacggaaacacggcgggatgctcgtgcgaaatcctctgtcaagaaactctactcacgagatgtactggattagtaatggaacgggcaacatcgtcgcatcggtgaatatggttagcaggttgctgctcaaccgcttcacaatgacccatcggagaccaactatcgaaaaggacgtggatcttggtgccgggacccgtcacgtcaacgctgagcccgagacaccgaatatggacgtgattggagaaaggataaaacggatcaaggaggaacataactccacgtggcactatgacgatgagaatccttacaagacctgggcgtatcacggctcttacgaagtaaaagccactggctcagcaagctccatgattaacggggtggttaagctgttaacaaaaccatgggacgtcgtgcccatggtgacccagatggctatgactgatacaaccccttttggacagcaacgcgtcttcaaggagaaagttgacacacgaactccaagaagtatgcccggtaccaggcgggtgatgggcatcacggccgagtggctgtggcgcaccttggggagaaataagaagccgaggctctgcacacgagaagagtttactaaaaaggtacggaccaacgcagccatgggagctgtgttcacagaagagaatcagtgggattctgccaaagcggcagtcgaagacgaggatttttggaagctggtggaccgtgagagagaactacataaacttggcaagtgtggtagctgcgtttacaacatgatggggaaacgcgagaagaagctgggagagttcggcaaagccaagggctcaagggctatttggtatatgtggctcggggcccggtacctggagtttgaggcattgggattcctgaatgaagatcactggttttccagagagaacagttatagcggtgtggaaggcgaggggctccataaacttggatacatcctgcgcgacatatctaagatccctggcggtgctatgtatgccgatgacactgctgggtgggacaccaggattacggaagatgacttacacaatgaggagaaaatcacacagcagatggatcccgaacatcgacaactggccaacgcaattttcaagttgacctaccagaataaggtcgtgaaagtacagcggccaactcctacaggaaccgttatggacatcatatccagaaaggatcagaggggctcaggccaagtggggacttatggactcaacacctttacaaatatggaggcgcagctgattcgccagatggaaggtgagggcgtcctaagcaaagccgaccttgaaaacccccatctgccagagaagaaaatcgctcagtggctcgagacgaagggggtggaacgtctgaagcggatggccatctcgggagatgactgcgtggtcaaacccattgatgacagattcgcaaacgctttgttagccctgaatgatatgggcaaggttaggaaagacatacctcaatggcagccatctaagggttggcacgattggcaacaggtgccgttttgtagtcatcacttccatgagctcatcatgaaagacgggcgcaaacttgtagtgccctgccgacctcaagacgaactgattggacgggcaagaatctcccagggcgccggctggagcctaagggagaccgcgtgtctggggaaggcttacgcccagatgtggtcactcatgtacttccaccgcagagatttgcggctggcatccaacgccatttgctctgctgtcccagtgcactgggttcccactagcaggacaacctggagtatccatgcccaccatcaatggatgactacagaagacatgcttaccgtgtggaatcgtgtctggatagaggataacccttggatggaggacaaaacgccagtgacaacctgggaaaatgtaccctatctgggaaagcgagaggatcagtggtgtggttccctcatcggcttaactagccgcgcaacctgggctcagaacattcctacagccatccagcaagttagatctctgatggggaatgaagagtttttggactacatgccgtcaatgaaacggttcaggaaggaggaagagagtgaaggagcgatttggtga

SEQ ID NO: 15189 - RNA, 9873 nt, synthetic construct
  misc_feature 1..9873: note = derived and/or modified CDS sequence (opt3) from DENV-3__FJ898457__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagcatgaaaatctgaagtatacagtgattatcactgttcacaccggtgaccagcatcaggtgggcaacgagacacaaggggtcaccgcagaaattactcctcaggcttccacgacagaggccatcctcccagaatacggaacccttggcctggagtgctctccgcgaactggtttggacttcaatgagatgatcctactgaccatgaaaaacaaggcgtggatggtgcacagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcatactgctctcacaggcgccaccgaaattcagaattcagggggaacaagtatattcgcaggtcacctgaagtgtcggttaaaaatggacaagctggagctaaaaggcatgagctatgccatgtgcactaacacctttgtgctcaagaaagaggtctctgaaacgcagcatgggaccatcctgattaaggtggagtacaagggagaagatgctccctgtaaaatccctttctccacagaggacggccaaggtaaggcgcacaacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtacaagaaggggagcagtattggaaaaatgtttgaagccacagcacgcggtgccagaaggatggctatactgggcgacactgcctgggatttcgggtctgtgggaggcgttctcaactccctgggtaagatggtgcatcagatctttgggagcgcatataccgcgcttttctcgggcgtctcttggattatgaaaatcggaatcggcgtgctgttgacgtggattgggctcaattccaagaacacatcaatgagttttagctgcatagctatcggaattatcaccctgtacttaggcgccgtagtgcaggcagacatgggttgtgttattaattggaaagggaaggagctgaagtgcggatccggcatcttcgtcactaacgaggtgcacacatggaccgaacagtataaatttcaagccgattctcccaagcggctagctactgccatagcaggtgcttgggagaatggcgtgtgtgggatccgaagcaccacacgcatggaaaacctcctgtggaaacagattgccaatgagcttaactacatcttgtgggaaaataacattaagctgacggtcgttgtgggagacatcataggcgtgctcgagcaggggaaaagaaccctgactccacagcctatggagttaaagtattcatggaaaacatggggaaaggcgaagattgtaaccgccgaaacacaaaacagttccttcatcattgatggccccaatactccagagtgccccagcgcttctagggcatggaacgtctgggaagtggaggactacggttttggggttttcaccacgaatatctggctgaaacttcgggaagtgtatacacagttgtgtgaccaccgcctcatgtcagccgctgtcaaggatgagagagccgtgcatgcagacatgggatactggatagagagtcagaaaaacggcagctggaagctggaaaaagcgtccctaatcgaggttaagacctgcacttggcctaagtctcacaccctgtggtcgaatggtgtgctcgaaagcgatatgattatcccaaaatccctggccggcccgatttcacagcataaccacaggcccgggtaccacacacaaactgctggaccttggcatcttggcaagttggagctggactttaattattgcgaggggaccacagtagtcatcacggaaaactgtggaacccgtggcccaagtttacggactacaaccgtgtctggtaaactcatacacgagtggtgctgtcgaagctgcactctgccccctcttagatacatgggggaagatggatgttggtatggcatggagattaggccaatctccgaaaaggaggagaatatggtgaaatcactggtcagcgccggttctggcaaggttgacaacttcacaatgggggtgttgtgcctcgcaatcctgtttgaagaggtaatgcgcggaaagttcggcaaaaagcatatgattgctggggtgttctttaccttcgtcctactgctctccggacagatcacgtggcgggatatggcccacactctgattatgataggcagtaatgcaagcgacagaatgggtatgggggtgacctaccttgccttgatcgctacatttaaaattcagcccttcctggcgttaggatttttcctcaggaagctgacctctcgcgaaaaccttctgctaggcgttggcctcgccatggcaactacactgcaattgccggaggatatcgaacagatggctaatgggattgccctgggattaatggccctcaaactgatcacccagtttgagacatatcagctttggactgctctgatatccttgacctgttcaaacacgatcttcacactcaccgtggcatggcgaactgccaccctgattctagcgggtgtcagtctgcttcctgtgtgccaaagctcgtccatgcggaagacagactggctcccaatggctgttgccgcaatgggcgtgccccctctgcccttgtttatcttctctctgaaggatactttaaaacgtagaagctggccactcaatgagggggtcatggccgtaggactggtgtcaattcttgctagttccctgttgaggaacgacgttcctatggcaggccccctcgtggccggtgggctgctaatcgcgtgttacgtcataaccggaacgtctgctgatctgacagtggaaaaggccgcagacattacctgggaggaagaggccgaacagactggcgtaagccataaccttatgatcacagtggacgatgacggcaccatgcgcatcaaagatgacgagactgagaatattctcacagtcctgttgaagaccgctttactgatagtttccgggatctttccatattcaattccggccacgctcctggtgtggcacacttggcagaaacagacccaacggagcggagtgctttgggatgtccctagtcccccagaaacacagaaggcagagctggaagagggtgtgtacagaatcaaacagcagggcattttcgggaagacccaagttggagtaggcgtgcagaaggagggtgtctttcacacaatgtggcatgtgactaggggggctgttttgacctacaacggaaaacgactagaacccaattgggcctctgtgaagaaagacctgatctcctatggcggcgggtggcgcctcagcgcgcagtggcaaaagggagaggaagtccaggtgatagccgtagagcctggtaaaaacccaaagaatttccagacgatgcccggcacattccagactaccacaggggaaatcggagcaattgctctggattttaagcctggcacctcgggttcaccgatcattaaccgggaggggaaagtcgtgggactttacggcaatggcgttgtgactaagaacgggggatatgtctctggtatcgcccaaaccaatgctgagccagacggccccacacctgaattagaggaagagatgttcaaaaagagaaacctgacgataatggatctccacccagggagtggaaaaactaggaagtacttgcccgcaattgtgcgtgaagccatcaagcgccggctgagaaccctcatcctggcccctacaagggttgtggctgcggagatggaggaagcacttaaaggcctgccgattcgatatcagaccactgccacaaagtccgagcataccggtcgggaaatcgtcgacttgatgtgccacgctacgtttactatgcgcctactgagccccgtgagagtaccaaattacaacctcataattatggatgaggcccatttcacagaccctgcatctatcgccgctagggggtatattagcacccgggtgggaatgggcgaagcggccgcaatctttatgaccgctactcccccaggcacagccgatgcattccctcagtccaatgcccccatacaggacgaggagcgagacattccagaaagatcatggaacagtgggaatgagtggatcaccgattttgctggaaaaacagtttggttcgtcccgagcatcaaggccggtaacgacattgcgaactgtttacgcaaaaatggcaagaaggtgatccaactgtctaggaaaacttttgatacggaataccagaagaccaaacttaacgactgggatttcgtggtcacaactgacatttccgagatgggggcaaattttaaggccgatcgtgtaatagaccctcggagatgcctgaaacccgtgatcctcaccgatggaccagagagggttattttggctggccccatgcctgtgacagccgcttcagcagcccagcgccgaggtagagtcgggcggaacccacagaaggaaaatgaccaatacatcttcaccggccagcccctgaacaatgatgaggaccacgctcactggactgaagccaagatgctcctggacaacatcaatacgcctgagggaattataccggcacttttcgaaccagagagggagaaaagtgcggccatcgatggcgaatatcgcctaaagggggagagccgtaaaacctttgtggaactgatgagacggggagacttgcccgtttggttagctcataaggtggcctccgagggtattaaatacacagataggaagtggtgcttcgacggccagcgcaacaatcagatcctggaagagaacatggatgtcgagatttggactaaagaaggggagaagaagaaactccgacctagatggctggacgcacggacctattctgatccccttgctctgaaggaatttaaagacttcgccgcaggaaggaagtcgatcgccctcgatttggtgacagagataggccgcgtaccaagccacctggctcatagaaccaggaatgcgctagacaacctggtgatgctccacacttcagaacacggtgggcgggcctaccgtcatgcagttgaggagcttcctgaaacaatggagacgctgttattgctgggcctcatgatcctgcttaccggaggcgctatgctgtttctcatttccgggaaaggaatcggtaagactagtattggcttgatctgtgtcatagcctctagcgggatgctgtggatggccgaaattcccttacaatggatcgcatccgctattgtgctagagttctttatgatggtgctgctcatcccagagcctgaaaagcagcgcacaccgcaggataatcaacttgcctatgtcgttataggaatcctgaccttggcggctattatcgccgcaaacgagatgggcctgctcgaaaccacaaaacgagacctgggtatgtcaaaggagcccggggtggtatctccaactagctaccttgatgtggacctccaccctgccagtgcttggacgctgtatgcagtcgccaccacagtgattactcccatgttgagacataccatcgaaaattccacagcgaacgttagcctggctgccatagcaaaccaggccgtggtcttaatgggcctagacaaaggatggccaatttctaagatggatctgggcgtacctctccttgctctggggtgctactcacaggtgaatcccttgaccctgactgccgcagttctcctgcttatcacgcactacgctatcattggaccgggcttacaggccaaagcgacaagggaggcccaaaagcggaccgcagctggtatcatgaagaacccaactgtggacgggataatgaccattgatctggaccctgtcatctatgattccaaattcgagaagcagctcggacaggtgatgttgctggtcctatgtgccgtgcagctgctccttatgcgcacaagttgggcactgtgcgaagctttgactctggccaccggccccattacaacgctctgggagggtagcccaggcaaattttggaataccactatcgccgtttcgatggcgaacatattcagagggtcttacctggctggagcaggcttagccttttccatcatgaagacagtggggaccggaaaaaggggcactggtagccaaggggaaacacttggagagaagtggaagaaaaagctgaatcagctctcacggaaagaattcgacctatataagaaaagtggcattaccgaggtagatcgaacggaggctaaggaaggtctgaaaagaggcgagatcacccatcacgccgtgtctcgcgggtccgcaaagttgcagtggtttgtcgaaaggaacatggttattcccgagggacgggtgatcgacctgggctgtgggcgtggaggctggagctactattgcgccggtctcaagaaagtcacagaagtgagagggtacactaagggaggccctggccacgaggagccggtacccatgtcaacctatgggtggaatattgtgaaacttatgagtggaaaggatgttttctacctgccacctgaaaaatgtgacacattgctgtgcgatatcggtgagagctccccctctcctactgtggaagagagcaggaccatacgcgtcctcaagatggtggagccatggttaaagaacaatcagttctgtattaaagtcctgaacccctacatgcctacagtgatcgaacatcttgagcggctgcaacgaaagcacggcgggatgctagttagaaatccactctccaggaactcaacccatgaaatgtattggatctctaatggaactggcaacattgtagctagtgtgaatatggtctcgcgcctgttgctgaaccggtttacgatgacacacagacgtcccaccatagagaaagacgtggatctcggtgcggggactaggcacgttaacgccgaaccggagacccctaatatggacgtgatcggagagcggattaagcgcatcaaagaagagcataacagcacatggcactacgacgatgaaaatccatataagacgtgggcataccatggctcctatgaggtcaaggctaccggctctgcctcaagcatgattaacggggtggtaaaacttctgactaagccctgggacgtggttcctatggtcacacagatggcaatgaccgatactacaccattcggacagcaacgagtgtttaaagaaaaggtggacaccagaacacccaggtccatgccgggtactcggcgcgtcatgggcatcaccgccgagtggttatggagaacgctggggaggaataaaaagcctcgattgtgcacccgggaggaattcacaaagaaagttcgtactaacgctgccatgggagcggtgtttaccgaggaaaatcagtgggatagtgcaaaggccgctgtagaggacgaagatttctggaaactcgtggacagagagcgcgagctgcacaagctaggcaaatgtggttcttgcgtctacaacatgatggggaagagggaaaaaaagcttggagagtttggcaaggccaaaggcagccgggcaatatggtatatgtggctgggggctagatacctcgaattcgaggccctgggatttttgaatgaggatcattggttctcacgcgaaaactcctacagtggtgtggagggcgaagggctgcacaagctcggatatatccttagggacattagcaaaatccccggcggtgctatgtacgccgatgacacagcagggtgggacactcgaattaccgaggatgacctgcacaatgaagagaagatcacgcagcagatggatccagagcatcggcaattagcgaacgccatatttaaactgacatatcagaataaggttgtgaaggtccagagacctacccccactggaacagtgatggacattatctctaggaaagatcagcgcggctccggccaagtagggacctacggattgaacactttcaccaatatggaagctcagctcatccgtcagatggagggtgaaggcgttctgtcaaaggccgacctagagaacccacaccttcccgaaaaaaagattacacagtggctggagacgaaaggggtggagcggctcaagagaatggcaataagcggagatgactgcgtcgtgaagcctatcgatgacaggtttgctaacgccctgttggcattaaatgatatgggcaaagtgcgcaaggacattccacaatggcagccgtcgaaaggttggcatgattggcagcaggtccccttctgttctcaccacttccatgaactgatcatgaaggacgggcgaaaactcgttgtgccttgccggccacaagacgagcttattggaagagccaggatcagtcagggcgcgggctggtccctgcgcgaaaccgcttgtctagggaaggcctatgcacagatgtggagcctgatgtactttcacagacgggatctcaggttggcctcaaacgctatatgctccgccgtacccgtgcattgggtccctacttctcgtacaacctggagcatccacgcacatcaccaatggatgactacagaggacatgctgaccgtgtggaatcgagtttggattgaagataacccatggatggaggacaagacgcccgtgacaacctgggagaatgtcccttatcttggaaaacgcgaagatcagtggtgtggtagtctgatcggcctcacttccagagctacctgggcccagaacattccgacagcgatccagcaagtgcggagcttaattgggaatgaggaattcctggactacatgccatctatgaagaggtttcgcaaagaggaggaatcagagggagctatatggtga

SEQ ID NO: 15190 - RNA, 9873 nt, synthetic construct
  misc_feature 1..9873: note = derived and/or modified CDS sequence (opt3) from DENV-3__KF955505__SS-prME
  source 1..9873: mol_type = other RNA
accagcctgtgcctcatgatgatccttcccgccgctctggcattccacttgacatccagaaacggcgagcctaggatgattgtggggaagaatgaacggggaaaatctttactgtttaagactgcctcaggtataaacatgtgtacgctaatcgcgatggacctcggcgagatgtgcgatgacaccgtcacatacaaatgtccacatattactgaagttgagccggaagatatcgactgctggtgtaatctgaccagtacatgggtgacctatgggacttgcaaccaggctggagagcaccgccgagataagcgtagcgtagcccttgcaccccatgtgggcatgggtctggacacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaatagagattttgttgaaggattgtcaggtgccacctgggtggacgtcgtgctggagcacggcgggtgcgtgacgactatggcgaagaacaaacccacactagatattgagctccagaagaccgaagcaactcaactggccacacttaggaaactgtgtatcgagggaaagattaccaatatcacgaccgacagccggtgccctacacagggcgaagctgtcttgccagaggaacaggatcagaactatgtttgtaaacacacttacgtggaccgcggttgggggaatggatgcggcctcttcggcaaggggagtctggtaacctgcgccaagtttcaatgtttagagcccatagagggaaaagtggtccagtatgaaaacctgaagtacacagtgattatcactgttcataccggtgatcagcaccaggtgggcaatgagacacaaggggtcaccgcagaaattactcctcaggcttccacgacagaggccatcctcccagaatatggaacccttggcctggagtgctctccgcgaactggtttggacttcaacgagatgatcctactgaccatgaaaaataaggcgtggatggtgcatagacagtggtttttcgacctccccctgccttggacaagcggggccaccactgaaacaccaacgtggaacaggaaagagcttctggtaacctttaagaatgcacacgctaaaaagcaagaagttgtggtcttgggctcccaggagggagccatgcacactgctctcacaggcgccaccgaaattcagaactcagggggaacaagtatattcgcaggtcatctgaagtgtcggttaaaaatggataagctggagctaaaaggcatgagctacgccatgtgcactaacacctttgtgctcaagaaagaggtctctgaaacgcagcacgggaccatcctgattaaggtggagtacaagggagaagacgctccctgtaaaatccctttctccacagaggatggccaaggtaaggcgcataatgggcgtcttataactgcaaacccagttgtgaccaaaaaggaggaacccgtaaatattgaggccgaaccgcctttcggcgagtcaaacatcgtcatcggaattggcgacaatgctttgaaaatcaactggtataagaaggggagcagtattggaaaaatgtttgaagccacagcacgcggtgccagaaggatggctatactgggcgatactgcctgggacttcgggtctgtgggaggcgttctcaattccctgggtaagatggtgcaccagatctttgggagcgcatacaccgcgcttttctcgggcgtctcttgggtgatgaaaattggaatcggcgtactgttgacgtggatcgggctcaactccaagaatacatcaatgagttttagctgcattgctataggaatcattaccctgtatttaggcgccgtggttcaggcagatatgggttgtgtcatcaactggaaagggaaggagctgaagtgcggatccggcattttcgtgactaatgaggtgcatacatggaccgaacagtacaaatttcaagccgactctcccaagcggctagctactgccatcgcaggtgcttgggagaacggcgtctgtgggatacgaagcaccacacgcatggaaaatctcctgtggaaacagatcgccaacgagcttaattatattttgtgggaaaacaacatcaagctgacggttgtggtgggagatattatcggcgtactcgagcaggggaaaagaaccctgactccacagcctatggagttaaagtactcatggaaaacatggggaaaggcgaagatagtcaccgccgaaacacaaaatagttccttcattatcgacggccccaacactccagagtgccccagcgcttctagggcatggaatgtgtgggaagttgaggattatggttttggggtgttcaccacgaacatttggctgaaacttcgggaagtctacacacagttgtgtgaccaccgcctcatgtcagccgctgtgaaggacgagagagccgttcacgcagatatgggatactggatcgagagtcagaaaaatggcagctggaagctggaaaaagcgtccctaatagaggtgaagacctgcacttggcctaagtctcataccctgtggtcgaacggtgtactcgaaagcgacatgatcattccaaaatccctggccggcccgatctcacagcacaatcataggcccgggtatcacacacaaactgctggaccttggcaccttggcaagttggagctggattttaactactgcgaggggaccacagtcgtgattacggaaaattgtggaacccgtggcccaagtttacggactacaaccgtgtctggtaaactcatccatgagtggtgctgtcgaagctgcactctgccccctcttagatatatgggggaagacggatgttggtacggcatggagataaggccaatttccgaaaaggaggagaacatggtcaaatcactggttagcgccggttctggcaaggtggataatttcacaatgggggtattgtgcctcgcaatcctgtttgaagaggtgatgcgcggaaagttcggcaaaaagcacatgatcgctggggtcttctttaccttcgtgctactgctctccggacagattacgtggcgggacatggcccatactctgatcatgattggcagtaacgcaagcgatagaatgggtatgggggttacctatcttgccttgatagctacatttaaaatccagcccttcctggcgttaggatttttcctcaggaagctgacctctcgcgaaaatcttctgctaggcgtgggcctcgccatggcaactacactgcaattgccggaggacattgaacagatggctaacgggatcgccctgggattaatggccctcaaactgattacccagtttgagacataccagctttggactgctctgatctccttgacctgttcaaatacgatgttcacactcaccgtcgcatggcgaactgccaccctgatactagcgggtgtgagtctgcttcctgtttgccaaagctcgtccatgcggaagacagattggctcccaatggctgtggccgcaatgggcgtcccccctctgcccttgtttatcttctctctgaaggacactttaaaacgtagaagctggccactcaacgagggggtaatggccgtgggactggtttcaattcttgctagttccctgttgaggaacgatgtgcctatggcaggccccctcgtcgccggtgggctgctaatcgcgtgttatgtgattaccggaacgtctgctgacctgacagtagaaaaggccgcagatatcacctgggaggaagaggccgaacagactggcgtgagccacaatcttatgataacagtcgacgacgatggcaccatgcgcattaaagacgatgagactgagaacatcctcacagttctgttgaagaccgctttactgatcgtgtccggggtgtttccatactcaattccggccacgctcctggtctggcatacttggcagaaacagacccaacggagcggagtgctttgggacgttcctagtcccccagaaacacagaaggcagagctggaagagggtgtatacagaataaaacagcagggcatcttcgggaagacccaagtgggagtcggcgtgcagaaggagggtgtttttcacacaatgtggcacgtgactaggggggctgtcttgacctataatggaaaacgactagaacccaactgggcctctgtgaagaaagatctgatttcctacggcggcgggtggcgcctcagcgcgcagtggcaaaagggagaggaagtacaggtcatcgccgtggagcctggtaaaaatccaaagaacttccagacgatgcccggcacattccagactaccacaggggaaattggagcaatcgctctggactttaagcctggcacctcgggttcaccgataatcaatcgggaggggaaagttgtgggactttatggcaacggcgtcgtgactaagaatgggggatacgtttctggtattgcccaaaccaacgctgagccagatggccccacacctgaattagaggaagagatgttcaaaaagagaaatctgacgatcatggacctccatccagggagtggaaaaactaggaagtatttgcccgcaattgtgcgtgaagccatcaagcgccggctgagaaccctcatactggcccctacaagggtcgtggctgcggagatggaggaagcacttaaaggcctgccgattcgataccagaccactgccacaaagtccgagcacaccggtcgggaaatcgtagatttgatgtgccatgctacgtttactatgcgcctactgagccccgtgagagttccaaactataatctcatcattatggacgaggcccacttcacagatcctgcatctatcgccgctagggggtacataagcacccgggtcggaatgggcgaagcggccgcaatttttatgaccgctactcccccaggcacagccgacgcattccctcagtccaacgcccccatccaggatgaggagcgagacattccagaaagatcatggaatagtgggaacgagtggatcaccgactttgctggaaaaacagtgtggttcgtgccgagcataaaggccggtaacgatattgcgaattgtttacgcaaaaacggcaagaaggtcatccaactgtctaggaaaacttttgacacggaataccagaagaccaaacttaatgattgggacttcgtagtgacaactgatatctccgagatgggggcaaactttaaggccgaccgtgttattgatcctcggagatgcctgaaacccgtgatcctcaccgacggaccagagagggtcattttggctggccccatgcctgtgacagccgcttcagcagcccagcgccgaggtagagttgggcggaatccacagaaggaaaacgatcaatatatattcaccggccagcccctgaataacgacgaggatcatgctcactggactgaagccaagatgctcctggacaatatcaacacgcctgagggaattatcccggcacttttcgaaccagagagggagaaaagtgcggccatcgacggcgaataccgcctaaagggggagagccgtaaaacctttgtggaactgatgagacggggagatttgcccgtctggttagctcacaaggtggcctccgagggtattaaatatacagacaggaagtggtgcttcgatggccagcgcaataaccagatactggaagagaatatggacgtagagatctggactaaagaaggggagaagaagaaactccgacctagatggctggatgcacggacctactctgacccccttgctctgaaggaatttaaagatttcgccgcaggaaggaagtcgattgccctcgacttggtgacagagatcggccgcgttccaagccatctggctcacagaaccaggaacgcgctagataatctggtcatgctccatacttcagaacacggtgggcgggcctatcgtcacgcagtggaggagcttcctgaaacaatggagacgctgttattgctgggcctcatgattctgcttaccggaggcgctatgctgtttctcatctccgggaaaggaataggtaagactagtatcggcttgatttgtgtgatcgcctctagcgggatgctgtggatggccgaaattcccttacaatggatcgcatccgctatagtcctagagttctttatgatggttctgctcattccagagcctgaaaagcagcgcacaccgcaggacaaccaacttgcctacgtggtaatcggaattctgaccttggcggctatcatagccgcaaatgagatgggcctgctcgaaaccacaaaacgagatctgggtatgtcaaaggagcccggggtggtctctccaactagctatcttgacgtggatctccatcctgccagtgcttggacgctgtacgcagttgccaccacagtgatcactcccatgttgagacacaccattgaaaactccacagcgaacgtcagcctggctgccatcgcaaatcaggccgtagtgttaatgggcctagacaaaggatggccaatttctaagatggacctgggcgttcctctccttgctctggggtgctactcacaggtgaaccccttgaccctgactgccgcagtcctcctgcttatcacgcattatgctataattggaccgggcttacaggccaaagcgacaagggaggcccaaaagcggaccgcagctggtatcatgaagaatccaactgtggatgggatcatgaccattgacctggatcctgtcatctacgactccaaattcgagaagcagctcggacaggtgatgttgctggttctatgtgccgtgcagctgctccttatgcgcacaagttgggcactgtgcgaagctttgactctggccaccggccccataacaacgctctgggagggtagcccaggcaaattttggaacaccactattgccgtatcgatggcgaatatcttcagagggtcttatctggctggagcaggcttagccttttccattatgaagagcgtggggacaggaaaaaggggcaccggttcacaaggggaaactcttggagagaagtggaagaaaaagctgaaccagctcagtcggaaagaattcgatctatacaagaaatctggcatcacagaggtcgaccgaaccgaggctaaggaaggtctgaaaagaggcgagacgacccaccatgccgtttcccgcgggagcgcaaagttgcagtggtttgtggaaaggaatatggtcatacccgagggacgggtgatcgatctgggctgtgggcgtggaggctggtcatattactgcgccggtctcaagaaagtaacagaagtgagagggtatactaagggaggccctggccacgaggagccggttcccatgagtacctacgggtggaacattgtgaaacttatgagcggaaaggacgtcttctacctgccacctgaaaaatgtgatacattgctgtgcgacatcggtgagtcctctcccagccctactgtggaagagtccaggaccattcgcgtcctcaagatggtggagccatggttaaagaataaccagttctgtatcaaagttctgaatccctatatgcctacagtaattgaacaccttgagcggctgcaacgaaagcatggcgggatgctagtgagaaacccactctcaaggaattctacccacgaaatgtactggatcagtaacggaactggcaatatagtcgcttcggtgaacatggttagccgcctgttgctgaaccggtttacgatgacacatagacgtcccaccattgagaaagatgtggacctcggtgcggggactaggcacgtcaatgccgaaccggagacccctaacatggatgtgatcggagagcggatcaagcgcattaaagaagagcacaattccacatggcattatgacgacgaaaacccatacaagacgtgggcatatcacggctcttacgaggtaaaggctaccggctcagccagctccatgataaatggggtggttaaacttctgactaagccctgggatgtcgtgcctatggtgacacagatggcaatgaccgacactacaccattcggacagcaacgagtctttaaagaaaaggttgataccagaacacccaggagtatgccgggtactcggcgcgtgatgggcatcaccgccgagtggttatggagaacgctggggaggaacaaaaagcctcgattgtgcccccgggaggaattcaccaagaaagtacgtacaaatgctgccatgggagcggtgtttactgaggaaaaccagtgggactctgcaaaggccgctgtcgaggatgaagacttctggaaactcgtggatagagagcgcgagctgcataagctaggcaaatgtggtagctgcgtttataatatgatggggaagagggaaaaaaagcttggagagtttggcaaggccaaaggctcacgggcaatttggtacatgtggctgggggctagatacctcgaattcgaggccctgggatttttgaacgaggaccactggttctcccgcgaaaatagttatagcggtgtggagggcgaagggctgccaaagctcggatacatccttagggatatttctaaaatccctggcggtgctatgtatgccgacgataccgcagggtgggacacacgaataactgaggacgatctgcataacgaagagaagatcccccaccagatggacccagagcactcccggttagcgaatgccatttttaaactgacctaccagaacaaggtcgtgaaggtacaaagacccacgcctacaggaaccgttatggatatcatttcaaggaaagctcagcgcggcagcggccaggtggggacttatggattgaatacattcaccaacatggaagcccagctcatccgtcaaatggagggtgaaggcgtcctgtcgaaggcagacctagagaacccacatcttccggaaaaaaagataactcagtggctggagaccaaaggggtggagcggctcaagagaatggctattacaggagatgactgcgtggtcaagcccatcgatgacaggtttgccaatgcactgttggccttaaacgatatgggcaaagttcgcaaggacatccctcagtggcagccatctaaaggttggcacgattggcaacaggtgcccttctgtagtcatcacttccacgaactgattatgaaggacgggcgaaaactcgtagtgccttgccggccacaggatgagcttataggaagagcgaggatctcccagggcgctggctggagcctgcgcgaaacggcctgtctagggaaggcatacgcccaaatgtggtcactgatgtattttcatagacgggacctcaggttggcttccaatgccatttgctctgcagtccccgtgcactgggttcctaccagccgtactacatggagtatccatgctcaccatcagtggatgaccactgaggacatgctgacagtgtggaaccgagtctggattgaagataatccgtggatggaggacaagaccccagtgacgacatgggagaacgtaccctaccttggaaaacgcgaagatcagtggtgtggttccctgatcggcctcaccagcagagccacttgggcgcaaaatatacctaccgctatccagcaggttcggtctttaattgggaacgaggaattcctggactacatgccctcaatgaagaggtttcgcaaagaggaggaaagtgagggagccatctggtga

SEQ ID NO: 15191 - RNA, 9873 nt, synthetic construct
  misc_feature 1..9873: note = derived and/or modified CDS sequence (opt3) from DENV-3__FJ898464__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgcttctagggcatggaacgtgtgggaagttgaggactatggttttggggtgttcaccacgaatatttggctgaaacttcgggaagtctacacacagttgtgtgaccaccgcctcatgtcagccgctgtgaaggatgagagagccgttcacgcagacatgggatactggatcgagagtcagaaaaacggcagctggaagctggaaaaagcgtccctaatagaggtgaagacctgcacttggcctaagtctcataccctgtggtcgaatggtgtactcgaaagcgatatgatcattccaaaatccctggccggcccgatctcacagcacaaccataggcccgggtatcacacacaaactgctggaccttggcaccttggcaagttggagctggactttaattactgcgaggggaccacagtcgtgattacggaaaactgtggaacccgtggcccaagtttacggactacaaccgtgtctggtaaactcatccatgagtggtgctgtcgaagctgcactctgccccctcttagatatatgggggaagatggatgttggtacggcatggagataaggccaatttccgaaaaggaggagaatatggtcaaatcactggttagcgccggttctggcaaggtggacaacttcacaatgggggtattgtgcctcgcaatcctgtttgaagaggtgatgcgcggaaagttcggcaaaaagcacatgatcgctggggtcttctttaccttcgtgctactgctctccggacagattacgtggcgggatatggcccatactctgatcatgattggcagtaatgcaagcgacagaatgggtatgggggttacctatcttgccttgatagctacatttaaaatccagcccttcctggcgttaggatttttcctcaggaagctgacctctcgcgaaaaccttctgctaggcgtgggcctcgccatggcaactacactgcaattgccggaggatattgaacagatggctaatgggatcgccctgggattaatggccctcaaactgattacccagtttgagacataccagctttggactgctctgatctccttgacctgttcaaacacgatgttcacactcaccgtcgcatggcgaactgccaccctgatactagcgggtgtgagtctgcttcctgtttgccaaagctcgtccatgcggaagacagactggctcccaatggctgtggccgcaatgggcgtcccccctctgcccttgtttatcttctctctgaaggatactttaaaacgtagaagctggccactcaatgagggggtaatggccgtgggactggtttcaattcttgctagttccctgttgaggaacgacgtgcctatggcaggccccctcgtcgccggtgggctgctaatcgcgtgttatgtgattaccggaacgtctgctgatctgacagtagaaaaggccgcagacatcacctgggaggaagaggccgaacagactggcgtgagccacaaccttatgataacagtcgacgatgacggcaccatgcgcattaaagatgacgagactgagaatatcctcacagttctgttgaagaccgctttactgatcgtgtccggggtgtttccatactcaattccggccacgctcctggtctggcatacttggcagaaacagacccaacggagcggagtgctttgggatgttcctagtcccccagaaacacagaaggcagagctggaagagggtgtatacagaataaaacagcagggcatcttcgggaagacccaagtgggagtcggcgtgcagaaggagggtgtttttcacacaatgtggcacgtgactaggggggctgtcttgacctataacggaaaacgactagaacccaattgggcctctgtgaagaaagacctgatttcctacggcggcgggtggcgcctcagcgcgcagtggcaaaagggagaggaagtacaggtcatcgccgtggagcctggtaaaaacccaaagaatttccagacgatgcccggcacattccagactaccacaggggaaattggagcaatcgctctggattttaagcctggcacctcgggttcaccgataatcaaccgggaggggaaagttgtgggactttatggcaatggcgtcgtgactaagaacgggggatacgtttctggtattgcccaaaccaatgctgagccagacggccccacacctgaattagaggaagagatgttcaaaaagagaaacctgacgatcatggatctccatccagggagtggaaaaactaggaagtatttgcccgcaattgtgcgtgaagccatcaagcgccggctgagaaccctcatactggcccctacaagggtcgtggctgcggagatggaggaagcacttaaaggcctgccgattcgataccagaccactgccacaaagtccgagcacaccggtcgggaaatcgtagacttgatgtgccatgctacgtttactatgcgcctactgagccccgtgagagttccaaattataacctcatcattatggatgaggcccacttcacagaccctgcatctatcgccgctagggggtacataagcacccgggtcggaatgggcgaagcggccgcaatttttatgaccgctactcccccaggcacagccgatgcattccctcagtccaatgcccccatccaggacgaggagcgagacattccagaaagatcatggaacagtgggaatgagtggatcaccgattttgctggaaaaacagtgtggttcgtgccgagcataaaggccggtaacgacattgcgaactgtttacgcaaaaatggcaagaaggtcatccaactgtctaggaaaacttttgatacggaataccagaagaccaaacttaacgactgggatttcgtagtgacaactgacatctccgagatgggggcaaattttaaggccgatcgtgttattgaccctcggagatgcctgaaacccgtgatcctcaccgatggaccagagagggtcattttggctggccccatgcctgtgacagccgcttcagcagcccagcgccgaggtagagttgggcggaacccacagaaggaaaatgaccaatatatattcaccggccagcccctgaacaatgatgaggaccatgctcactggactgaagccaagatgctcctggacaacatcaatacgcctgagggaattatcccggcacttttcgaaccagagagggagaaaagtgcggccatcgatggcgaataccgcctaaagggggagagccgtaaaacctttgtggaactgatgagacggggagacttgcccgtctggttagctcacaaggtggcctccgagggtattaaatatacagataggaagtggtgcttcgacggccagcgcaacaatcagatactggaagagaacatggatgtagagatctggactaaagaaggggagaagaagaaactccgacctagatggctggacgcacggacctactctgatccccttgctctgaaggaatttaaagacttcgccgcaggaaggaagtcgattgccctcgatttggtgacagagatcggccgcgttccaagccatctggctcacagaaccaggaatgcgctagacaacctggtcatgctccatacttcagaacacggtgggcgggcctatcgtcacgcagtggaggagcttcctgaaacaatggagacgctgttattgctgggcctcatgattctgcttaccggaggcgctatgctgtttctcatctccgggaaaggaataggtaagactagtatcggcttgatttgtgtgatcgcctctagcgggatgctgtggatggccgaaattcccttacaatggatcgcatccgctatagtcctagagttctttatgatggttctgctcattccagagcctgaaaagcagcgcacaccgcaggataatcaacttgcctacgtggtaatcggaattctgaccttggcggctatcatagccgcaaacgagatgggcctgctcgaaaccacaaaacgagacctgggtatgtcaaaggagcccggggtggtctctccaactagctatcttgatgtggacctccatcctgccagtgcttggacgctgtacgcagttgccaccacagtgatcactcccatgttgagacacaccattgaaaattccacagcgaacgtcagcctggctgccatcgcaaaccaggccgtagtgttaatgggcctagacaaaggatggccaatttctaagatggatctgggcgttcctctccttgctctggggtgctactcacaggtgaatcccttgaccctgactgccgcagtcctcctgcttatcacgcattatgctataattggaccgggcttacaggccaaagcgacaagggaggcccaaaagcggaccgcagctggtatcatgaagaacccaactgtggacgggatcatgaccattgatctggaccctgtcatctacgattccaaattcgagaagcagctcggacaggtgatgttgctggttctatgtgccgtgcagctgctccttatgcgcacaagttgggcactgtgcgaagctttgactctggccaccggccccataacaacgctctgggagggtagcccaggcaaattttggaataccactattgccgtatcgatggcgaacatcttcagagggtcttatctggctggagcaggcttagccttttccattatgaagagcgtggggacaggaaaaaggggcaccggttcacaaggggaaactcttggagagaagtggaagaaaaagctgaatcagctcagtcggaaagaattcgacctatacaagaaatctggcatcacagaggtcgatcgaaccgaggctaaggaaggtctgaaaagaggcgagacgacccaccatgccgtttcccgcgggagcgcaaagttgcagtggtttgtggaaaggaacatggtcatacccgagggacgggtgatcgacctgggctgtgggcgtggaggctggtcatattactgcgccggtctcaagaaagtaacagaagtgagagggtatactaagggaggccctggccacgaggagccggttcccatgagtacctacgggtggaatattgtgaaacttatgagcggaaaggatgtcttctacctgccacctgaaaaatgtgacacattgctgtgcgatatcggtgagtcctctcccagccctactgtggaagagtccaggaccattcgcgtcctcaagatggtggagccatggttaaagaacaatcagttctgtatcaaagttctgaacccctatatgcctacagtaattgaacaccttgagcggctgcaacgaaagcatggcgggatgctagtgagaaatccactctcaaggaactctacccacgaaatgtactggatcagtaatggaactggcaacatagtcgcttcggtgaatatggttagccgcctgttgctgaaccggtttacgatgacacatagacgtcccaccattgagaaagacgtggatctcggtgcggggactaggcacgtcaacgccgaaccggagacccctaatatggacgtgatcggagagcggatcaagcgcattaaagaagagcacaactccacatggcattatgacgatgaaaatccatacaagacgtgggcatatcacggctcttacgaggtaaaggctaccggctcagccagctccatgataaacggggtggttaaacttctgactaagccctgggacgtcgtgcctatggtgacacagatggcaatgaccgatactacaccattcggacagcaacgagtctttaaagaaaaggttgacaccagaacacccaggagtatgccgggtactcggcgcgtgatgggcatcaccgccgagtggttatggagaacgctggggaggaataaaaagcctcgattgtgcacccgggaggaattcacaaagaaagtacgtactaacgctgccatgggagcggtgtttaccgaggaaaatcagtgggattctgcaaaggccgctgtcgaggacgaagatttctggaaactcgtggacagagagcgcgagctgcataagctaggcaaatgtggtagctgcgtttataacatgatggggaagagggaaaaaaagcttggagagtttggcaaggccaaaggctcacgggcaatttggtacatgtggctgggggctagatacctcgaattcgaggccctgggatttttgaatgaggatcactggttctcccgcgaaaacagttatagcggtgtggagggcgaagggctgcataagctcggatacatccttagggacatttctaaaatccccggcggtgctatgtatgccgatgacacagcagggtgggacactcgaataaccgaggatgacctgcacaatgaagagaagatcacgcagcagatggatccagagcaccggcaattagcgaacgccatttttaaactgacataccagaataaggtcgtgaaggtacagagacctacccccactggaacagttatggacatcatttccaggaaagatcagcgcggctcaggccaagtggggacctatggattgaacactttcaccaatatggaagctcagctcatccgtcagatggagggtgaaggcgtcctgagcaaggccgacctagagaacccacatcttcccgaaaaaaagataacacagtggctggagacgaaaggggtggagcggctcaagagaatggcaatttcgggagatgactgcgtggtcaagcctatcgatgacaggtttgctaacgccctgttggcattaaatgatatgggcaaagttcgcaaggacatcccacaatggcagccgtctaaaggttggcacgattggcagcaggtgcccttctgtagtcatcacttccacgaactgattatgaaggacgggcgaaaactcgtagtgccttgccggccacaagacgagcttataggaagagccaggatctcccagggcgcgggctggagcctgcgcgaaaccgcttgtctagggaaggcctacgcacagatgtggtcactgatgtattttcatagacgggatctcaggttggcctccaacgctatttgctctgccgtccccgtgcactgggttcctactagccgtacaacctggagtatccatgcacaccatcaatggatgactacagaggacatgctgaccgtgtggaatcgagtctggattgaagataacccatggatggaggacaagacgcccgtgacaacctgggagaatgtaccttaccttggaaaacgcgaagatcagtggtgtggttccctgatcggcctcactagcagagctacctgggcccagaacataccgacagcgatccagcaagttcggtctttaattgggaatgaggaattcctggactacatgccatcaatgaagaggtttcgcaaagaggaggaaagtgagggagctatctggtga

SEQ ID NO: 15192 - RNA, 9873 nt, synthetic construct
  misc_feature 1..9873: note = derived and/or modified CDS sequence (opt3) from DENV-3__JQ922556__SS-prME
  source 1..9873: mol_type = other RNA
accagcctgtgcctcatgatgatccttcccgcagctctggcattccacttgacctccagagacggcgaacctaggatgattgtggggaagaacgaacgggggaagtctttactgtttaagactgcctcaggtataaatatgtgtacgctaatcgcgatggatctcggcgaaatgtgcgacgataccgtaacgtacaagtgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagcccccgcacgcggtgccagaaggatggctatactgggcgacacagcctgggtgttcgggtctgttggaggcgtgctcaactccctgggtaagatggtccaccagatctttgggagcgcatacactgcgcttttctcgggcgtgtcttgggtaatgaaaattggaatcggcgtgctgttgacctggatcgggctcaattccaagaacacgtcaatgagttttagctgcattgctataggaatcattacactgtatttaggcgccgttgtccaggcagatatgggttgtgtgatcaattggaaagggaaggagctgaagtgcggatccggcattttcgtgaccaacgaggtccatacttggacagaacagtacaaatttcaagccgactctccaaagcggctagctaccgccatcgccggtgcttgggagaatggcgtttgtgggatacgaagcactacccgcatggaaaacctcctgtggaaacagatcgccaatgagcttaactatattttgtgggaaaataacatcaagctgacagtggtggtaggagatacgattggcgtcctcgagcaggggaaaagaaccctgactcctcagcccatggagttaaagtactcatggaaaacatggggaaaggcgaagatcgtgaccgccgaaacacaaaacagttccttcataattgacggcccaagcactcccgagtgcccttctgcttcaagggcatggaatgtttgggaagtggaggattatggttttggggtcttcaccacgaacatctggctgaaacttcgggaagtgtacacacagatgtgtgaccaccgcttgatgagtccagccgttaaggacgagagagctgtgcacgccgatatgggatactggattgagagccagaaaaatggctcctggaagctcgaaaaagcatctctgatcgaggtaaagacctgcacttggccgaagtcgcataccctatggagcaacggtgtcctggaatccgacatgataatccccaaatcactcgcgggccctattagtcagcacaattataggccagggtaccatacacaaactgccggaccctggcacctgggcaaacttgagttggattttaactattgcgaggggaccacagtggtgatcacggaaaattgtggaacccgtggcccttctctgcggactacaaccgtcagcggtaaattaattcacgagtggtgctgtcgatcctgcactctcccacccctgagatacatgggggaagacggatgttggtatggcatggagatcaggccgatatcagaaaaggaggagaacatggttaaaagccttgtgtctgctggttccggcaaggtagataatttcacaatgggggtgctgtgcttggccattctctttgaagaggtcatgcgcggaaagttcggcaaaaagcatatgatcgcaggggtgttctttaccttcgttctgctactgagtggacagatcacgtggcgggacatggctcacactctcattatgatcggcagcaacgcctctgatagaatgggtatgggggtgacctacctggcacttattgccacatttaaaatacagcctttcttggctctgggatttttcttaaggaagctcacctcccgcgaaaatctgcttctgggcgtcggcctagcgatggccactacactccaactgccagaggacatcgaacagatggcaaacgggattgctttgggactgatggcctttaaattaatcacccagttcgagacatatcagctctggactgccctgatttcacttacctgtagtaatacgatctttacactgaccgtggcttggcgaactgcaaccttgatactcgccggtgttagcctgctacccgtgtgccaatcgtcctctatgcggaagacagattggctgcctatgactgtcgcggctatgggcgtacccccacttcctctcttcatctttagcctgaaggacaccttgaaacgtagatcatggcccctgaacgagggggtgatggccgttggattagtgagtattctcgcatcctctctgcttaggaatgatgtcccaatggccggcccgctggtggctggtgggttgctcatcgcatgttacgtaggaacgggcacaagcgccgacctgaccgtggaacaggcggctgatgtcacttgggaggaagaggccgaacagacaggcgtttcccataacctaatgattaccgtggacgacgatgggactatgcgcatcaaggacgatgagacagagaacatactgaccgtgcttctcaaaacggcactgttgattgtctcaggaatcttcccttacagcatccccgccactttactggtgtggcacacctggcagaagcaaacacagcggagtggtgttctctgggacgtaccatctccccctgaaacccagaaagctgagctggaagagggcgtgtatagaattaagcagcaagggatacttggaaaaacacaggtcggcgtgggtgttcagaaggagggggtgtttcatactatgtggcacgtcaccaggggagccgtgctgacgcacaatggcaagcgattggaaccaaactgggcatccgtcaagaaggatctaatcagctacggcgggggatggcgcctgtcgccccaatggcagaaaggtgaggaagtccaggtgattacagttgagcctggcaagaatccgaaaaacttccagactatgccagggaccttccaaacaaccactggagaaatcggcgctattgccctcgactttaagcccggtacctcagggtctcctatcataaatcgggagggaaaggtggtcggcctgtatggcaacggggtggttaccaagaatggaggttacgtgagtggcatcgcgcagacgaacgccgagccagatgggcccactcctgaacttgaggaagagatgttcaagaaaagaaatttaaccattatggacctgcatccgggatccggcaagacaaggaaatatctccccgcaatcgtccgtgaagctattaaccgccggttgagaaccctgatcctcgccccaactagggtggtagctgcagagatggaggaagccctgaagggtcttcctatacgataccagacaaccgccacaaagagcgagcacactgggcgggaaattgtggatctgatgtgccatgctacatttaccatgcgcttgctatctcccgttagagtcccaaattataacctgatcatcatggacgaggcgcacttcaccgatcctgcaagcattgccgctaggggatacatctccactcgggtgggcatgggcgaagccgcagccatatttatgacagctacacccccagggacagcggacgccttcccgcagtcaaatgcacctattcaagatgaggagcgagacatccccgaaagaagttggaacagcggaaatgagtggattactgactttgctggtaaaacggtgtggttcgtcccatctatcaaggccggcaacgatatagcaaactgtctccgcaaaaatgggaagaaagtaattcagttatccaggaagacctttgaaacagagtaccagaagactaaactgaacgactgggatttcgtgggaaccacagacatctcagagatgggcgccaattttaaggctgatcgtgttatcgacccccggagatgccttaaacctggtattctgaccgatgggccagaaggcgtgatcctcgccggacccatgcctgtcactgcggcaagtgccgctcagaggcgcggccgagtggggagaaacccgcaaaaggagaatgaccagtatattttcacgggacagccattgaacaatgatgaagaccatgcccactggaccgaggctaaaatgctgctcgataacataaatacacccgaaggtatcattcctgcactgttcgagcccgagcgggaaaagagcgccgctatcgacggcgagtacaggcttaagggggaatcccgcaaaacttttgttgagctaatgcgtagaggagacctgccagtgtggttggcccacaaggtcgcatctgaaggcatcaaatataccgatcggaagtggtgcttcgacggtcagaggaacaatcaaattttagaggagaacatggatgtggaaatatggacaaaagagggggaaaagatcaaactgcgccctcgatggctcgacgcgagaacctactcggatcccctggcccttaaggagtttaaggacttcgctgccggccggaaaagcattgcactggatctcgtaactgaaatcggaagggtgccatcacatttggctcaccgcacaagaaatgccctggacaacctagttatgctgcatacgtccgagcacggcgggagggcatatcggcacgccgtcgaggaactccctgagaccatggaaactcttctgttattgggactgatgattctcctgacaggtggcgctatgctttttctgatcagtgggaagggaataggcaaaacctctatcggtctcatttgtgtgatcgcgagctccgggatgttgtggatggccgagattccgctgcagtggatcgcatcagctatagtgttagagttctttatgatggtcctactgattcccgaaccagagaagcagcgtacccctcaagataatcagctcgcctacgttgtgatcggcattcttacactggccgcaatcatagctgccaacgaaatgggattgctggagactacgaaacgcgacctcggcgtatctaaggaacccggggtggtcagcccaaccagttatctggatgtggaccttcatcctgcgtccgcttggacactctacgccgttgcaactaccgtgatcacacccatgctgcgacacaccattgagaatagcactgccaacgtctctttggctgcaatcgccaaccaggcggtagtgctgatgggattagataagggctggccgatttcaaaaatggacctaggtgttccactgctcgctcttgggtgctactcccaggtgaatcctctgacgttgacagccgcagtcctgctcctgatcacccattatgccataattggacccggccttcaagctaaggccactagagaggcacagaaaaggaccgctgccggtatcatgaagaacccaacagtggacggcatcattactatcgatttagaccccgtcatatacgatagtaaattcgaaaagcagctgggacaggtgatgctcttggttctgtgtgcggtgcaactactgctcatgcggaccagctgggccctttgcgaggcactgacattggctacgggacctattaccactctgtgggaaggctcgccggggaagttttggaatacaaccatcgccgtatctatggcaaacattttccgcggatcctatctcgctggcgccggtctggcctttagcatcatgaaatcagtggggactggaaagagaggcacaggtagtcagggcgagaccttaggggaaaaatggaagaagaaacttaatcagctgtctaggaaagagttcgacctctacaaaaagtccggaataacggaggtcgatcggaccgaagcgaaagagggcctaaagcgaggggaactgacacaccatgctgttagcagaggatcagcaaaattgcagtggtttgtggagcgcaacatggtcatccccgaaggcagggtgattgacctgggttgtgggcggggaggctggagttattactgcgccggcctcaagaaagtaactgaggtgcgtgggtataccaagggaggtccaggccacgaggaacctgttcccatgagcacatacgggtggaatatcgtgaaacttatgtccggaaaagatgtcttctacctgcctccagagaagtgtgacactttgctgtgcgatattggcgaatctagcccctcccctaccgtggaggagtcaagaacaatcagggtcctcaaaatggtggaaccatggttaaagaacaatcaattctgtattaaagttctgaacccctatatgccggctgtaatcgagcaccttgaacgcctgcagcggaagcatggtgggatgctagtgcgaaatcctctctctagaaacagtacccacgagatgtactggatatcgaatggaactggcaacattgtcagctccgtgaatatggtttctaggctgttgctgaaccgctttacgatgacacatcggagaccaaccatcgaaaaggacgtggatctcggcgccgggactcgtcacgtcaacgcagagcccgagacccctaatatggacgtgatcggagaaaggattaaacggataaaggaggaacacaactcaacatggcattatgatgacgagaatccatacaaaacgtgggcctatcacggtagctacgaagtaaaggctaccggctccgggagttctatgatcaacggagtggttaaacttctgactaagccctgggacgtcgtgccgatggtgacacagatggcgatgaccgatactacacctttcggccaacagcgcgtctttaaggagaaagttgacacccgaacacccagaccaatgcctggtactaggaaggtgatggagattaccgccgaatggttatggcggacgctggggcgcaataaaagacccaggttgtgcacccgagaggagttcacaaagaaagtacggactaacgcagctatgggagccgtgtttaccgaggaaaatcagtgggatagcgcaaaggccgctgtcgaggacgaggagttctggaagctcgtggatcgtgagagagaactgcataaactaggcaagtgtggctcatgcgtttataacatgatgggagggcgcgagaagaaacttggtgagtttggcaaagccaaagggtccagggcgatctggtacatgtggctgggagcacggtacctcgagttcgaggccctgggctttttgaatgaagaccactggttcagtagagagaacagctattctggtgtggaaggggagggactgcataaactcggctacattcttcgcgatatctccaagataccaggcggggctatgtatgccgacgatacagcaggatgggacactaggatcaccgaggatgacctgcacaatgaagagaagattacgcagcaaatggaccccgaacaccgattactggctaacgccatctttaaattgacataccagaataaggtcgtgaaagtacagcggcctaccccaactggtacagttatggatattatctcaagaaaggaccagaggggcagcgggcaagtgggaacctatggcctcaacactttcaccaatatggaggctcagctggtccgccagatggaaggtgagggggtgctatcgaaagccgatcttgagaacccgcatctgcccgaaaagaagataacacagtggctcgagacgaaaggagtggaacgtctgaagcggatggcaatttctggcgacgattgcgtcgttaaacctatcgacgatagatttgcgaacgccttgttagctctgaatgacatgggcaaggtgaggaaagatatcccacaatggcagcccagtaaggggtggcacgactggcagcaggtacctttctgttcccatcacttccacgagctcattatgaaggatggacgcaaacttgtggtcccatgccgaccccaagacgaactgataggtcgggccagaatcagccagggcgcagggtggtcactaagggagaccgcttgtctgggaaaggcctacgcacagatgtggtccctcatgtattttcatcgcagagatttgcggctggcctctaacgcgatttgcagcgctgtgcctgttcactgggtgactacaagtaggaccacttggtccatccatgcccaccatcaatggatgacaaccgaggacatgcttacggtctggaatcgtgtgtggattgaagacaacccgtggatggaggataaaacaccagtaaccacttgggaaaatgttccctacctgggcaagcgagaggaccagtggtgtggtagcctcatcgggttaacctctcgcgcaacatgggcccagaacatacctactgctatccagcaagtgagatcactgattggaaatgaggagttcttggattacatgcccagtatgaaacggtttaggaaggaggaagagtccgaaggcgccatctggtga

SEQ ID NO: 15193 - RNA, 9873 nt, synthetic construct
  misc_feature 1..9873: note = derived and/or modified CDS sequence (opt3) from DENV-3__JQ922557__SS-prME
  source 1..9873: mol_type = other RNA
acaagcctgtgcctcatgatgatccttcccgccgctctggcattccacttgacatccagggacggagagcctaggatgattgtggggaagaacgagcggggaaaatctttactgtttaagactgcctcaggtataaatatgtgtacgctcatcgcgatggatctcggcgagatgtgcgacgatacagtcacatacaaatgtccacatattactgaagttgagccggaagacatcgattgctggtgtaacctgaccagtacatgggtgacctatgggacttgcaatcaggctggagagcaccgccgagacaagcgtagcgtggcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaaggttgtcaggagccacctgggtggatgtcgtgctggagcacggtggctgcgtgacgactatggcgaagaataaacccacactagacattgagctccagaagaccgaagcaactcaactggccacacttcggaaactgtgtatcgaggggaagattaccaacatcacgaccgatagccgctgccctacacagggagaagctgtcttgccagaggaacaggaccagaattatgtttgtaaacacacttacgtggatcgaggctggggtaacgggtgcggactcttcggcaagggcagtctggtaacctgcgccaagtttcaatgtttagagcccatagaggggaaagtggtccagtatgaaaatctgaagtacacagtgattatcactgttcataccggagaccagcaccaggtgggtaacgagacacaaggcgtcaccgcagaaattactcctcaggcttccacgacagaggccatcctcccagaatatgggacccttggactggagtgctctccgagaactggcttggacttcaatgagatgatcctactgaccatgaaaaacaaggcgtggatggtgcataggcagtggtttttcgatctccccctgccttggacaagcggtgccaccactgaaacaccaacgtggaatcggaaagagcttctggtaacctttaagaacgcacacgctaaaaagcaagaagttgtggtcttggggtcccaggagggcgccatgcacactgctctcacaggagccaccgaaattcaaaattcaggcgggacaagtatattcgcaggacatctgaagtgtcgtttaaaaatggacaagctggagctaaaaggtatgagctacgccatgtgcactaacacctttgtgctcaagaaagaggtctctgaaacgcagcacggcaccatcctgattaaggtggagtacaagggggaagatgctccctgtaaaatccctttctccacagaggacggacaaggcaaggcgcataacggtcgccttataactgcaaatccagttgtgaccaaaaaggaggaacccgtaaacattgaggccgaaccgcctttcggggagtcaaatatcgtcatcggcattggagataacgctttgaaaatcaattggtataagaagggcagcagtattgggaaaatgtttgaagccacagcaagaggagccaggcggatggctatactgggtgacactgcctgggatttcggctctgtaggcggggttctcaactccctggggaagatggtgcaccagatctttggtagcgcatacaccgcgcttttctcgggggtctcttgggtgatgaaaattggcatcggagtactgttgacgtggatcggcctcaattccaagaacacatcaatgagttttagctgcattgctatagggatcattaccctgtatttaggagccgtggttcaggcagacatgggctgtgtcatcaattggaaaggtaaggagctgaagtgcgggtccggaattttcgtgactaacgaggtgcatacatggaccgaacagtacaaatttcaagccgattctcccaagcgactagctactgccatcgcaggcgcttgggagaatggtgtctgtggcatacgcagcaccacaagaatggaaaacctcctgtggaaacagatcgccaatgagcttaactatattttgtgggaaaataacatcaagctgacggttgtggtgggggacaccattggagtactcgagcagggcaaaaggactctgacaccacagcctatggagttaaagtactcatggaaaacctgggggaaggcgaagatcgtcacagccgaaactcaaaacagttccttcataattgatggacccaataccccagagtgccccagcgcttctcgggcatggaacgtgtgggaagttgaggactatggctttggtgtgttcacgacaaatatctggctgaaacttcgcgaagtctacacccagatgtgtgaccacagattgatgtcagccgctgtgaaggatgagagggccgttcacgcagacatggggtactggattgagagtcagaaaaacggaagctggaagctcgaaaaagcgtccctgatcgaggtgaagacttgcacctggcctaagtctcatacactatggtcgaatggcgtactggaaagcgatatgataatcccaaaatccctcgccggtccgatttcacagcacaactatcgtcccggctaccatactcaaaccgctgggccttggcacctgggaaaacttgagttggactttaattattgcgagggcacaacggtcgtgatcaccgaaaactgtgggactcggggaccaagtctgcgaacaaccactgtgtctggcaaattaattcacgagtggtgctgtagaagctgcacactaccccctctgaggtacatgggtgaagatgggtgttggtatggaatggagatccgcccaatatccgaaaaggaggagaatatggtcaaatcacttgttagcgccggcaagtctaagcgggacaactccaccatgggtgtgctgtgcttggcaattctcttcgaagaggtaatgagaggcaaatttgggaagaaacatatgatcgctggagtgttcttcacgtttgtcctgctactgagtggccagatcacttggagggatatggcccacaccctcattatgatcgggagcaatgcatctgaccgcatgggaatgggcgtgacatacctggcccttattgctaccttcaagatacagccctttttggcgctgggtttctttttacgaaaactcacttcccgggaaaacctgatgcttggggttggactggccatggcaacaaccctacaactcccggaggatatcgaacagatggctaatggcattgccctgggcttgatggccctgaagttaatcacacagttcgagacttatcagctctggaccgctctgatttcacttacgtgtagtaacacaatctttaccctgactgtggcatggcgtaccgccacattgatactcgcgggggtcagcctgctacctgtgtgccaatcgtcctctatgagaaagactgactggctgccaatgaccgttgctgccatgggagtgccccctcttcccctcttcatctttagcctgaaagatacgttgaagaggcgctcatggccactgaatgagggtgtcatggcagtaggcttagtgagtattctcgcctcctctctgcttcggaacgacgttcctatggctgggcccctggtggcaggaggcttgctcatcgcctgttacgtcattacaggtaccagcgcggatctgactgtggaaaaagctgccgacgtaacatgggaggaagaggcagaacagaccggggtgtcccataacctactgatcactgtcgacgataatggaacaatgagaataaaggacgatgagaccgagattatccttacggttctcctgaaaactgccttgcagatcgtgtcaggcattttcccatacagcataccggctaccttactggtgtggcacacatggcagaagcaaacccagaggagtggcgtcctctgggacgtgccttctcccccagaaacacagaaagccgagctggaagagggggtttatcgaatcaagcagcaaggcattcttggtaagactcaggtaggcgtgggggtccagaaagagggagtgtttcataccatgtggcacgttacgcgcggcgcagtgctgacacacaacggtaagcggttggaacccaattgggcttccgtcaaaaaggatctaatcagctacgggggaggctggagactgtcggcccaatggcagaaaggcgaggaagtgcaggtaattgcggtcgagcctgggaagaacccaaagaatttccagactatgcccggaacctttcaaacaaccactggtgaaatcggcgccatagcactcgacttcaaacctgggacctcaggatctccgatcattaacagggagggcaaggtggttggtctgtatgggaatggagtggtcaccaagaatggcgattaccttagtggcatcgctcagacgaatgccgagccatatgggccctcccctgacttagaagaggaaatgttcaagaaacgtaagctgactattatggatctccatccaggaagcggtcagaccttgaagtacctgcccgctatcgtgcgcgacgcaataaaacggagactcaggattctgatccttgcccctacacgagttgtggccgctgagatggaagaggcgctgaagggcttgccgatccggtatcagaccactgcaacaaaatctgagcacaccgggcgcgaaattgtcgatctaatgtgccatgccacgtttactatgagactgctcagccccgtgagggtaccaaactacaatttaatcataatggacgaggctcacttcacagatcctgcctccattgcagcccggggatacatctcaacccgagtgggcatgggtgaagctgcggccatttttatgaccgcaactcccccagggacagctgacgccttccctcaaagtaacgcacccatccaggacgccgagagagatataccagaacgcagctggaactctggaaacgagtggattaccgactttgctggcaagacagtttggttcgtcccgtccatcaaagccggcaatgatatcgcgaactgtctgaggaagaacgggaagaaagtgattcagctttcacgtaagacttttgagacggaatatcagaaaaccaagctgaatgactgggatttcgtggtcacaactgacatcagtgagatgggagcaaactttaaagccgatcgggtaattgaccctagaaggtgcctcaagcccgtgatattgaccgatggtccaaagcgcgttatcctggctggccccatgcctgacacagccgctagcgcagcccaacgaagagggcgggtgggaaggaatccacagaaagaaaacgatcagtacattttccccggccagcctctcaataccgacgaggaccatgctcactggccggagactaagctgcttatggatctatttacgaccccagaaggtatcctgccctcccacttcgaccctcatggggagaacttccccgaaatctctggcgagtatcgcttgaaaggagaatcgcgtaagacatttgtcgagttaatgagacggggcgatctgccagtgtggctcgcccacaaagttgcaagcgaggggattaagtacactgacaggaaatggtgcttcgatggacaacgcaataaccagatactggaagagaatatggacgtggaaatctggaccaaggagggtgaaaagaagaaacttcgacctagatggctggatgcgcggacatattcagaccccctcgccttgaaagagtttaaagatttcgctgccggcaggaaatccattgcactggacctagtcaccgagatcgggcgcgtgccaagtcatctggctcacagaactaggaacgccctcgataatcttgtaatgctgcacacatctgaacatggaggccgggcataccgtcacgccgtggaggaattacctgagacgatggaaaccttgctgctcctgggtcttatgattctgctcactgggggcgctatgttgtttctgatcagcggaaagggcatagggaagacatccatcggattaatttgtgttatcgcgtcatctggtatgctatggatggccgagattccgctgcagtggatcgcaagcgctatagtcctcgagttctttatgatggtgcttctgattcccgaaccagagaaacaacgcacccctcaggacaaccagttggcctatgtggtcatcggcattctgaccctcgccgcaatcatagctgccaatgaaatggggctgcttgagacaactaagcgagatctcggaatgagtaaagagcccggcgttgtgtccccaacgagctacctggacgtagactctcatcctgcgtcagcttggaccttgtacgccgtggcaacaactgtcatcacccccatgctgagacacacaattgaaaactccaccgccaatgtgagtttagctgcaatcgccaaccaggcggttgtgctaatgggtctggataaggggtggccgattagcaaaatggacctcggcgtcccacttctggctttgggatgctattcgcaagtaaatcctctgactctcacggccgcagtgctgcttttaatcacacattacgccataattggccccgggctgcaggctaaggccaccagggaggcacagaagcggactgctgccggaatcatgaaaaacccaaccgttgatggcatcattacaatcgacctcgatcccgtgatatatgactctaagttcgaaaaacagttgggtcaagtcatgctgctagtgctgtgtgcggtccagctccttctgatgcgcacttcctgggccttgtgcgaggcactgaccctcgctacagggcctatgacgaccctgtgggaaggaagcccgggcaagatttggaacactacaatcgccgtgtcaatggcaaatatttttagaggtagttacttagctggcgccgggcttgccttctctatcatgaaatccgttggaaccggcaagagggggactggaagccagggcgagacactgggtgagaagtggaaaaagaaactcaaccagctatcacggaaggaatttgatctgtataaaaagagtgggataaccgaggtggaccgaacggaagcgaaagagggattgaagagaggcgaaaccacacaccacgctgtaagccgcggttccgcaaagctgcaatggttcgtggagaggaatatggtcatccccgagggccgggttattgatctcgggtgtggacgtggcgggtggtcttactattgcgccggacttaaaaaggtgactgaagtcagaggctacaccaaaggtgggccaggacatgaggaacctgtgcccatgagcacatacggctggaacatcgtaaagctgatgtccggcaaagacgtgttttatttgcctccagagaagtgtgatactctgctctgcgacattggggaatcatctcccagtcctaccgttgaggagtcgaggacaatccgcgtgttaaagatggtcgaaccatggctgaaaaataaccagttctgtattaaggtgcttaatccctacatgccggctgtcatcgagcacctggaacggctacagcgaaaacatggaggtatgctcgtgagaaaccctctgagcagaaattccacccacgagatgcactggatatctaacggcactgggaatattgtttcaagcgtaaacatggtgtcccgcttgctgctcaatcggttcacgatgacacatagacgtccaaccatcgagaaggatgtcgaccttggagccggcactaggcacgtgaacgcagaacccgagacccctaatatggacgttatcggtgaacggattaaacgcataaaggaggaacataacagtacatggcactatgatgacgagaacccatacaagacgtgggcctatcatgggtcttacgaggtgaaagctaccggaagcgcgtcatccatgatcaatggcgtcgtgaagctgttaactaaaccctgggatgtagtgccgatggttacacaaatggccatgaccgacactacaccttttggccagcagcgagtcttcaaggaaaaagtggataccagaacacccaggccaatgcctgggactcggaaggtgatggagattaccgcagaatggctgtggcgcacgttgggaagaaacaagaggccccgactctgcacccgggaggaatttaccaagaaggtccgtactaatgctgccatgggtgcagttttcaccgaggagaaccagtgggacagtgccaaagctgccgtggaagatgaggaattttggaagctggtagacagagagcgcgaactacacaaacttggcaagtgtgggagctgcgtgtataatatgatgggaaaaagggagaagaagctgggcgagttcggtaaagcgaaggggtctcgggcaatctggtacatgtggctcggagccagatacctggaatttgaggctttgggcttcctgaacgaagatcactggttttcccgcgaaaattcatatagcggcgtcgagggggaaggactccataaacttggttacattctgagggacatctcgaagataccaggcggggccatgtatgcagatgacacagctggatgggacactcgaatcaccgaggatgacttacacaacgaagagaaaattacgcaacagatggatcccgaacatcggctgttggccaatgctatcttcaagctcacataccagaacaaggtggttaaagtgcagagacctaccccaactggcacagtcatggacattatctctaggaaggatcaacgcggtagtggacaggtgggaacctatggcctgaatacttttaccaacatggaggcccagctagtacgtcagatggagggcgaaggggttctttccaaagcagacctggagaatccgcacctccccgaaaagaaaataacacaatggctggagacgaagggagtggaacggttgaagagaatggcgattagcggtgatgactgcgtcgtgaaacctatcgatgacaggttcgccaacgctttactggccctcaatgatatgggcaaggtgcgcaaagacatcccacagtggcagccctcaaaggggtggcacgattggcagcaagtccctttttgttcccatcacttccatgagcttattatgaaagacggacgaaagctggttgtgccatgccggccccaggacgagctaataggcagagcaaggatctctcagggtgctgggtggagcctgcgcgaaaccgcctgtctcggaaaggcatacgcccaaatgtggagtttgatgtatttccacagacgggatctgaggcttgcgtccaacgctatttgcagcgccgtacctgtgcattgggtcccgacttctcgtacaacctggtcaatccacgcacaccatcagtggatgactacagaggacatgctgaccgtgtggaaccgagtttggattgaagataatccatggatggaggacaaaacgcccgtgacaacctgggaaaaccctccctacctcggcaagcgcgaggatcagtggtgtggcagtatcatagggttatccagcagagccacttgggctcagaatatcccaaccgccattcaacaggtccggtctctgatcggaaacgaggaatttttggactacatgccttcgatgaaaaggttccgcaaggaggaagagtcagagggtgcaatttggtga

SEQ ID NO: 15194 - RNA, 9873 nt, synthetic construct
  misc_feature 1..9873: note = derived and/or modified CDS sequence (opt3) from DENV-3__JQ922555__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagtccatagagggaaaagtggtccagtatgaaaatctgaagtacacagtgattatcactgttcataccggtgaccagcaccaggtgggcaacgagacacaaggggtcaccgcagaaattactccccaggcttctacggccgaggcgatcctccctgaatatggaacacttggcctggagtgcagcccacgaaccggtttggacttcaatgagatgatcctactgactatgaaaaacaaggcctggatggggcatagacagatgctctttgatctgccgaccccctggacatccggcaccactacagaaacgtcagcatggaataggaaagagcctttcgtgacctttaagaacgctcacactaaaaagcaagaagtagttgtgcttggaagtcaggagggcgccatgcacacagctctgaccggggccacagaaattcagaatagcggaggtacttctatattcgcaggccatttgaagtgtcggctcaaaatggacaagctggagttaaaagggatgtcctacgccatgtgcaccaacacgtttgtcctgaagaaagaggtgtcagaaacccagcacggaacaatcctagtcaaggtggagtacaagggcgaagatgctccatgtaaaattcccttcagcactgaggacggtcaagggaaggcgcataacggccgtctcatcaccgcaaatcctgttgtgacaaaaaaggaggaaccagtaaacatagaggccgaacccccgttcggagagagtaatattgtcatcggcatcggggataaagctctgaagattaactggtatcgcaagggatcttccatcggtaaaatgtttgaagccactagcagaggcgcaaggcggatggccattcttggggacaccgcttgggatttcggatcggtgggcggtgttttgaattctctggggaagatggtgcaccagatatttggctccgcctacacggcactcttctcaggagtcagttgggtgatgaaaatcggcattggggtactgcttacatggatcggactgaacagcaagaatacctccatgtcttttagctgcatcgcgattggcataatcactttgtatctcggtgctgtggttcaggccgacatggggtgtgtcattaactggaaaggaaaggagctgaagtgcggctcaggtatcttcgtgacaaatgaggtgcatacctggactgaacagtacaaatttcaagcagatagtcctaagcgattagccaccgctattgccggcgcatgggagaacggggtctgtggaatccgctccacaacgagaatggaaaatctgctatggaaacagatagctaacgagctcaattatatcctgtgggaaaacaatattaagcttaccgttgtggtgggcgacactatcggggtattggagcagggaaaaaggacactgaccccccagccaatggagctcaagtacagctggaaaacatggggcaaggccaagattgtcactgcggaaacccaaaactcttcattcatcatagatggtcctaacacgcccgagtgcccaagtgccagccgggcttggaatgtgtgggaagttgaggactatgggtttggagtgttcacaaccaacatttggctgaaattacgcgaagtctacactcagatctgtgaccacagactgatgtccgcagccgtgaaggatgagagggctgttcacgccgacatgggctactggattgagtctcagaaaaatggttcgtggaagcttgaaaaagcaagcttgatcgaggtgaagacctccacatggcccaagtcacatactctctggagtaacggcgtacaggaatctgatatgataatccctaaaagcctggcggggccaatttcccaacacaattatcgtccgggataccatacccagacagccggcccctggcacctagggaagctggagctcgactttaactattgcgagggaacgaccgtcgtgatcactgaaaattgcggcacacggggtccttcactgcgaaccactacagtgagcgggaaacttattcacgagtggtgttgcagatcttgtaccttgccacccctgaggtacatgggagaagatggctgctggtatggtatggagatccgccctatatccgaaaaggaggagaacatggtcaaaagtttagctagcgccggctctgggaaggttgacaatttcacgatgggagtgctctgtctggcaattctttttgaagaggtaatgcggggcaagttcgggaaaaagcatatgatcgctggagtgctgttcacttttgtcttgctcctgtccggccagatcacctggagagatatggccaggacactaattatgatcggttcaaacgcaagtgaccgcatggggatgggagtgacctacctggccctcattgctactttcaaaatacaaccatttctggcgcttggcttctttttgcgaaagctgacaagccgggaaaatttactcctgggcgttgggcttgccatggcaaccacactgcagctacccgaggatatcgaacagatggctaacggaattgccctcggtctgatggccttgaaactgatcactcagttcgagacctatcaattatggacggctctcgtgtcgctgacatgctccaataccatttttactcttaccgtcgcatggcgtacagccactctgatcttggcgggcgtgtctctcctgccggtttgtcagagctcaagtatgagaaagaccgactggctacctatgacggtggctgccatgggggtcccacccctgcctcttttcatattttccctcaaggatacactgaaaaggcgctcttggcccttgaacgagggagtaatggcagtgggcctggttagcatcttagcctcctcactcctgcggaatggtgtgccaatggctgggcctcttgtcgcaggaggcctgttgattgcctgctacgtgatcaccggcactagcgcggacctcacagtagaaaaggctgccgatgtgacctgggaggaagaggcagaacagactggggtcagtcacaacctgatgattacagttgacgacgatggaaccatgagaatcaaagacgatgagacggagaacatactaactgtgctgcttaagaccgccctcctgattgtgtctggtatcttcccctactccatcccagctacattgttagtctggcatacctggcagaaacaaacacagaggagcggcgtgctgtgggacgttccgtcgcctcccgaaactcagaaggccgagctcgaagagggggtatatcgaattaaacagcaaggaatatttggcaagacccaggtgggtgtcggggtgcagaaggagggagttttccacacgatgtggcatgtgacacgcggcgcagtcctgactcacaatggcaaacggcttgaaccaaactgggcttcagtgaagaaagatctgatctcttacgggggaggttggagattgagtgcccaatggcagaagggcgaggaagtacaggtcattgcggtggagcccgggaaaaatcctaagaactttcagaccatgccaggaacattccaaaccacttccggcgaaatcggtgccattgcactagacttcaagcccgggaccagcggatctcctatcataaatagggagggcaaagttgtgggcctgtatgggaacggagtcgtgacaaagaatggtggctacgttagcgggatcgctcagacgaacgccgagccggatggaccaactcccgaactcgaggaagagatgtttaaaaagcgtaatctgaccattatggaccttcaccctggctccggtaaaacacgcaagtatttaccagctatcgtgcgggaagcaattaagagaaggctgcgaaccctcatcttggcccccactcgggtcgtggccgctgagatggaggaagcgctgaaagggctccctatacgctaccagacaaccgcaacgaagtcagagcatactggaagagaaattgtagatctgatgtgtcacgccacattcaccatgaggcttctgagtccggtgcgggttcccaactataatttgatcatcatggacgaggctcattttaccgatccagccagcattgcagcccgaggctacatctctactagagtcggcatgggggaagctgcggccatattcatgacagcaacccctcccggaacagctgacgcctttccacagtccaacgcacctattcaagatgaggagcgcgacatccccgaaaggtcatggaatagtggtaacgagtggattactgacttcgccggcaaaacggtgtggtttgtgccaagcatcaaggctgggaatgatatagccaactgcctacgtaaaaacggaaagaaggtcattcagctgtcccggaaaaccttcgacacagaataccagaagactaaactcaatgattgggactttgtagtgaccacagatatctctgagatgggcgcgaacttcaaggcagacagagttatcgatccgaggcgctgtttaaaacctgtgattctgaccgacggtcccgagcgagtcatccttgccgggccaatgcccgtgactgctgcctcggctgcacagagacggggcagggttggacgcaatcctcaaaaggaaaacgatcagtatatttttacgggccagccactgaataacgacgaggatcacgcccattggaccgacgctaagatgctcttggaaaatataaacacacccgaggggatcattcctgccctgttcgaaccggagcgtgagaaaagcgcaggactcgacggtgaatacagactgaagggcgagtcacggaaaactttcgtggaacttatgaggcgcggggatctaccagtctggctggcgcacaaggtggcctccgagggaatcttgtataccgaccgaaaatggtgctttgatggccagagaaataaccaaatcttagaagagaatatggacgtagagatttggacaaaggaaggtgagaaaaagaagctgcggcccaggtggctcgatgctcgcacctacagtgaccctctggcccttaaagaattcaaggattttgcagctgggagaaaatctatagccctggacctcgtgactgagatcggcagggttagctcccacttggcacatcggacacgtaacgccctggataataagatgatgctacacacgtcagaatatggaggccgcgcttaccgacatgcggtcgaggagctgcccgaaaccatggagactctccttctgttagggttgatgattctgctcacaggaggtgccatgctgttccttatctctggcaaagggattggaaagaccagcatcggcctgatatgcgtgatcgcaagttccggtatgctctggatggctgacgtgccattgcagtggattgccagcgccatcgtcctggaatttttcatgatggttttactaattcctgagcccgagaagcagagaaccccacaagataaccagctggcatatgtggtaatcgggatactcacacttgctgccattatcgcggctaatgaaatgggcctgttggagactacgaaaagggacctgggagtgtctaaggaacctggcgtcgtgtcaccgacctcctacctcgatgttgacctgcaccccgccagtgcatggacactttacgccgtggctactaccgtcattgcaccaatgctccggcacacaatcgagaacagcaccgccaatgtatcgatggcggctatagccaaccaggcagtggttctgatggggttggacaaaggatggcctatctctaagatggatctgggcgtgcccttactagccctgggttgttatttttacgtcaacccactcactcttacggctgccgtgttcctgttggtcacacattatgcaattatcgggcctggactgcaggctaaagccacccgcgaagcgcacaagaagactgccgcaggcattatgaatcccccgccaggtgacggcatcatgaccatagatctcgaccctgtgatttacgattccaaatttgagaagcaactggggcaggttatgcttttagtgctgtgcgctgtacagctcttgctgatgagaacaagctgggccctatgtgaggcactgactctcgctaccggacccacaacgaccctttgggaaggctcaccagggaaattctggaacactacaatcgccgtgagtatggccaatatctttaggggatcttatctggcgggcgctggtttggcattctccattatgaagagcgtcgggaccggaaaacggggcactggttcacagggcgagacactgggggaaaagtggaagaaaaagctcaaccaactgagtcgaaaagagtttgacttatacaagaaaagcggaatcaccgaagttgatagaacggaggccaaggagggccttaaacgcggggaaataacccatcacgctgtgtccaggggatctgccaagctgcagtggttcgtcgagcggaatatggtgattcccgaaggccgtgtaatcgacctcggttgcgggaagggaggctggagctattactgtgcaggcctaaaaaaggtgacagaggttagagggtacactaaaggaggtcctggccatgaagagccggtgcccatgtccacctatgggtggaacattgtcaagctgatgtcaggaaaagatgtgttctacttgccacctgagaagtgcgacacactgctctgtgatatcggcgaatctagtccctcgcctactgtcgaggaaagcaggaccatacgcgtgcttaagatggttgagccatggctgaaaaataaccagttttgcatcaaggtattgaatccctatatgcctacagtgattgagcacctggaacggctccagcgaaaacacggtgggatgttagtcagaaacccactgtccaggaattctcgcaacgagatgtactggatctcaaatggaaccggcaacattgtgagctccgttaatatggtgagtcggcttctgctaaacagattcactatgacgcatcgtaggcccacaatcgaaaaggacgtcgatctcggcgccgggacccggcacgtgaacgctgagccggaaactcctaatatggacgtaattggagagcgcatcaaacgaataaaggaggaacataactctacctggcactatgacgatgagaatccatacaagacatgggcgtatcacggtagctacgaagtgaaagccacgggctcagcatccagtatgattaacggggttgtcaagctgttgaccaaaccctgggacgtggtgcctatggtcactcaaatggctatgacagataccactccatttggacagcagagagttttcaaggagaaagtggacacaaggaccccccggctgatgccgcgcacaagaaaggtaatggaaatcactgccgagtggctctggaggacccttggccgaaataagcggcctcgtctgtgtacgagagaggaatttaccaaaaaggtgcgccccatcgcagccatgggtgctgtcttcacacaaagggatcagtgggacagcgccaaagcggcagtggaggatgaagagttttggaagccagttgaccgggaatgcaactctcatcagttagggaaatgtggatcctgcgtgtacaatatgatgggcaagagagagaaaaagctgggcgagttcgggaaggccaaaggatcacgcgctatttggtatatgtggttgggtgccaggtacctcgaatttgaggcactgggcttcctaaacgaagatcactggtttagccgagagaattcgtattctggggtcgagggagaaggccttcataagctgggttacatactccgggacatcagtaaaattcctgggggagctatgtatgccgatgacactgctggctgggacaccagaaacacagaggatgacctgcacatgaaggaaaaaatcactcagcaaatgggccccgggcattccaggttggccaatgcaattttcaagctgacctaccagaacaaggtggtaaaagttcagcgcccaacgcccacaggaaccgtgatggatatcataagccgtaaggaccagcggggttcaggccaagtcgggacttatggactcaatacatttaccaacatggaggcgcagcttgtgagacagatggaaggcgagggtgtgctgtccaaagccgatttagagaatcctcacctgttggaaaagaaaatcactcagtggctcgagaccaagggggtcgaaaggctgaagcgcatggctatttctggagacgattgcgttgtgaaaccaatcgacgatcgattcgccaacgcactacttgctctgaacgacatgggcaaggtacggaaagatattccgcaatggcagcccagcaagggctggcacgactggcagcaggtgcctttctgtagtcatcactttcatgagctcatcatgaaagatgggagaaagctggtcgtgccatgcaggccccaagacgaattgataggacgcgccagaatttcccagggtgcaggctggagcttacgggagacagcctgtctggggaaggcgtacgctcagatgtggtctctcatgtacttccacaggcgtgaccttcgactggcctcaaatgcaatctgcagtgccgttcctgtgcactgggtcccaacgtcccgcaccacttggagcatccatgctcaccatcaatggatgacaaccgaggatatgctaactgtgtggaacagagtatggattgaagacaatccctggatggaggataaaacacctgttaccacgtgggaaaacgtgccgtatctgggaaagcgggaggaccagtggtgtggctctctcataggtttgacatcgagggccacctgggcacagaatatcccaactgctattcagcaagtccgctcactgatcgggaacgaagagtttcttgattacatgcccagcatgaaaagattccggaaggaggaagagtccgaaggagccatttggtga

SEQ ID NO: 15195 - RNA, 9873 nt, synthetic construct
  misc_feature 1..9873: note = derived and/or modified CDS sequence (opt3) from DENV-3__GU131903__SS-prME
  source 1..9873: mol_type = other RNA
accagcctgtgcctcatgatgatgcttccagccacactggctttccacttgacttccagagacggagaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagcacgaaaacctcaagtatactgtcataattaccgtgcatacaggtgaccagcaccaggttggcaatgacacccaaggggtgactgtcgagatcacgcctcaggcatctacagtggaagctgtacttccagagtacggaaccctgggcttggaatgcagcccgcgaactggtctagatttcaacgagatgattctgctcaccatgaaaaataaggcctggatggttcatagacagtggtttttcgacctgccccttccttggacatccggggcgaccactgagacaccaacgtggaacaggaaagaactgttggtgacctttaagaatgcccacgccaagaagcaagaggtcgtggtcctcggctcacaggaaggagctatgcacactgccctgacaggcgctaccgagatccagaacagtgggggaacaagcatcttcgccggtcatttaaagtgtcggctgaaaatggataagctagaactcaaaggcatgtcttatgcaatgtgcctgaatacttttgtgcttaagaaagaggtttccgagacccagcacgggacgattttgataaaggtggaatacaagggagaggacgccccctgtaaaatccctttctcaaccgaagatggccaaggtaaggctcatagcgggcgtctgattacagcgaacccagtagtcactaaaaaggaggagcccgtgaacatcgaagcagagccgcctttcggcgaaagtaatatagttattggaatcggcgacaaagccctcaagatcaactggtacaagaaagggtcttccattggaaagatgtttgaggctaccgcccgcggtgcaagaaggatggccatcctgggcgatacagcttgggacttcgggagcgtgggaggcgtccttaattcgctgggtaaaatggtgcaccagatttttgggtctgcctatactgcattgttctccggcgtatcatggataatgaagatcggaattggcgtgctcctgacctggatcgggttaaacagtaaaaatacgagcatgtccttttcttgcatcgttattggaataatcacactgtacctaggcgcggtcgtgcaggctgatatgggttgtgtgattaactggaaggggaaggaactcaaatgcggaagcggcatcttcgtcaccaatgaggttcatacttggacagagcagtataagtttcaagccgactcacccaaacggctggcaaccgccattgctggtgcctgggaaaacggcgtgtgtgggatccgaagtactacccgcatggagaatcttttgtggaagcagatagcaaacgaactgaattacatcctctgggagaacaatattaaactgacagtggtagtcggagatatcattggcgtgttagaacaggggaagagaacgctgaccccacagcctatggagcttaaatattcctggaagacttggggaaaggctaaaatcgttacagccgagacccaaaacagctctttcataattgacggccccaatacaccagaatgccccaacgcgtcaagggcctggaacgtgtgggaggtcgaagactacggttttggggtgttcactaccaatatctggttgaagctccgggaggtttatacgcagagttgtgatcaccgcctgatgagcgctgcaattaaagacgaaagagccgtgcacgctgatatgggatactggatcgagtcccagaagaacggctcttggaaactagagaaggcctcgtttatagaagtaaagacatgcacctggcctaaaagccatactctgtggtccaatggtgtcctcgagtcagacatgatcattccaaagagtctggcaggcccgatctctcagcacaaccataggcccgggtaccacacccaaacagcgggaccttggcaccttggcaaattggaactggatttcaattattgcgaggggactaccgtggtgattacagagaactgtggaacgcgtggccccagcttacggaccactacagtctccggtaagctcatccatgaatggtgctgtcgatcatgcaccctgccccctcttagatacatgggggaggacggatgttggtatggcatggaaataaggccaattaatgagaaagaagagaacatggttaagagcctggtgtctgccggttccggcaaggtagataattttactatgggggtgttgtgcctcgctatcctgttcgaggaagtcatgcgcggaaaattcggcaagaaacacatgatcgccggggtgctatttacattcgttctgctcctgagtggacagattacctggcgggacatggcacatacgcttatcatgattggcagcaacgcttctgatagaatgggtatgggggtgacttacttggccctgatagcaacctttaagatccagcccttcttagccctcggatttttcctgaggaaacttacatcccgcgagaatctgctactcggcgtcggcctggctatggcgaccactttgcaactgccggaagacattgagcagatggccaacgggatcgcattaggactcatgacactgaaacttattacccagtttgaaacatatcagctgtggactgctttggtgtcactcacctgtagtaatacgatcttcacactgaccgttgcctggcgaactgccaccctaatactggctggtgtgagccttctccctctgtgccaatcgtcctctatgcggaagacagattggttgccaatgactgtcgcagccatgggcgtaccccctctgcccttatttatcttcagcctcaaagacaccccaaagcgtagatcatggcctctgaacgagggggtgatggcggttggacttgtgagtattctggcttcctctttgctcaggaatgatgtccccatggccggcccactggtggcgggtgggctactgatcgcctgttacgtaattacgggaacaagcgctgaccttaccgtggagaaagcagccgacgtcacttgggaagaggaagcggagcagacaggcgtttcccacaacctcatgatcaccgtggatgacgatggcactatgcgcataaaggacgatgaaacagagaacattctgaccgtgttgttaaaaacggctctgctcatcgtctcagggatctttccgtatagcattcctgccactctgcttgtgtggcatacctggcagaagcagacacaacggagtggagttctgtgggacgtaccctctccacccgagacccagaaagcagaattggaggaaggtgtgtacagaataaagcagcagggcatcttcgggaagacacaagtcggagtgggcgttcagaaagagggtgtgtttcacactatgtggcacgtcacccgaggggcagtgctaacgcataatggaaagaggctggagcctaactgggcttccgtcaaaaaggatctcattagctacggcggcgggtggcgcctgaatgcccagtggcaaaaaggagaagaggtccaggtgatcgcagttgaaccaggtaagaaccccaagaatttccagacaatgcctggcattttccagactaccacaggggagatcggagctatagcccttgactttaaaccgggcacctcgggttcaccaatcattaaccgggaagggaaggtggtcggattatatggcaatggcgtggttactaaaaacgggggatacgtgtctggtatcgcgcaaaccaatgccgagcccgatggccctacaccagagctggaagaggaaatgttcaagaaaagaaacctcacgattatggacttgcaccccgggagtggaaagactaggaagtatctgcctgcaatcgtccgtgaggctataaaacgccggctcagaaccctgattcttgccccgacaagggtggtagctgcagaaatggaggaggccctgaagggcttgcccatccgataccagaccactgccacaaaatccgaacataccggtcgggagatcgtggatctaatgtgccacgctacgtttactatgcgcctgctcagcccagttagagtccctaattataacttagtgattatggacgaagcgcatttcacagatcccgcatctatcgccgctagggggtacataagcacccgggtgggaatgggcgaggccgcagccatttttatgaccgctactccacctggcacagcggaagccttcccccagtccaatgcaccaatccaggacgaggagcgagacattccggaaagatcatggaacagtgggaatgagtggatcaccgattttgtcggaaagacagtatggttcgtgcctagcataaaagctggtaacgacattgccaactgtctgcgcaagaatggcaagaaagttatccaactttctaggaagacttttgatacggaatatcagaaaacccgtctgaacgactgggatttcgtggtcacaactgacatctccgagatgggggcaaattttaaggccgatcgggtgattgaccccagaaggtgcctcaaaccagttatcttgaccgatggacccgagcgcgtgattctggctggccctatgccagtcacagccgcgtcagcagcccagcgaagaggtcgggtggggaggaacccccagaaggaaaatgaccaatacatattcaccggccagcctctcaacaatgatgaggaccacgctcactggactgaagccaagatgctgcttgacaacatcaatacgccggagggaattatcccagctctattcgaacccgagcgcgagaaaagtgcagccatcgatggcgaataccgtctgaagggggagagcagaaaaacctttgtagaattgatgcggaggggagacttacctgtgtggctggctcataaggttgcctccgagggtattaaatatacagatcgcaagtggtgcttcgacggcgaacgaaacaatcagatactcgaggagaacatggatgtcgaaatctggactaaagagggggaaagaaagaagctgcggcccaggtggcttgacgcacgcacctactctgatccactggcgctcaaagagtttaaggacttcgccgctggaagaaaatcgattgccttggatctggtgacagaaatcggcagggtgcctagccacctagcacatcggacccgtaatgctctggacaacctcgtcatgcttcacacttcagagcacggtgggcgcgcctatcgacatgcagttgaggaactgcccgagacaatggaaacgttattgctgctcggcctgatgattcttctgaccggaggcgccatgctctttttgatctccgggaagggaataggtaaaacaagtatcggcctgatttgtgtgatcgtatctagcgggatgttatggatggctgatgtgccactacagtggattgcgtccgccatcgtcctggagttctttatgatggtgctccttatacctgagccggaaaagcaaagaacaccccaggacaatcagctggcatacgttgtgattggaatcttgaccctggctgccattgtcgccgcaaacgagatgggcctcctggaaaccacaaagagggatcttggtatgtcaaaagagccaggggtagtgtctcctactagctatctcgacgttgacctgcaccccgctagtgcctggacgttgtacgcggtggctaccacagtcatcactccaatgctgcggcataccatagaaaattccacagccaacgtgagcttagcagccatcgctaaccaagcagtcgtgctaatgggcctggataagggatggcctatttctaaaatggacctcggcgttccccttctggccttggggtgctattcacaggtgaatccgctgaccctcactgcggctgtactgcttttagtgacgcactacgccatcattggaccaggcctgcaggcaaaggccacacgcgaggctcagaaaagaaccgccgcaggtatcatgaagaaccctactgtcgatgggataatgaccattgacctcgatcccgttatctacgactccaagttcgagaaacaattgggacaggtgatgctgctagtcctgtgtgctgtgcagctccttctgatgaggacaagttgggccttgtgcgaagcgctgactctcgccaccggcccaatcacaacgctgtgggagggtagccccggcaagttttggaataccactattgcagtatcgatggctaacatcttccgggggtcttatttagccggagcaggccttgctttttccataatgaaaagcgtggggacaggacgaagaggcaccggttcacagggggaaactctgggagagaagtggaaaaagaagctcaatcaactaagtcgcaaagagttcgatctgtacaagaaatctggcattacagaggttgacaggaccgaggccaaggaaggtttgaaacggggcgagacgacccatcacgccgtgtcccgtgggagcgcgaagctgcagtggtttgtcgaaagaaacatggtgatccctgagggaagggtcattgatctcggctgtgggcgcggaggctggtcatattactgcgctggtcttaaaaaggtgacagaagttcgggggtatactaaggcaggaccgggccacgaggagcccgtaccaatgagtacctacggctggaatatcgtgaaactgatgagcgggaaggacgtcttctatttgcctcccgaaaaatgtgatacactgctctgcgacataggagagtcctctcctagcccaactgtggaagagtcccgaaccatcagagttttaaagatggtggagccctggctgaggaacaatcagttctgtattaaagtccttaacccttacatggccacaggtatcgaacatctggagcgcctacagcggaagtacggcgggatgctcgtgagaaatccactgtcacgtaactctacccacgaaatggattggattagtaatggaactggcaacatcgtatcgagcgtgaatatggtttccaggttgctgctcaaccggtttacgatgacacatcgccgacccaccattgagaaggacgtcgaccttggtgctgggactagacacgtgaacgccgaaccggagacccctaatatggatgtgatcggagagaggataaaacggattaaggaagaacactcttcaacatggcattatgacgatgaaaacccatacaaaacgtgggcatatcacggcagctacgaggtcaaggccaccggctccgctagttctatgatcaatggggttgtgaaactgttaactaagccctgggacgtagtgcctatggtcacacaaatggcgatgaccgatactacaccattcggacagcagcgcgtgtttaaggaaaaagttgacaccagaacacccaggccgatgcctggtactcgaaaggtgatggagatcaccgccgagtggctgtggcggacgttgggccgtaacaaaaagcccagactctgcacccgcgaagagttcactaaaaaggtcaggactaatgcagctatgggggccgtgtttaccgaagagaaccaatgggatagcgcacgggccgctgtagaagacgaggagttctggaagctggttgatagagaacgcgagctacataaacttggaaagtgtggctcatgcgtgtataatatgatgggtaaaagggaaaagaaactgggggagtttggaaaggccaaaggctcccgagcgatttggtacatgtggctcggcgcacggtatctggagttcgaagccttggggtttctgaacgaggaccactggttcagtagagaaaatagctactctggagtcgagggtgaaggcctccataaacttgggtacatactgagggatatctccaagattccaggaggcgctatgtatgccgacgacacagcaggttgggatactcgcatcaccgaggacgatttacacaacgaggagaagattacgcagcagatggaccctgagcaccgtcagctggctaatgccatctttaagttgacataccaaaacaaagtggtgaaggtccagcggcccaccccaaaagggactgttatggatataatctcaagaaaggaccagaggggaagcggccaggtgggcacatatgggctcaataccttcactaacatggaagctcaactggtacgccagatggagggagaaggtgtgctatcgaaggccgatcttgagaatccccatctgctcgagaaaaagattacccagtggctggaaacaaaaggcgtcgagcgattgaagcggatggcaatctctggggacgattgcgtggttaaacctattgacgatagatttgcgaacgccttactggctctcaacgacatgggaaaggtgaggaaggatatcccacagtggcaaccgagtaaaggctggcacgactggcagcaggtccccttctgttcccatcacttccacgaacttataatgaaggacggtcgcaaactggtggtaccttgcagaccacaggatgagctaattgggcgggccaggatcagccaaggagcaggctggtcactgaaggaaacggcttgtctcggcaaagcctacgcacagatgtggtccttgatgtattttcatcgtcgagacctgcgccttgcctctaatgcgatctgcagcgctgttcccgtgcactggattcctaccagtagaactacatggtccatacatgcccaccatcagtggatgaccactgaggatatgctgacagtctggaaccgggtgtggatcgaggacaatccatggatggaagataagacccccgttacgacatgggaggacgtgccttacctcgggaagagggaagatcaatggtgtggcagcttaattggtctgacctctcgcgcaacttgggcccagaacatcttgaccgctattcagcaggtcagatcactgatcggcgacgaggagttcctcgattatatgccgagtatgaaacggtttaggaaggaagaggaatccgagggggccatatggtga

SEQ ID NO: 15196 - RNA, 9873 nt, synthetic construct
  misc_feature 1..9873: note = derived and/or modified CDS sequence (opt3) from DENV-3__GU131904__SS-prME
  source 1..9873: mol_type = other RNA
accagcctgtgcctcatgatgatgcttcccgccactctggctttccacttgacttccagagacggcgaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaatagtaaaaacacgtcaatgagcttttcctgcatcgttattggaataatcacactgtatctaggcgcggtcgtgcaggctgatatgggttgtgtgattaattggaaggggaaggaactcaaatgcggatctggcatcttcgtcaccaacgaggttcacacttggacagagcagtacaagtttcaagccgacagccccaaacggctggcaaccgccattgctggtgcctgggaaaatggcgtgtgtgggatccgatcaactacccgcatggagaaccttttgtggaagcagatagcaaatgaactgaactatatcctctgggagaatagtattaaactgacagtggtagtcggagatatcattggcgtgttagaacaggggaagagaacgctgaccccacagcctatggagcttaaatactcctggaagacttggggaaaggctaaaatcgttacagccgagacccaaaacagctctttcataattgacggccccaatacaccagaatgcccctcagcgagtagggcctggaacgtgtgggaggtcgaagactatggttttggggtgttcactaccaacatctggttgaagctccgggaggtttacacgcagagctgtgatcatcgcctgatgtccgctgcaattaaagacgaaagagccgtgcacgctgatatgggatactggatcgagtctcagaagaatggctcgtggaaactagagaaggccagctttatagaagtaaagacatgcacctggcctaaatcccacactctgtggtcaaacggtgtcctcgagagtgacatgatcattccaaagtctctggcaggcccgatcagccagcataatcacaggcccgggtatcatacccaaacagcgggaccttggcaccttggcaaattggaactggatttcaactactgcgaggggactaccgtggtgattacagagaattgtggaacgcgtggcccatccttacggaccactacagtctcaggtaagctcatccacgaatggtgctgtcgaagctgcaccctgccccctcttagatatatgggggaggacggatgttggtacggcatggaaataaggccaattaacgagaaagaagagaatatggttaagtctctggtgtccgccggtagtggcaaggtagataactttactatgggggtgttgtgcctcgctatcctgttcgaggaagtcatgcgcggaaaattcggcaagaaacatatgatcgccggggtgctatttacattcgttctgctcctgagcggacagattacctggcgggacatggcacacacgcttatcatgattggctctaatgcttccgatagaatgggtatgggggtgacttatttggccctgatagcaacctttaagatccagcccttcttagccctcggatttttcctgaggaaacttacatcacgcgagaacctgctactcggcgtcggcctggctatggcgaccactttgcaactgccggaagacattgagcagatggccaatgggatcgcattaggactcatgacactgaaacttattacccagtttgaaacataccagctgtggactgctttggtgagtctcacctgtagcaacacgatcttcacactgaccgttgcctggcgaactgccaccctaatactggctggtgtgtcgcttctccctctgtgccaatcctctagcatgcggaagacagattggttgccaatgactgtcgcagccatgggcgtaccccctctgcccttatttatcttctcactcaaagacaccccaaagcgtagaagttggcctctgaatgagggggtgatggcggttggacttgtgtccattctggcttctagcttgctcaggaacgatgtccccatggccggcccactggtggcgggtgggctactgatcgcctgttatgtaattacgggaacatccgctgaccttaccgtggagaaagcagccgacgtcacttgggaagaggaagcggagcagacaggcgtttcacataatctcatgatcaccgtggatgacgatggcactatgcgcataaaggacgatgaaacagagaacattctgaccgtgttgttaaaaacggctctgctcatcgtcagcgggatctttccgtacagtattcctgccactctgcttgtgtggcacacctggcagaagcagacacaacggtctggagttctgtgggacgtaccctccccacccgagacccagaaagcagaattggaggaaggtgtgtacagaataaagcagcagggcatcttcgggaagacacaagtcggagtgggcgttcagaaagagggtgtgtttcatactatgtggcacgtcacccgaggggcagtgctaacgcacaacggaaagaggctggagcctaattgggctagcgtcaagaaggatctcatttcgtatggcggcgggtggcgcctgtcagcccagtggcaaaaaggagaagaggtccaggtgatcgcagttgaaccaggtaagaaccccaagaatttccagacaatgcctggcattttccagactaccacaggggagatcggagctatagcccttgactttaaaccgggcacctctggtagtccaatcattaaccgggaagggaaggtggtcggattatacggcaatggcgtggttactaaaaacgggggatatgtgtccggtatcgcgcaaaccaatgccgagcccgatggccctacaccagagctggaagaggaaatgttcaagaaaagaaacctcacgattatggacttgcatcccgggagcggaaagactaggaagtacctgcctgcaatcgtccgtgaggctataaaacgccggctcagaaccctgattcttgccccgacaagggtggtagctgcagaaatggaggaggccctgaagggcttgcccatccgatatcagaccactgccacaaaatctgaacacaccggtcgggagatcgtggatctaatgtgccatgctacgtttactatgcgcctgctcagcccagttagagtccctaattacaacttagtgattatggacgaagcgcacttcacagatcccgcatccatcgccgctagggggtatatatcaacccgggtgggaatgggcgaggccgcagccatttttatgaccgctactccacctggcacagcggaagccttcccccagagtaatgcaccaatccaggacgaggagcgagacattccggaaagaagctggaactctgggaatgagtggatcaccgattttgtcggaaagacagtatggttcgtgccttccataaaagctggtaacgacattgccaattgtctgcgcaagaacggcaagaaagttatccaactttcaaggaagacttttgatacggaataccagaaaacccgtctgaacgactgggatttcgtggtcacaactgacatcagtgagatgggggcaaattttaaggccgatcgggtgattgaccccagaaggtgcctcaaaccagttatcttgaccgatggacccgagcgcgtgattctggctggccctatgccagtcacagccgcgagcgcagcccagcgaagaggtcgggtggggaggaacccccagaaggaaaatgaccaatacatattcaccggccagcctctcaacaatgatgaggaccatgctcactggactgaagccaagatgctgcttgacaacatcaatacgccggagggaattatcccagctctattcgaacccgagcgcgagaaatccgcagccatcgatggcgaatatcgtctgaagggggagtctagaaaaacctttgtagaattgatgcggaggggagacttacctgtgtggctggctcacaaggttgcctcggagggtattaaatacacagatcgcaagtggtgcttcgacggcgaacgaaacaatcagatactcgaggagaacatggatgtcgaaatctggactaaagagggggaaagaaagaagctgcggcccaggtggcttgacgcacgcacctatagcgatccactggcgctcaaagagtttaaggacttcgccgctggaagaaaatcaattgccttggatctggtgacagaaatcggcagggtgccttcccatctagcacaccggacccgtaatgctctggacaacctcgtcatgcttcatacaagtgagcacggtgggcgcgcctaccgacacgcagttgaggaactgcccgagacaatggaaacgttattgctgctcggcctgatgattcttctgaccggaggcgccatgctctttttgatctctgggaagggaataggtaaaactagcatcggcctgatttgtgtgatcgcttcctcagggatgttatggatggcggatgtaccactacagtggattgcctctgcaatcgtgctggagttctttatgatggtcctccttatacctgagccggaaaagcaaagaacaccccaggacaatcagctggcttatgtggttattggaatcttgaccctggccgccattgtggcagctaacgagatgggcctcctggaaaccacaaagagggatcttggtatgagcaaagagccaggggtcgtaagtcctacttcctacctcgacgtggacctgcatcccgccagcgcgtggacgttgtatgctgttgccaccacagtgatcactccaatgctgcggcacaccatagaaaattctacagcaaacgtctcattagccgctatcgcaaatcaagccgtggtcctaatgggcctggataagggatggcctatttccaaaatggacctcggcgtgccccttctggcgttggggtgctacagtcaggttaacccgctgaccctcactgctgccgtgctgcttttagtaacgcattacgcaatcattggaccaggcctgcaggccaaggctacacgcgaggcccagaaaagaaccgcagctggtatcatgaagaaccctactgtggatgggataatgaccattgacctcgatcccgtcatctatgacagcaagttcgagaaacaattgggacaggttatgctgctagtgctgtgtgccgtccagctccttctgatgaggacatcgtgggcgttgtgcgaagccctgactctcgcaaccggcccaatcacaacgctgtgggagggttctcccggcaagttttggaataccactattgctgtgtccatggccaacatcttccgggggagctacttagcaggagctggccttgccttttcaataatgaaaagtgtagggacaggacgaagaggcaccggttctcagggggaaactctgggagagaagtggaaaaagaagctcaatcaactatcccgcaaagagttcgatctgtataagaaaagcggcattacagaggtggacaggaccgaggccaaggaaggtttgaaacggggcgagacgacccaccatgcggtttcacgtgggagtgctaagctgcagtggtttgtggaaagaaacatggtcatccctgagggaagggtgattgatctcggctgtgggcgcggaggctggagctactattgcgcaggtcttcggaaagtcacagaagtgcgagggtacactaagggaggcccgggccacgaggagcccgttccaatgtccacctatgggtggaatatcgtaaagctgatgtctggaaaagacgtgttctacttgcctcccgaaaagtgtgatacactgctctgcgacataggtgagagctccccttcaccaactgtcgaagagtctagaaccatcagggtgttaaaaatggttgagccctggctgcgcaacaatcagttctgtattaaggtgcttaacccttacatgccaacagtcatcgaacacctggagcggctacagagaaaatatggcgggatgctcgtgcgtaatcccctgagtaggaactcgacccatgaaatgtactggattagcaatggaactggcaacatcgtatcctctgtgaatatggtttcacggttgctgctcaaccgctttacgatgacacaccgaagaccgaccattgagaaggatgtcgaccttggtgccgggactaggcatgtgaatgctgaacctgagaccccaaacatggacgtgatcggagagcggataaagcgcattaaagaagaacacagctccacatggcactatgatgacgaaaacccctacaagacgtgggcctatcatggcagttacgaggtcaaagcaaccggctctgccagctcaatgatcaatggggttgtgaagctgttaactaaaccttgggatgtagtgccaatggtcacacaaatggctatgaccgacactacacccttcggacagcagagagtgtttaaggaaaaggttgataccaggacaccgcgacctatggcgggtactcggaaagtgatggagatcaccgccgagtggctgtggcgtacgttgggcagaaacaagaaaccccgcctctgcaccagggaagagttcacaaagaaagtccggactaatgcagctatgggggccgtgtttaccgaagagaaccaatgggactccgcaagagccgctgtagaagatgaggagttctggaagctggttgaccgcgaaagggagctacacaaacttggaaaatgtggcagttgcgtgtataatatgatgggtaagcgagagaaaaagctgggggagtttggaaaagccaagggcagccgggcgatttggtacatgtggctcggcgcaagatacctggagttcgaagccttggggtttctgaacgaggatcattggttctctagggaaaattcctattcaggagtcgagggtgaaggcctccacaaacttgggtacatactgcgcgacatcagcaagattccaggaggcgctatgtatgccgatgacacagcaggttgggacactcgtatcaccgaggatgacttacataacgaggaaaagattacgcagcagatggatcctgagcaccggcagctggctaatgccatctttaaattgacataccaaaacaaggtggtgaaagtccagagacccaccccaaaggggactgttatggacataatctcgaggaaagatcagcgcggatctggccaggtgggcacatatgggctcaataccttcactaacatggaagctcaactggtacgacagatggagggagaaggtgtgctaagtaaggccgaccttgagaatccccatctgctcgagaagaaaattacccagtggctggaaacaaagggcgtcgagcggttgaaaagaatggcaatctccggggatgactgcgtggttaagcctattgatgacaggtttgcgaacgccttactggctctcaatgatatgggaaaagtgcgcaaggacatcccacagtggcaaccgagcaagggctggcatgattggcagcaggtccccttctgttcacaccatttccacgaacttataatgaaagacggtagaaagctggtggtaccttgccggccacaggacgagctaattgggagggcccgtatctcccaaggagcaggctggtctctgaaagaaacggcttgtctcggcaaggcctacgcacagatgtggagcttgatgtattttcaccgacgcgatctgagacttgccagtaacgcgatctgctccgctgttcccgtgcattggattcctaccagccggactacatggtctatacacgcccatcaccagtggatgaccactgaggacatgctgacagtctggaacagggtgtggatcgaggataatccatggatggaagacaaaacccccgttacgacatgggaggatgtgccttacctcgggaagcgcgaagaccaatggtgtggatcattaattggtctgaccagtagagcaacttgggcccagaacatcttgaccgctattcagcaggtccggtccctgatcggcgatgaggagttcctcgactacatgccgagcatgaagaggtttcgaaaagaagaggaatctgagggggccatatggtga

SEQ ID NO: 15197 - RNA, 9873 nt, synthetic construct
  misc_feature 1..9873: note = derived and/or modified CDS sequence (opt3) from DENV-3__GU131906__SS-prME
  source 1..9873: mol_type = other RNA
accagcctgtgcctcatgatgatgcttccagcaactctggctttccacttgacttccagggacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaatagtaaaaacacgtcaatgagcttttcctgcatcgttattggaataatcacactgtatctaggcgcggtcgtgcaggctgatatgggttgtgtgattaattggaaggggaaggaactcaaatgcggatctggcatcttcgtcaccaacgaggttcacacttggacagagcagtacaagtttcaagccgacagccccaaacggctggcaaccgccattgctggtgcctgggaaaatggcgtgtgtgggatccgatcaactacccgcatggagaaccttttgtggaagcagatagcaaatgaactgaactatatcctctgggagaataacattaaactgacagtggtagtcggagatatcattggcgtgttagaacaggggaagagaacgctgaccccacagcctatggagcttaaatacagttggaagacttggggaaaggctaaaatcgttacagccgagacccaaaattccagcttcataattgacggccccaacacaccagaatgcccctctgcgtcaagggcctggaacgtgtgggaggtcgaagactatggttttggggtgttcactaccaatatctggttgaagctccgggaggtttacacgcagagttgtgatcatcgcctgatgagcgctgcaattaaagacgaaagagccgtgcacgctgatatgggatactggatcgagtcccagaagaacggctcttggaaactagagaaggcctcgtttatagaagtaaagacatgcacctggcctaaaagccacactctgtggtccaatggtgtcctcgagtcagacatgatcattccaaagagtctggcaggcccgatctctcagcataaccacaggcccgggtatcatacccaaacagcgggaccttggcaccttggcaaattggaactggatttcaattactgcgaggggactaccgtggtgattacagagaactgtggaacgcgtggccccagcttacggaccactacagtctccggtaagctcatccacgaatggtgctgtcgatcatgcaccctgccccctcttagatatatgggggaggacggatgttggtacggcatggaaataaggccaattaatgagaaagaagagaacatggttaagagcctggtgtctgccggttccggcaaggtagataattttactatgggggtgttgtgcctcgctatcctgttcgaggaagtcatgcgcggaaaattcggcaagaaacatatgatcgccggggtgctatttacattcgttctgctcctgagtggacagattacctggcgggacatggcacacacgcttatcatgattggcagcaacgcttctgatagaatgggtatgggggtgacttatttggccctgatagcaacctttaagatccagcccttcttagccctcggatttttcctgaggaaacttacatcccgcgagaatctgctactcggcgtcggcctggctatggcgaccactttgcaactgccggaagacattgagcagatggccaacgggatcgcattaggactcatgacactgaaacttattacccagtttgaaacataccagctgtggactgctttggtgtcactcacctgtagtaatacgatcttcacactgaccgttgcctggcgaactgccaccctaatactggctggtgtgagccttctccctctgtgccaatcgtcctctatgcggaagacagattggttgccaatgactgtcgcagccatgggcgtaccccctctgcccttatttatcttcagcctcaaagacaccccacgtagaaggtcatggcctctgaacgagggggtgatggcggttggacttgtgagtattctggcttcctctttgctccgcaatgatgtccccatggccggcccactggtggcgggtgggctactgatcgcctgttatgtaattacgggaacaagcgctgaccttaccgtggagaaggcagccgacgtcacttgggaagaggaagcggagcagacaggcgtttcccataacctcatgatcaccgtggatgacgatggcactatgcggataaaagacgatgaaacagagaacattctgaccgtgttgttaaagacggctctgctcatcgtctcagggatctttccgtacagcattcctgccactctgcttgtgtggcacacctggcagaaacagacacaaagaagtggagttctgtgggacgtaccctctccacccgagacccagaaggcagaattggaggaaggtgtgtacaggataaaacagcagggcatcttcgggaagacacaagtcggagtgggcgttcagaaggagggtgtgtttcatactatgtggcacgtcacccgaggggccgtgctaacgcacaatggaaaacgcctggagcctaactgggcttccgtaaagaaagatctcattagctatggcggcgggtggcggctgtcggcccagtggcaaaagggagaagaggtccaggtgatcgcagttgaaccaggtaaaaatcccaagaacttccagacaatgcctggcattttccagactaccacaggggagatcggagctatagcccttgactttaagccgggcacctcaggttctccaatcattaatagagaagggaaagtggtcggattatacggcaacggcgtggttactaagaatgggggatatgtgagtggtatcgcgcaaaccaacgccgagcccgatggccctacaccagagctggaagaggaaatgttcaaaaagaggaatctcacgattatggacttgcatcccgggtccggaaaaactcgtaagtacctgcctgcaatcgtccgcgaggctataaagcggagactcaggaccctgattcttgccccgacacgagtggtagctgcagaaatggaggaggccctgaaaggcttgcccatccggtatcagaccactgccacaaagagcgaacacaccggtcgcgagatcgtggatctaatgtgccatgctacgtttactatgagactgctctctccagttagggtccctaactacaatttagtgattatggacgaagcgcacttcacagatcccgcaagcatcgccgctcgggggtatatatccacccgagtgggaatgggcgaggccgcagccatttttatgaccgctactccacctggcacagcggaagccttcccccagtcaaacgcaccaatccaggacgaggagagagacattccggaacgcagttggaatagcgggaacgagtggatcaccgattttgtcggaaaaacagtatggttcgtgccttctataaaggctggtaatgacattgccaactgtctgaggaaaaacggcaagaaggttatccaactttcccgtaaaacttttgatacggaataccagaagacccggctgaatgactgggatttcgtggtcacaactgacatctcagagatgggggcaaactttaaagccgatagagtgattgaccccaggcgctgcctcaagccagttatcttgaccgatggacccgagcgagtgattctggctggccctatgccagtcacagccgcgagtgcagcccagagacggggtagggtggggcgcaatccccagaaagaaaacgaccaatacatattcaccggccagcctctcaataacgatgaggaccatgctcactggactgaagccaagatgctgcttgacaatatcaacacgccggagggaattatcccagctctattcgaacccgagcgtgaaaagagcgcagccatcgatggcgaatatagactgaaaggggagtcccggaagacctttgtagaattgatgaggcgcggagacttacctgtgtggctggctcacaaagttgcctctgagggtattaagtacacagatcgaaaatggtgcttcgacggcgaaagaaataaccagatactcgaggagaatatggatgtcgaaatctggactaaggagggggaacggaaaaagctgaggccccgctggcttgacgcaagaacctattcggatccactggcgctcaaggagtttaaagacttcgccgctggaagaaagagcattgccttggatctggtgacagaaatcggccgggtgccttcacatctagcacaccgtacccgcaacgctctggacaatctcgtcatgcttcatacttccgagcacggtgggcgagcctacagacacgcagttgaggaactgcccgagacaatggaaacgttattgctgctcggcctgatgattcttctgaccggaggcgccatgctctttttgatcagtgggaaaggaataggtaagacttctatcggcctgatttgtgtgatcgctagctccgggatgttatggatggcggatgtaccactacagtggattgcctcagcaatcgtgctggagttctttatgatggtcctccttatacctgagccggaaaaacaaaggacaccccaggacaaccagctggcttatgtggttattggaatcttgaccctggccgccattgtggcagctaatgagatgggcctcctggaaaccacaaagcgggatcttggtatgtctaaggagccaggggtcgtaagccctacaagttacctcgacgtggacctgcatcccgcctccgcgtggacgttgtatgctgttgccaccacagtgatcactccaatgctgcgccacaccatagaaaacagcacagcaaatgtctctttagccgctatcgcaaaccaagccgtggtcctaatgggcctggataaaggatggcctatttcaaagatggacctcggcgtgccccttctggcgttggggtgctactcccaggttaacccgctgaccctcactgctgccgtgctgcttttagtaacgcattacgcaatcattggaccaggcctgcaggccaaagctacaagagaggcccagaagaggaccgcagctggtatcatgaaaaatcctactgtggatgggataatgaccattgacctcgatcccgtcatctatgacagtaagttcgagaagcaattgggacaggttatgctgctagtgctgtgtgccgtccagctccttctgatgcggacaagctgggcgttgtgcgaagccctgactctcgcaaccggcccaatcacaacgctgtgggagggttcgcccggcaaattttggaacaccactattgctgtgtctatggccaatatcttccgagggtcctacttagcaggagctggccttgcctttagcataatgaagtcagtagggacaggaagacgcggcaccggtagtcagggggaaactctgggagagaaatggaagaaaaagctcaaccaactatctaggaaggagttcgatctgtataaaaagtccggcattacagaggtggaccggaccgaggccaaagaaggtttgaagcgtggcgagacgacccaccatgcggttagcagagggtcagctaaactgcagtggtttgtggaaaggaatatggtcatccctgagggacgcgtgattgatctcggctgtgggcggggaggctggagttactattgcgcaggtcttaagaaagtcacagaagtgcgagggtacactaagggaggcccgggccacgaggagcccgttccaatgagcacctatgggtggaacatcgtaaagctgatgtccggaaaagacgtgttctacttgcctcccgaaaagtgtgatacactgctctgcgacataggtgagtctagcccttccccaactgtcgaagagtcaagaaccatcagggtgttaaaaatggttgagccctggctgcgcaataaccagttctgtattaaggtgcttaatccttacatgccaacagtcatcgaacacctggagcggctacagagaaaatatggcgggatgctcgtgcgtaaccccctgtctaggaatagtacccatgaaatgtactggatttcgaacggaactggcaatatcgtaagctccgtgaacatggtttctcggttgctgctcaatcgctttacgatgacacaccgaagaccgaccattgagaaggatgtcgaccttggtgccgggactaggcatgtgaacgctgaacctgagaccccaaacatggacgtgatcggagagcggataaagcgcattaaagaagaacactcaagcacatggcactatgatgacgaaaatccctacaagacgtgggcctatcatggctcctacgaggtcaaagcaaccggcagtgcctctagcatgatcaacggggttgtgaagctgttaactaaaccttgggatgtagtgccaatggtcacacaaatggctatgaccgacactacacccttcggacagcagagagtgtttaaggaaaaggttgataccaggacaccgcgacctatgcccggtactcggaaagtgatggagatcaccgcggagtggctgtggcgtacgttgggcagaaataagaaaccacgcctctgcaccagggaagagttcacaaagaaagtccggactaacgccgcaatgggggctgtgtttaccgaagagaatcaatgggactcagccagagcagccgtagaagatgaggagttctggaagctggttgaccgcgaaagggagctacacaaacttggaaaatgtggctcctgcgtgtataacatgatgggtaagcgagagaagaagctgggggagtttggaaaagctaagggcagtcgggccatttggtacatgtggctcggcgcgagatacctggagttcgaagcattggggtttctgaatgaggatcattggttcagcagggaaaactcttattccggagtcgagggtgaaggcctccacaaacttgggtacatactgcgcgacatctcaaagattcctggaggcgccatgtatgctgatgacacagccggttgggacactcgtatcaccgaggatgacttacataatgaggaaaagattacgcagcagatggatcccgagcaccggcagctggcaaacgctatctttaaattgacataccaaaataaggtggtgaaagtccagagaccaacccccaaggggactgttatggacataatcagcaggaaagatcagcgcggatcgggccaggtgggcacatatgggctcaacaccttcactaatatggaagcccaactggtacgacagatggagggagaaggtgtgctatctaaggctgaccttgagaaccctcatctgctcggcaagaaaattacccagtggctggagacaaagggggtcgaacggttgaaaagaatggccatcagtggagatgactgcgtggttaagccaattgatgacaggtttgcaaatgcgttactggccctcaacgatatgggcaaagtgcgcaaggacatcccgcagtggcaaccctccaagggttggcatgattggcagcaggtccctttctgtagccaccatttccacgagcttataatgaaagacgggagaaagctggtggtaccatgccggccccaggacgaactaattggaagggctcgtatctcacaaggcgccggctggtccctgaaagagacggcatgtctcgggaaggcttacgcccagatgtggtctttgatgtattttcaccgacgcgatctgagacttgcaagcaacgccatctgcagtgcggttcctgtgcattggattccaacctcccggactacatggagcatacacgctcatcaccagtggatgaccactgaagacatgctgacagtctggaatagggtgtggatcgaggataacccctggatggaggacaaaacccctgttacgacatgggaagatgtgccgtacctcggaaagcgcgaggaccaatggtgtggttctttaattggcctgacctcaagagccacttgggcacagaatatcttgaccgccattcagcaggtccggagtctgatcggggatgaagagttcctcgactacatgccatccatgaagaggtttcgaaaagaggaagagagcgaaggagctatatggtga

SEQ ID NO: 15198 - RNA, 9873 nt, synthetic construct
  misc_feature 1..9873: note = derived and/or modified CDS sequence (opt3) from DENV-3__GU131907__SS-prME
  source 1..9873: mol_type = other RNA
accagcctgtgcctcatgatgatgcttcccgcaacactggctttccacttgacttccagggacggagaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcagcttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaatagtaaaaacacgtcaatgagcttttcctgcatcgttattggaataatcacactgtatctaggcgcggtcgtgcaggctgatatgggttgtgtgattaattggaaggggaaggaactcaaatgcggaaacggcatcttcgtcaccaatgaggttcacacttggacagagcagtacaagtttcaagccgactctcccaaacggctggcaaccgccattgctggtgcctgggaaaacggcgtgtgtgggatccgaagcactacccgcatggagaatcttttgtggaagcagatagcaaacgaactgaattatatcctctgggagaacaatattaaactgacagtggtagtcggagatatcattggcgtgttagaacaggggaagagaacgctgaccccacagcctatggagcttaaatactcatggaagacttggggaaaggctaaaatcgttacagccgagacccaaaacagttccttcataattgacggccccaacacaccagaatgccccagcgcgtctagggcctggaatgtgtgggaggtcgaagactatggttttggggtgttcactaccaacatctggttgaagctccgggaggtttacacgcagtcatgtgatcatcgcctgatgagtgctgcaattaaagacgaaagagccgtgcacgctgatatgggatactggatcgagagccagaagaatggctcctggaaactagagaaggcctcttttatagaagtaaagacatgcacctggcctaaatcgcacactctgtggagcaacggtgtcctcgagtccgacatgatcattccaaagtcactggcaggcccgatcagtcagcataatcacaggcccgggtatcatacccaaacagcgggaccttggcaccttggcaaattggaactggatttcaactactgcgaggggactaccgtggtgattgccgagaattgtggaacacgtggcccatctttacggacgaccactgtcagcggtaagctcatccacgaatggtgctgtcgatcctgcacactgccccctcttagatatatgggggaggacggatgttggtacggcatggaaataaggccaattaacgagaaagaagagaatatggttaagtcactggtgagcgctggttctggcaaggtagataactttaccatgggggtgttgtgcctcgccatcctgttcgaggaagtcatgcgcggaaaattcggcaagaaacatatgatcgcaggggtgctatttactttcgttctgctcctgtccggacagattacatggcgggacatggctcacacccttatcatgattggcagtaatgccagcgatagaatgggtatgggggtgacgtatttggcactgactgccacctttaagatacagcccttcttagctctcggatttttcctgaggaaacttacatctcgcgagaacctgctactcggcgtcggcctggcgatggccaccactttgcaactgccggaagacatcgagcagatggcaaatgggattgctttaggactcatgacactgaaacttatcacccagtttgaaacataccagctgtggactgccttggtgtccctcacctgttcaaacacgattttcacactgaccgttgcctggcgaactgctaccctaatcctggcgggtgtgagtcttctccctctgtgccaaagctcgtccatgcggaagacagattggttgccaatgactgtcgccgcgatgggcgtaccccctctgcccttatttatattctctctcaaagacaccccaaagcgtagaagctggcctctgaatgagggggtgatggctgttggacttgtgtcaatcctggccagttccttgctcaggaacgatgtccccatggcaggcccactggtggccggtgggctactgattgcttgttatgtaatcacgggaacatctgcagaccttaccgtggagaaagccgcggacgtcacttgggaagaggaagctgagcagacaggcgttagccataacctcatgattaccgtggatgacgatggcactatgcgcatcaaggacgatgaaacagagaatatactgaccgtgttgttaaaaacggccctgctcattgtctccgggatctttccgtactcaatccctgcaactctgcttgtgtggcacacctggcagaagcagacacaacggagcggagttctgtgggacgtacccagtccacccgagacccagaaagccgaattggaggaaggtgtgtacagaattaagcagcagggcatattcgggaagacacaagtcggagtgggcgttcagaaagagggtgtgtttcatactatgtggcacgtcaccagaggggctgtgctaacgcacaacggaaagcgactggagcctaattgggcctctgtcaagaaggatctcatctcctatggcggcgggtggcgcctgagcgcacagtggcaaaaaggagaagaggtccaggtgattgctgttgaaccaggtaagaaccccaagaatttccagacaatgcctggcatcttccagactaccacaggggagattggagccatcgcgcttgactttaaaccgggcacctcgggttcaccaataatcaaccgggaagggaaggtggtcggattatacggcaatggcgtggttactaaaaacgggggatatgtgtctggtattgcccaaaccaatgcagagcccgatggccctacaccagagctggaagaggaaatgttcaagaaaagaaacctcacgatcatggacttgcatcccgggagtggaaagactaggaagtacctgcctgctattgtccgtgaggccatcaaacgccggctcagaaccctgatacttgctccgacaagggtggtagcagccgaaatggaggaggccctgaagggcttgcccattcgatatcagaccactgctacaaaatccgaacacaccggtcgggagatcgtggatctaatgtgccatgcgacgtttactatgcgcctgctcagcccagttagagtccctaattacaacttagtgatcatggacgaagcacacttcacagatcccgcctctattgctgccagggggtatatcagcacccgggtgggaatgggcgaggcagccgctatatttatgaccgcgactccacctggcacagccgaagcattcccccagtccaatgctccaattcaggacgaggagcgagacatcccggaaagatcatggaacagtgggaatgagtggattaccgattttgtcggaaagacagtatggttcgtgcctagcatcaaagccggtaacgacatagcaaactgtctgcgcaagaatggcaagaaagttattcaactttctaggaagacttttgatacggaataccagaaaacccgtctgaacgactgggatttcgtggtcacaactgacatctccgagatgggggccaattttaaggctgatcgggtgatcgaccccagaaggtgcctcaaaccagttattttgaccgatggacccgagcgcgtgatcctggccggccctatgccagtcacagcggcatcagccgctcagcgaagaggtcgggtggggaggaacccccagaaggaaaatgaccaatacattttcaccggccagcctctcaacaatgatgaggaccatgcccactggactgaagctaagatgctgcttgacaacataaatacgccggagggaatcattccagcactattcgaacccgagcgcgagaaaagtgccgctatcgatggcgaatatcgtctgaagggggagagcagaaaaacctttgtagaattgatgcggaggggagacttacctgtgtggctggcccacaaggttgcatccgagggtatcaaatacacagatcgcaagtggtgcttcgacggcgaacgaaacaatcagattctcgaggagaacatggatgtcgaaatatggactaaagagggggaaagaaagaagctgcggcccaggtggcttgacgcgcgcacctattctgatccactggccctcaaagagtttaaggacttcgctgccggaagaaaatcgatcgcattggatctggtgacagaaattggcagggtgcctagccatctagctcaccggacccgtaatgccctggacaacctcgtcatgcttcatacttcagagcacggtgggcgcgcataccgacacgccgttgaggaactgcccgagacaatggaaacgttattgctgctcggcctgatgatccttctgaccggaggcgctatgctctttttgatttccgggaagggaatcggtaaaacaagtataggcctgatctgtgtgattgtatctagcgggatgttatggatggcggatgtgccactacagtggatcgcctccgcaattgtcctggagttctttatgatggtgctccttatccctgagccggaaaagcaaagaacaccccaggacaatcagctggcttatgttgtgataggaattttgaccctggccgccatcgtcgcagctaacgagatgggcctcctggaaaccacaaagagggatcttggtatgtcaaaagagccaggggtagtgtctcctactagctacctcgacgttgacctgcatcccgccagtgcgtggacgttgtatgctgtggccaccacagtcattactccaatgctgcggcacaccatcgaaaattccacagcaaacgtgagcttagccgctatagcaaaccaagccgtcgtgctaatgggcctggataagggatggcctatctctaaaatggacctcggcgttccccttctggcgttggggtgctactcacaggtgaatccgctgaccctcactgctgccgtactgcttttagtgacgcattacgcaattatcggaccaggcctgcaggccaaggctacacgcgaggcccagaaaagaaccgcagctggtattatgaagaaccctactgtcgatgggatcatgaccatagacctcgatcccgttatttatgactccaagttcgagaaacaattgggacaggtgatgctgctagtcctgtgtgccgtgcagctccttctgatgaggacaagttgggcgttgtgcgaagccctgactctcgcaaccggcccaatcacaacgctgtgggagggtagccccggcaagttttggaataccactatcgctgtatcgatggccaacattttccgggggtcttacttagcaggagctggccttgccttttccatcatgaaaagcgtggggacaggacgaagaggcaccggttcacagggggaaactctgggagagaagtggaaaaagaagctcaatcaactaagtcgcaaagagttcgatctgtataagaaatctggcataacagaggttgacaggaccgaggccaaggaaggtttgaaacggggcgagacgacccaccatgcggtgtcccgtgggagcgctaagctgcagtggtttgtcgaaagaaacatggtgattcctgagggaagggtcatcgatctcggctgtgggcgcggaggctggtcatactattgcgcaggtcttaaaaaggtgacagaagttcgggggtacactaagggaggcccgggccacgaggagcccgtaccaatgagtacctatgggtggaatattgtgaaactgatgagcggaaaggacgtcttctacttgcctcccgaaaaatgtgatacactgctctgcgacatcggtgagtcctctcctagcccaactgtggaagagtcccgaaccataagagttttaaagatggtggagccctggctgaggaacaatcagttctgtatcaaagtccttaacccttacatgccaacagtgattgaacacctggagcgcctacagcggaagtatggcgggatgctcgtaagaaatcccctgtcacgtaactctacccatgaaatgtactggatcagtaatggaactggcaacattgtgtcgagcgttaatatggtctccaggttgctgctcaaccggtttacgatgacacaccgccgaccgaccatcgagaaggatgtggaccttggtgccgggactagacatgtgaacgctgaacctgagaccccaaatatggacgtcattggagagaggatcaaacggataaaggaagaacactcttcaacatggcactatgatgacgaaaacccctacaaaacgtgggcctatcatggcagctacgaggttaaggcaaccggctccgccagttctatgattaatggggtggtaaaactgttaactaagccttgggatgtggtcccaatggtgacacaaatggctatgaccgacactacacccttcggacagcagcgcgtttttaaggaaaaagtggataccagaacaccgaggcctatgcccggtactcgaaaggtcatggagatcaccgcggagtggctgtggcggacgttgggccgtaacaaaaagccaagactctgcacccgcgaagagttcactaagaaggtgaggactaatgccgcaatgggggctgtatttaccgaagagaaccaatgggacagcgcccgggcagccgttgaagatgaggagttctggaagctggtggacaaagaaagagagctacacaaacttggaaaatgtggctcatgcgtctataatatgatgggtaagcgcgagaaaaagctgggggagtttggaaaagctaagggctccagggccatctggtacatgtggctcggcgcgcgatacctggagttcgaagcattggggtttctgaacgaggatcattggttcagtcgggaaaatagctattctggagtggagggtgaaggcctccacaaacttgggtacattctgagagacatatccaaaatccctggaggcgccatgtatgctgatgacacagccggttgggacactaggattaccgaggatgacttacataacgaggaaaagatcacgcagcagatggatcccgagcaccgccagctggcaaatgctatttttaaattgacataccaaaacaaggtggtcaaagttcagcgtccaacccccaaggggactgtgatggacatcatatcacggaaggatcagagaggaagcggccaggtaggcacatatgggctcaataccttcactaacatggaagcccaactggtgaggcagatggagggagaaggtgtcctatcgaaagctgaccttgagaatcctcatctgctcgagaagaaaatcacccagtggctggaaacaaagggcgtggagcgcttgaaacgaatggccatttctggggatgactgcgttgtgaagccaatcgatgaccggtttgcaaacgcgttactggccctcaacgatatgggaaaggtcagaaaagacattccgcagtggcaacccagtaagggctggcatgattggcaacaggtgcctttctgttcccaccatttccacgaacttatcatgaaagacggtaggaagctggtagttccatgccgcccccaggacgagctaatagggagagctcggattagccaaggagccggctggtcactgaaagaaacggcatgtctcggcaaggcttacgcccagatgtggtccttgatgtattttcacaggcgtgatctgcgacttgcatctaatgccatctgcagcgcggtgcctgtccattggatcccaaccagtcgcactacatggtccattcacgctcatcaccagtggatgaccactgaggacatgctgacagtgtggaacagagtttggatagaggataatccctggatggaagacaagacccctgtgacgacatgggaggatgtcccgtacctcgggaaacgggaagaccaatggtgtggcagcttaatcggtctgacctctagggccacttgggcacagaacattttgaccgccatccaacaggtgcgctcactgattggcgatgaggagttcctcgactacatgccaagtatgaagagatttcggaaagaagaggaaacagagggggctatctggtga

SEQ ID NO: 15199 - RNA, 9873 nt, synthetic construct
  misc_feature 1..9873: note = derived and/or modified CDS sequence (opt3) from DENV-3__GQ868634__SS-prME
  source 1..9873: mol_type = other RNA
accagcctgtgcctcatgatgatgcttcccgcaacactggctttccacttgacttccagggacggagaacctaggatgatcgtggggaagaacgaacggggaaaatctttactgtttaagacggcatcaggtattaatatgtgtaccctaatagcaatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcaccgccgagacaagcgtagcgtcgccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaaaagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaattcaaagaacacgagtatgagcttttcctgcatcgttattggaataatcacactgtatctaggcgcggtcgtgcaggctgatatgggttgtgccattaattggaaggggaaggaactcaaatgcggatctggcatcttcgtgaccaacgaggtccacacttggacagagcagtacaagtttcaagcagacagccccaaacggctggccaccgctattgccggtgcatgggaaaatggcgtttgtgggatccgatcaactacccgcatggagaaccttttgtggaagcagatagctaatgaactgaactatatcctctgggagaataacattaaactgacagtggtggtaggagatatcattggcgtcttagaacaggggaagagaacgctgaccccacagcctatggagcttaaatacagttggaagacttggggaaaggccaaaatcgtgacagcggagacccaaaattccagcttcataattgacggccccaacacaccagaatgcccctctgcctcaagggcttggaacgtttgggaggtggaagactatggttttggggtcttcactaccaatatctggttgaagctccgggaggtgtacacgcagagttgtgatcatcgcctgatgagcgcagccattaaagacgaaagagctgttcacgccgatatgggatactggatcgagtcccagaagaacggctcttggaaactagagaaggcatcgtttatagaagtgaagacatgcacctggcctaaaagccacactctgtggtccaatggtgtactcgagtcagacatgatcattccaaagagtctggcgggcccgatctctcagcataaccacaggcccgggtatcatacccaaacagccggaccttggcaccttggcaaattggaactggatttcaattactgcgaggggactaccgtcgtgattacagagaactgtggaacgcgtggccccagcttacggaccactacagtgtccggtaagctcatccacgaatggtgctgtcgatcatgcaccctgccccctcttagatatatgggggaggacggatgttggtacggcatggaaataaggccaattaatgagaaagaagagaacatggtcaagagcctggtttctgctggttccggcaaggtggataattttactatgggggtattgtgcctcgccatcctgttcgaggaagtgatgcgcggaaaattcggcaagaaacatatgatcgcaggggtcctatttacattcgtgctgctcctgagtggacagattacctggcgggacatggctcacacgcttatcatgattggcagcaacgcctctgatagaatgggtatgggggttacttatttggcactgatagccacctttaagatccagcccttcttagctctcggatttttcctgaggaaacttacatcccgcgagaatctgctactcggcgtgggcctggcgatggccaccactttgcaactgccggaagacattgagcagatggcaaacgggatcgctttaggactcatgacactgaaacttattacccagtttgaaacataccagctgtggactgccttggtctcactcacctgtagtaatacgatcttcacactgaccgtggcctggcgaactgctaccctaatactggccggtgttagccttctccctctgtgccaatcgtcctctatgcggaagacagattggttgccaatgactgtggccgcgatgggcgtaccacctctgcccttatttatcttcagcctcaaagacaccccaaagcgtagatcatggcctctgaacgagggggtaatggctgtgggacttgttagtattctggcctcctctttgctcaggaatgatgtgcccatggcaggcccactggtcgccggtgggctactgatcgcttgttatgtgattacgggaacaagcgcagaccttaccgtagagaaagccgcggacgtgacttgggaagaggaagctgagcagacaggcgtctcccataacctcatgatcaccgttgatgacgatggcactatgcgcataaaggacgatgaaacagagaacattctgaccgtgttgttaaaaacggccctgctcatcgtgtcagggatctttccgtacagcattcctgcaactctgcttgtctggcacacctggcagaagcagacacaacggagtggagtgctgtgggacgttccctctccacccgagacccagaaagccgaattggaggaaggtgtatacagaataaagcagcagggcatcttcgggaagacacaagtgggagtcggcgtgcagaaagagggtgtttttcatactatgtggcacgtgaccagaggggctgtcctaacgcacaatggaaagcgactggagcctaactgggcctccgtgaaaaaggatctcattagctatggcggcgggtggcgcctgaatgcacagtggcaaaaaggagaagaggtacaggtcatcgctgtggaaccaggtaagaaccccaagaatttccagacaatgcctggcattttccagactaccacaggggagatcggagccatagcgcttgactttaaaccgggcacctcgggttcaccaatcattaaccgggaagggaaggttgtgggattatacggcaatggcgtcgtgactaaaaacgggggatatgtttctggtatcgcccaaaccaatgcagagcccgatggccctacaccagagctggaagaggaaatgttcaagaaaagaaacctcacgattatggacttgcatcccgggagtggaaagactaggaagtacctgcctgctatcgtgcgtgaggccataaaacgccggctcagaaccctgattcttgctccgacaagggtcgtggcagccgaaatggaggaggccctgaagggcttgcccatccgatatcagaccactgctacaaaatccgaacacaccggtcgggagatcgtagatctaatgtgccatgcgacgtttactatgcgcctgctcagcccagtgagagttcctaattacaacttagtcattatggacgaagcacacttcacagatcccgcctctatcgctgccagggggtatataagcacccgggtgggaatgggcgaggcagccgctatttttatgaccgcgactccacctggcacagccgaagcattcccccagtccaatgctccaatccaggacgaggagcgagacattccggaaagatcatggaacagtgggaatgagtggatcaccgattttgtgggaaagacagtctggttcgtacctagcataaaagccggtaacgacattgcaaactgtctgcgcaagaatggcaagaaagtgatccaactttctaggaagacttttgatacggaataccagaaaacccgtctgaacgactgggatttcgttgtgacaactgacatctccgagatgggggccaattttaaggctgatcgggtcattgaccccagaaggtgcctcaaaccagtgatcttgaccgatggacccgagcgcgttattctggccggccctatgccagtgacagcggcatcagccgctcagcgaagaggtcgggtcgggaggaacccccagaaggaaaatgaccaatacatattcaccggccagcctctcaacaatgatgaggaccatgcccactggactgaagctaagatgctgcttgacaacatcaatacgccggagggaattatcccagcactattcgaacccgagcgcgagaaaagtgccgctatcgatggcgaatatcgtctgaagggggagagcagaaaaacctttgtggaattgatgcggaggggagacttacctgtatggctggcccacaaggtggcatccgagggtattaaatacacagatcgcaagtggtgcttcgacggcgaacgaaacaatcagatactcgaggagaacatggatgttgaaatctggactaaagagggggaaagaaagaagctgcggcccaggtggcttgacgcgcgcacctattctgatccactggccctcaaagagtttaaggacttcgctgccggaagaaaatcgattgcattggatctggtcacagaaatcggcagggtgcctagccatctagctcaccggacccgtaatgccctggacaacctcgtgatgcttcatacttcagagcacggtgggcgcgcataccgacacgccgtcgaggaactgcccgagacaatggaaacgttattgctgctcggcctgatgattcttctgaccggaggcgctatgctctttttgatctccgggaagggaataggtaaaacaagtatcggcctgatttgtgttatcgtgtctagcgggatgttatggatggcggatgtaccactacagtggattgcctccgcaatcgtgctggagttctttatgatggtcctccttatacctgagccggaaaagcaaagaacaccccaggacaatcagctggcttatgtggttattggaatcttgaccctggccgccattgtggcagctaacgagatgggcctcctggaaaccacaaagagggatcttggtatgtcaaaagagccaggggtcgtatctcctactagctacctcgacgtggacctgcatcccgccagtgcgtggacgttgtatgctgttgccaccacagtgatcactccaatgctgcggcacaccatagaaaattccacagcaaacgtcagcttagccgctatcgcaaaccaagccgtggtcctaatgggcctggataagggatggcctatttctaaaatggacctcggcgtgccccttctggcgttggggtgctactcacaggttaatccgctgaccctcactgctgccgtgctgcttttagtaacgcattacgcaatcattggaccaggcctgcaggccaaggctacacgcgaggcccagaaaagaaccgcagctggtatcatgaagaaccctactgtggatgggataatgaccattgacctcgatcccgtcatctatgactccaagttcgagaaacaattgggacaggttatgctgctagtgctgtgtgccgtccagctccttctgatgaggacaagttgggcgttgtgcgaagccctgactctcgcaaccggcccaatcacaacgctgtgggagggtagccccggcaagttttggaataccactattgctgtgtcgatggccaacatcttccgggggtcttacttagcaggagctggccttgccttttccataatgaaaagcgtagggacaggacgaagaggcaccggttcacagggggaaactctgggagagaagtggaaaaagaagctcaatcaactaagtcgcaaagagttcgatctgtataagaaatctggcattacagaggtggacaggaccgaggccaaggaaggtttgaaacggggcgagacgacccaccatgcggtttcccgtgggagcgctaagctgcagtggtttgtggaaagaaacatggtcatccctgagggaagggtgattgatctcggctgtgggcgcggaggctggtcatactattgcgcaggtcttaaaaaggtcacagaagtgcgggggtacactaagggaggcccgggccacgaggagcccgttccaatgagtacctatgggtggaatatcgtaaaactgatgagcggaaaggacgtgttctacttgcctcccgaaaaatgtgatacactgctctgcgacataggtgagtcctctcctagcccaactgtcgaagagtcccgaaccatcagagtgttaaagatggttgagccctggctgaggaacaatcagttctgtattaaagtgcttaacccttacatgccaacagtcatcgaacacctggagcgcctacagcggaagtatggcgggatgctcgtgagaaatcccctgtcacgtaactctacccatgaaatgtactggattagtaatggaactggcaacatcgtatcgagcgtgaatatggtttccaggttgctgctcaaccggtttacgatgacacaccgccgaccgaccattgagaaggatgtcgaccttggtgccgggactagacatgtgaacgctgaacctgagaccccaaatatggacgtgatcggagagaggataaaacggattaaggaagaacactcttcaacatggcactatgatgacgaaaacccctacaaaacgtgggcctatcatggcagctacgaggtcaaggcaaccggctccgccagttctatgatcaatggggttgtgaaactgttaactaagccttgggatgtagtgccaatggtcacacaaatggctatgaccgacactacacccttcggacagcagcgcgtgtttaaggaaaaagttgataccagaacaccgaggcctatgcccggtactcgaaaggtgatggagatcaccgcggagtggctgtggcggacgttgggccgtaacaaaaagccaagactctgcacccgcgaagagttcactaaaaaggtcaggactaatgccgcaatgggggctgtgtttaccgaagagaaccaatgggacagcgcccgggcagccgtagaagatgaggagttctggaagctggttgacagagaacgcgagctacacaaacttggaaagtgtggctcatgcgtgtataatatgatgggtaaaagggaaaagaaactgggggagtttggaaaggctaaaggctcccgagccatttggtacatgtggctcggcgcgcggtacctggagttcgaagcattggggtttctgaacgaggatcattggttcagtagagaaaatagctattctggagtcgagggtgaaggcctccacaaacttgggtacatactgagggacatctccaagattcctggaggcgccatgtatgctgatgacacagccggttgggacactcgcatcaccgaggatgacttacataacgaggagaaaattacgcagcagatggatcccgagcaccgtcagctggcaaatgctatctttaagttgacataccaaaacaaagtggtgaaggtccagcggccaacccccaaagggactgttatggacataatctcaagaaaggatcagaggggaagcggccaggtgggcacatatgggctcaataccttcactaacatggaagcccaactggtacgccagatggagggagaaggtgtgctatcgaaggctgaccttgagaatcctcatctgctcgagaaaaagattacccagtggctggaaacaaaaggcgtcgagcgattgaagcggatggccatctctggggatgactgcgtggttaaaccaattgatgacagatttgcaaacgcgttactggccctcaacgatatgggaaaggtgaggaaggacatcccgcagtggcaacccagtaaaggctggcatgattggcagcaggtccctttctgttcccaccatttccacgaacttataatgaaggacggtcgcaaactggtggtaccatgcagaccccaggacgagctaattgggcgggctaggatcagccaaggagccggctggtcactgaaggaaacggcatgtctcggcaaggcttacgcccagatgtggtccttgatgtattttcaccgtcgagatctgcgccttgcatctaatgccatctgcagcgcggttcctgtgcattggattccaaccagtagaactacatggtccatacacgctcatcaccagtggatgaccactgaggacatgctgacagtctggaaccgggtgtggatcgaggataatccctggatggaagacaagacccctgttacgacatgggaggatgtgccgtacctcgggaagagggaagaccaatggtgtggcagcttaattggtctgacctctcgcgccacttgggcacagaacatcttgaccgccattcagcaggtcagatcactgatcggcgatgaggagttcctcgactacatgccaagtatgaaacggtttaggaaggaagaggaatccgagggggctatatggtga

SEQ ID NO: 15200 - RNA, 9873 nt, synthetic construct
  misc_feature 1..9873: note = derived and/or modified CDS sequence (opt3) from DENV-3__GU131908__SS-prME
  source 1..9873: mol_type = other RNA
accagcctgtgcctcatgatgatgcttcccgcaactctggctttccacttgacttccagggacggagagcctaggatgatcgtggggaagaacgaacggggaaagtctttactgtttaagacggcatcaggtattaatatgtgtaccctaatagccatggatctcggcgagatgtgcgacgatacagtcacttacaagtgtccactgatcgcggaagttgagccggaagacattgattgctggtgtaaccttaccagtacatgggtgacctatgggacttgcaatcaggctggagagcaccgccgagacaagcgtagcgtcgccctggcaccccacgtgggcatgggtttggatacaagaacccaaacgtggatgtccgccgagggggcttggaggcaggtcgaaaaggtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaattcaaagaacacgagtatgagcttttcctgcatcgttattggaataatcacactgtatctaggcgcggtcgtgcaggctgatatgggttgtgccattaattggaaggggaaggaactcaaatgcggatctggcatcttcgtgaccaacgaggtccacacttggacagagcagtacaagtttcaagcagacagccccaaacggctggccaccgctattgccggtgcatggaagaatggcgtttgtgggatccgatcaactacccgcatggaaaaccttttgtggaaacagatagctaatgagctgaactatatcctctgggaaaataacattaagctgacagtggtggtaggagatatcattggcgtcttagagcaggggaaaagaacgctgaccccacagcctatggaacttaagtacagttggaagacttggggaaaagccaagatcgtgacagcggagacccaaaattccagcttcataattgacggccccaacacaccagagtgcccctctgcctcaagggcttggaacgtttgggaagtggaggactatggttttggggtcttcactaccaatatctggttgaaactccgggaagtgtacacgcagagttgtgatcatcgcctgatgagcgcagccattaaggacgagagagctgttcacgccgatatgggatactggatcgaatcccagaaaaacggctcttggaagctagagaaggcatcgtttatagaggtgaaaacatgcacctggcctaagagccacactctgtggtccaatggtgtactcgaatcagacatgatcattccaaaaagtctggcgggcccgatctctcagcataaccacaggcccgggtatcatacccaaacagccggaccttggcaccttggcaagttggagctggatttcaattactgcgaagggactaccgtcgtgattacagagaactgtggaacgcgtggccccagcttacggaccactacagtgtccggtaaactcatccacgagtggtgctgtcgatcatgcaccctgccccctcttagatatatgggggaagacggatgttggtacggcatggagataaggccaattaatgaaaaggaggaaaacatggtcaagagcctggtttctgctggttccggcaaagtggataattttactatgggggtattgtgcctcgccatcctgttcgaggaggtgatgcgcggaaagttcggcaaaaagcatatgatcgcaggggtcctatttacattcgtgctgctcctgagtggacagattacctggcgggacatggctcacacgcttatcatgattggcagcaacgcctctgatagaatgggtatgggggttacttatttggcactgatagccacctttaaaatccagcccttcttagctctcggatttttcctgaggaaacttacatcccgcgaaaatctgctactcggcgtgggcctggcgatggccaccactttgcaactgccggaggacattgaacagatggcaaacgggatcgctttaggactcatgacactgaaacttattacccagtttgagacataccagctgtggactgccttggtctcactcacctgtagtaatacgatcttcacactgaccgtggcctggcgaactgctaccctaatactggcgggtgttagccttctccctctgtgccaatcgtcctctatgcggaaaacagattggttgccaatgactgtggccgcgatgggcgtaccacctctgcccttatttatcttcagcctcaaggacaccccaaaacgtagatcatggcctctgaacgaaggggtaatggctgtgggacttgttagtattctggcctcctctttgctcaggaatgatgtgcccatggcaggcccactggtcgccggtgggctactgatcgcttgttatgtgattacgggaacaagcgcagaccttaccgtagagaaggccgcggacgtgacttgggaggaagaggctgaacagacaggcgtctcccataacctcatgatcaccgttgatgacgatggcactatgcgcataaaagacgatgagacagaaaacattctgaccgtgttgttaaagacggccctgctcatcgtgtcagggatctttccgtacagcattcctgcaactctgcttgtctggcacacctggcagaaacagacacaacggagtggagtgctgtgggacgttccctctccacccgagacccagaaggccgagttggaagagggtgtatacagaataaagcagcagggcatcttcgggaaaacacaagtgggagtcggcgtgcagaaggaaggtgtttttcatactatgtggcacgtgaccagaggggctgtcctaacgcacaatggaaaacgactggagcctaactgggcctccgtgaagaaagatctcattagctatggcggcgggtggcgcctgaatgcacagtggcaaaagggagaggaagtacaggtcatcgctgtggagccaggtaagaaccccaaaaatttccagacaatgcctggcattttccagactaccacaggggaaatcggagccatagcgcttgactttaagccgggcacctcgggttcaccaatcattaaccgggaggggaaagttgtgggattatacggcaatggcgtcgtgactaagaacgggggatatgtttctggtatcgcccaaaccaatgcagaacccgatggccctacaccagagctggaggaagagatgttcaaaaagagaaacctcacgattatggacttgcatcccgggagtggaaagactaggaaatacctgcctgctatcgtgcgtgaagccataaagcgccggctcagaaccctgattcttgctccgacaagggtcgtggcagccgagatggaagaggccctgaaaggcttgcccatccgatatcagaccactgctacaaagtccgagcacaccggtcgggaaatcgtagatctaatgtgccatgcgacgtttactatgcgcctgctcagcccagtgagagttcctaattacaacttagtcattatggacgaggcacacttcacagatcccgcctctatcgctgccagggggtatataagcacccgggtgggaatgggcgaagcagccgctatttttatgaccgcgactccacctggcacagccgaggcattcccccagtccaatgctccaatccaggacgaggaacgagacattccggagagatcatggaacagtgggaatgaatggatcaccgattttgtgggaaaaacagtctggttcgtacctagcataaaggccggtaacgacattgcaaactgtctgcgcaagaatggcaaaaaggtgatccaactttctaggaaaacttttgatacggagtaccagaagacccgtctgaacgactgggatttcgttgtgacaactgacatctccgaaatgggggccaattttaaagctgatcgggtcattgaccccagaaggtgcctcaagccagtgatcttgaccgatggacccgagcgcgttattctggccggccctatgccagtgacagcggcatcagccgctcagcgaagaggtcgggtcgggaggaacccccagaaggagaatgaccaatacatattcaccggccagcctctcaacaatgatgaagaccatgcccactggactgaggctaaaatgctgcttgacaacatcaatacgccggaaggaattatcccagcactattcgagcccgaacgcgagaagagtgccgctatcgatggcgagtatcgtctgaaaggggaaagcagaaagacctttgtggagttgatgcggaggggagacttacctgtatggctggcccacaaagtggcatccgaaggtattaagtacacagatcgcaaatggtgcttcgacggcgagcgaaacaatcagatactcgaagagaacatggatgttgagatctggactaaggaaggggagagaaagaaactgcggcccaggtggcttgacgcgcgcacctattctgatccactggccctcaaggaatttaaagacttcgctgccggaagaaagtcgattgcattggatctggtcacagagatcggcagggtgcctagccatctagctcaccggacccgtaatgccctggacaacctcgtgatgcttcatacttcagaacacggtgggcgcgcataccgacacgccgtcgaggagctgcccgaaacaatggagacgttattgctgctcggcctgatgattcttctgaccggaggcgctatgctctttttgatctccgggaaaggaataggtaagacaagtatcggcctgatttgtgttatcgtgtctagcgggatgttatggatggcggatgtaccactacagtggattgcctccgcaatcgtgctggagttctttatgatggtcctccttatacctgagccggagaagcaaagaacaccccaggacaatcagctggcttatgtggttattggaatcttgaccctggccgccattgtggcagctaacgaaatgggcctcctggagaccacaaaaagggatcttggtatgtcaaaggaaccaggggtcgtatctcctactagctacctcgacgtggacctgcatcccgccagtgcgtggacgttgtatgctgttgccaccacagtgatcactccaatgctgcggcacaccatagaaaattccacagcaaacgtcagcttagccgctatcgcaaaccaagccgtggtcctaatgggcctggataaaggatggcctatttctaagatggacctcggcgtgccccttctggcgttggggtgctactcacaggttaatccgctgaccctcactgctgccgtgctgcttttagtaacgcattacgcaatcattggaccaggcctgcaggccaaagctacacgcgaagcccagaagagaaccgcagctggtatcatgaagaaccctactgtggatgggataatgaccattgacctcgatcccgtcatctatgactccaaattcgagaagcaattgggacaggttatgctgctagtgctgtgtgccgtccagctccttctgatgaggacaagttgggcgttgtgcgaggccctgactctcgcaaccggcccaatcacaacgctgtgggaaggtagccccggcaaattttggaataccactattgctgtgtcgatggccaacatcttccgggggtcttacttagcaggagctggccttgccttttccataatgaaaagcgtagggacaggacgaagaggcaccggttcacagggggagactctgggagaaaaatggaagaagaaactcaatcaactaagtcgcaaggagttcgatctgtataaaaagtctggcattacagaagtggacaggaccgaggccaaagagggtttgaagcggggcgaaacgacccaccatgcggtttcccgtgggagcgctaaactgcagtggtttgtggagagaaacatggtcatccctgaaggaagggtgattgatctcggctgtgggcgcggaggctggtcatactattgcgcaggtcttaagaaggtcacagaggtgcgggggtacactaaaggaggcccgggccacgaagaacccgttccaatgagtacctatgggtggaatatcgtaaagctgatgagcggaaaagacgtgttctacttgcctcccgagaagtgtgatacactgctctgcgacataggtgaatcctctcctagcccaactgtcgaggaatcccgaaccatcagagtgttaaaaatggttgagccctggctgaggaacaatcagttctgtattaaggtgcttaacccttacatgccaacagtcatcgagcacctggaacgcctacagcggaagtatggcgggatgctcgtgagaaatcccctgtcacgtaactctacccatgagatgtactggattagtaatggaactggcaacatcgtatcgagcgtgaatatggtttccaggttgctgctcaaccggtttacgatgacacaccgccgaccgaccattgaaaaagatgtcgaccttggtgccgggactagacatgtgaacgctgagcctgaaaccccaaatatggacgtgatcggagagaggataaagcggattaaagaggaacactcttcaacatggcactatgatgacgagaacccctacaagacgtgggcctatcatggcagctacgaagtcaaagcaaccggctccgccagttctatgatcaatggggttgtgaagctgttaactaagccttgggatgtagtgccaatggtcacacaaatggctatgaccgacactacacccttcggacagcagcgcgtgtttaaagagaaggttgataccagaacaccgaggcctatgcccggtactcgaaaagtgatggaaatcaccgcggagtggctgtggcggacgttgggccgtaacaagaaaccaagactctgcacccgcgaggagttcacaaagaaggtcaggactaatgccgcaatgggggctgtgtttaccgaggaaaaccaatgggacagcgcccgggcagccgtagaggatgaagagttctggaaactggttgacagagagcgcgaactacacaaacttggaaaatgtggctcatgcgtgtataatatgatgggtaagagggagaaaaagctgggggaatttggaaaagctaagggctcccgagccatttggtacatgtggctcggcgcgcggtacctggagttcgaggcattggggtttctgaacgaagatcattggttcagtagagagaatagctattctggagtcgaaggtgagggcctccacaaacttgggtacatactgagggacatctccaaaattcctggaggcgccatgtatgctgatgacacagccggttgggacactcgcatcaccgaagatgacttacataacgaggagaagattacgcagcagatggatcccgaacaccgtcagctggcaaatgctatctttaaattgacataccaaaacaaggtggtgaaagtccagcggccaacccccaaggggactgttatggacataatctcaagaaaggatcagaggggaagcggccaggtgggcacatatgggctcaataccttcactaacatggaggcccaactggtacgccagatggaaggagagggtgtgctatcgaaagctgaccttgaaaatcctcatctgctcgagaagaaaattacccagtggctggagacaaagggcgtcgaacgattgaaacggatggccatctctggggatgactgcgtggttaagccaattgatgacagatttgcaaacgcgttactggccctcaacgatatgggaaaggtgaggaaagacatcccgcagtggcaacccagtaagggctggcatgattggcagcaggtccctttctgttcccaccatttccacgagcttataatgaaagacggtcgcaagctggtggtaccatgcagaccccaggacgaactaattgggcgggctaggatcagccaaggagccggctggtcactgaaagagacggcatgtctcggcaaggcttacgcccagatgtggtccttgatgtattttcaccgtcgagatctgcgccttgcatctaatgccatctgcagcgcggttcctgtgcattggattccaaccagtagaactacatggtccatacacgctcatcaccagtggatgaccactgaagacatgctgacagtctggaaccgggtgtggatcgaggataatccctggatggaggacaagacccctgttacgacatgggaagatgtgccgtacctcgggaaaagggaggaccaatggtgtggcagcttaattggtctgacctctcgcgccacttgggcacagaacatcttgaccgccattcagcaggtcagatcactgatcggcgatgaagagttcctcgactacatgccaagtatgaagcggtttaggaaagaggaagagtccgaaggggctatatggtga

SEQ ID NO: 15201 - RNA, 9873 nt, synthetic construct
  misc_feature 1..9873: note = derived and/or modified CDS sequence (opt3) from DENV-3__GU131909__SS-prME
  source 1..9873: mol_type = other RNA
accagcctgtgcctcatgatgatgcttcccgcaacactggctttccacttgacttccagggacggcgagcctaggatgatcgtggggaagaacgaacggggaaaatctttactgtttaagacggcatcaggtattaatatgtgtaccctcatagcaatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtcgccctggcaccccacgtgggcatgggtttggatacaagaacccaaacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaaaagcaaacccacactagacatcgagctccagaagaccgaagcaactcaactggccacacttaggaaactgtgtattgagggaaagatcaccaatattacgaccgatagtcggtgccctacacagggcgaagctactttgccagaggaacaggaccagaactatgtctgtaaacacacctacgttgatcgcggttgggggaatggatgcggcctctttggcaaggggtccctggtgacatgcgccaagttccaatgtttagagcccatcgagggaaaagtagtgcagtatgaaaacctgaagtacactgtcataattaccgtgcacacaggtgaccagcatcaggttggcaatgacacccaaggggtgactgtcgagatcacgcctcaggcatctacagtggaagctgtactcccagagtatggaacccttggcctggaatgcagcccgcgaactggtttggattttaacgagatgattctactgaccatgaaaaataaggcctggatggttcacagacagtggttctttgacctccccctgccttggacatccggggcgaccactgagacaccaacgtggaacaggaaagaacttctggtgaccttcaagaatgcccatgccaaaaagcaagaggtcgtggtcttgggctcacaggaaggagctatgcacactgccctcacaggcgctaccgagatccagaacagtgggggaacaagcatctttgccggtcacctgaagtgtcggttaaaaatggataagctggaactaaaaggcatgtcttacgcaatgtgcctcaatactttcgtgctgaagaaagaggtttccgagacccagcatgggacgattcttataaaggtggaatacaagggagaggacgccccctgtaaaatccctttctcaaccgaagatggccaaggtaaggctcacaacgggcgtttgattacagcgaacccagtagtcactaaaaaggaggagcccgtgaatatcgaagcagagccgccttttggcgaaagcaacatagttattggaatcggcgacaaagccctgaagatcaattggtataagaaagggagttctattggaaagatgttcgaggctaccgcccgcggtgcaagaaggatggccatcctcggcgatacagcttgggactttgggtccgtgggaggcgtcctgaacagccttggtaaaatggtgcatcagattttcgggtcggcctacactgcactgttttctggcgtatcctggataatgaagatcggaattggcgtgttgctcacctggatcgggctgaatagtaaaaacacgtcaatgagcttctcctgcatcgttattggaataatcacattatatctgggcgcggtcgtgcaggctgatatgggttgtgccattaattggaaggggaaggaactaaaatgcggatctggcatctttgtgaccaacgaggtccacacttggacagagcagtacaagttccaagcagacagccccaaacggctcgccaccgctattgccggtgcatgggaaaatggcgtttgtgggatccgatcaactacccgcatggagaacctgctttggaagcagatagctaatgaattgaactatatcctgtgggagaataacattaaactcacagtggtggtaggagatatcattggcgtcctggaacaggggaagagaacgttaaccccacagcctatggagctgaaatacagttggaagacttggggaaaggccaaaatcgtgacagcggagacccaaaattccagctttataattgacggccccaacacaccagaatgcccctctgcctcaagggcttggaacgtttgggaggtggaagactatggtttcggggtctttactaccaatatctggcttaagttgcgggaggtgtacacgcagagttgtgatcatcgcctcatgagcgcagccattaaagacgaaagagctgttcacgccgatatgggatactggatcgagtcccagaagaacggctcttggaaactggagaaggcatcgttcatagaagtgaagacatgcacctggcctaaaagccacactctatggtccaatggtgtactggagtcagacatgatcattccaaagagtctcgcgggcccgatctctcagcataaccacaggcccgggtatcatacccaaacagccggaccttggcacctgggcaaacttgaattggattttaattactgcgaggggactaccgtcgtgattacagagaactgtggaacgcgtggcccaagcctgcggaccactacagtgtccggtaagttaatccacgaatggtgctgtcgatcatgcaccctaccccctctgagatatatgggggaggacggatgttggtacggcatggaaataaggccaattaatgagaaagaagagaacatggtcaagagccttgtttctgctggttccggcaaggtggataatttcactatgggggtactgtgcttggccatcctcttcgaggaagtgatgcgcggaaaatttggcaagaaacatatgatcgcaggggtcctgttcacatttgtgctactgctcagtggacagattacctggcgggacatggctcacacgctgatcatgattggcagcaacgcctctgatagaatgggtatgggggttacttatcttgcattgatagccaccttcaagatccagccctttctggctttaggattctttctcaggaaactgacatcccgcgagaatcttctgctaggcgtgggcctcgcgatggccaccactctgcaattgccggaagacattgagcagatggcaaacgggatcgctctgggattaatgacactcaagctgattacccagttcgaaacataccagctttggactgccctggtctcattgacctgtagtaatacgatctttacactcaccgtggcctggcgaactgctaccctgatactagccggtgttagcctgcttcctctctgccaatcgtcctctatgcggaagacagattggctgccaatgactgtggccgcgatgggcgtaccccctttgcccctgttcatctttagcttaaaagacaccccaaagcgtagatcatggcctctcaacgagggggtaatggctgtgggactggttagtattcttgcctcctctctgttgaggaatgatgtgcccatggcaggcccactcgtcgccggtgggctgctaatcgcttgttatgtgattacgggaacaagcgcagacctgaccgtagagaaagccgcggacgtgacttgggaagaggaagctgagcagacaggcgtctcccataaccttatgatcaccgttgatgacgatggcactatgcgcataaaggacgatgaaacagagaacattctcaccgtgctgttgaaaacggccttactgatcgtgtcagggatcttcccgtacagcattcctgcaactctcctggtctggcacacctggcagaagcagacacaacggagtggagtgctttgggacgttccctctccacccgagacccagaaagccgaactggaggaaggtgtatacagaataaagcagcagggcatctttgggaagacacaagtgggagtcggcgtgcagaaagagggtgttttccatactatgtggcacgtgaccagaggggctgtcttgacgcacaatggaaagcgactagagcctaactgggcctccgtgaaaaaggatctgattagctatggcggcgggtggcgcctcaatgcacagtggcaaaaaggagaagaggtacaggtcatcgctgtggaaccaggtaagaaccccaagaatttccagacaatgcctggcatttttcagactaccacaggggagatcggagccatagcgctggacttcaaaccgggcacctcgggttcaccaatcattaaccgggaagggaaggttgtgggactttacggcaatggcgtcgtgactaaaaacgggggatatgtttctggtatcgcccaaaccaatgcagagcccgatggccctacaccagagttagaagaggaaatgtttaagaaaagaaacctgacgattatggacctccatcccgggagtggaaagactaggaagtacttgcctgctatcgtgcgtgaggccataaaacgccggctgagaaccctcattctggctccgacaagggtcgtggcagccgaaatggaggaggcccttaagggcctgcccatccgatatcagaccactgctacaaaatccgaacacaccggtcgggagatcgtagatttgatgtgccatgcgacgttcactatgcgcctactgagcccagtgagagttcctaattacaacctcgtcattatggacgaagcacactttacagatcccgcctctatcgctgccagggggtatataagcacccgggtgggaatgggcgaggcagccgctattttcatgaccgcgactccacctggcacagccgaagcatttccccagtccaatgctccaatccaggacgaggagcgagacattccggaaagatcatggaacagtgggaatgagtggatcaccgatttcgtgggaaagacagtctggtttgtacctagcataaaagccggtaacgacattgcaaactgtttacgcaagaatggcaagaaagtgatccaactgtctaggaagactttcgatacggaataccagaaaacccgtcttaacgactgggattttgttgtgacaactgacatctccgagatgggggccaatttcaaggctgatcgggtcattgaccccagaaggtgcctgaaaccagtgatcctcaccgatggacccgagcgcgttattttggccggccctatgccagtgacagcggcatcagccgctcagcgaagaggtcgggtcgggaggaacccccagaaggaaaatgaccaatacatattcaccggccagcctctgaacaatgatgaggaccatgcccactggactgaagctaagatgctcctggacaacatcaatacgccggagggaattatcccagcactttttgaacccgagcgcgagaaaagtgccgctatcgatggcgaatatcgtctaaagggggagagcagaaaaaccttcgtggaactgatgcggaggggagacttgcctgtatggttagcccacaaggtggcatccgagggtattaaatacacagatcgcaagtggtgctttgacggcgaacgaaacaatcagatactggaggagaacatggatgttgaaatctggactaaagagggggaaagaaagaagctccggcccaggtggctggacgcgcgcacctattctgatccacttgccctgaaagagttcaaggactttgctgccggaagaaaatcgattgcactcgatttggtcacagaaatcggcagggtgcctagccatctggctcaccggacccgtaatgccctagacaacctggtgatgctccatacttcagagcacggtgggcgcgcataccgacacgccgtcgaggaacttcccgagacaatggaaacgctgttattgctgggcctcatgattctgcttaccggaggcgctatgctgttcctcatctccgggaagggaataggtaaaacaagtatcggcttgatttgtgttatcgtgtctagcgggatgctgtggatggcggatgtaccattacagtggattgcctccgcaatcgtgctagagtttttcatgatggtcctgctcatacctgagccggaaaagcaaagaacaccccaggacaatcagcttgcttatgtggttattggaatcctgaccttggccgccattgtggcagctaacgagatgggcctgctcgaaaccacaaagagggatctgggtatgtcaaaagagccaggggtcgtatctcctactagctaccttgacgtggacctccatcccgccagtgcgtggacgctgtatgctgttgccaccacagtgatcactccaatgttgcggcacaccatagaaaattccacagcaaacgtcagcctggccgctatcgcaaaccaagccgtggtcttaatgggcctagataagggatggcctatttctaaaatggacctgggcgtgcccctccttgcgctggggtgctactcacaggttaatccgttgaccctgactgctgccgtgctcctgcttgtaacgcattacgcaatcattggaccaggcttacaggccaaggctacacgcgaggcccagaaaagaaccgcagctggtatcatgaagaaccctactgtggatgggataatgaccattgacctggatcccgtcatctatgactccaagtttgagaaacaactcggacaggttatgttgctggtgctatgtgccgtccagctgctccttatgaggacaagttgggcgctgtgcgaagccttgactctggcaaccggcccaatcacaacgctctgggagggtagccccggcaagttctggaataccactattgctgtgtcgatggccaacatctttcgggggtcttacctggcaggagctggcttagccttctccataatgaaaagcgtagggacaggacgaagaggcaccggttcacagggggaaactcttggagagaagtggaaaaagaagctgaatcaactcagtcgcaaagaatttgatctatataagaaatctggcattacagaggtggacaggaccgaggccaaggaaggtctgaaacggggcgagacgacccaccatgcggtttcccgtgggagcgctaagttgcagtggttcgtggaaagaaacatggtcatccctgagggaagggtgattgatctgggctgtgggcgcggaggctggtcatactattgcgcaggtctcaaaaaggtcacagaagtgcgggggtacactaagggaggcccgggccacgaggagcccgttccaatgagtacctatgggtggaatatcgtaaaacttatgagcggaaaggacgtgttctacctgcctcccgaaaaatgtgatacattgctgtgcgacataggtgagtcctctcctagcccaactgtcgaagagtcccgaaccatcagagtgctcaagatggttgagccctggttaaggaacaatcagttttgtattaaagtgctgaacccttacatgccaacagtcatcgaacaccttgagcgcctgcagcggaagtatggcgggatgctagtgagaaatcccctctcacgtaactctacccatgaaatgtactggattagtaatggaactggcaacatcgtatcgagcgtgaatatggtttccaggctgttgctgaaccggttcacgatgacacaccgccgaccgaccattgagaaggatgtcgacctcggtgccgggactagacatgtgaacgctgaacctgagaccccaaatatggacgtgatcggagagaggataaaacggattaaggaagaacactcttcaacatggcactatgatgacgaaaacccctacaaaacgtgggcctatcatggcagctacgaggtcaaggcaaccggctccgccagttctatgatcaatggggttgtgaaacttctgactaagccttgggatgtagtgccaatggtcacacaaatggctatgaccgacactacaccctttggacagcagcgcgtgttcaaggaaaaagttgataccagaacaccgaggcctatgcccggtactcgaaaggtgatggagatcaccgcggagtggttatggcggacgctgggccgtaacaaaaagccaagattgtgcacccgcgaagagtttactaaaaaggtcaggactaatgccgcaatgggggctgtgttcaccgaagagaaccaatgggacagcgcccgggcagccgtagaagatgaggagttttggaagctcgttgacagagaacgcgagctgcacaaactaggaaagtgtggctcatgcgtgtataatatgatgggtaaaagggaaaagaaacttggggagttcggaaaggctaaaggctcccgagccatttggtacatgtggctgggcgcgcggtacctcgagtttgaagcactggggttcttgaacgaggatcattggtttagtagagaaaatagctattctggagtcgagggtgaaggcctgcacaagctcgggtacatacttagggacatctccaagattcctggaggcgccatgtatgctgatgacacagccggttgggacactcgcatcaccgaggatgacctgcataacgaggagaaaattacgcagcagatggatcccgagcaccgtcagttagcaaatgctatcttcaagctgacataccaaaacaaagtggtgaaggtccagcggccaacccccaaagggactgttatggacataatctcaagaaaggatcagaggggaagcggccaggtgggcacatatgggttgaatacctttactaacatggaagcccaactcgtacgccagatggagggagaaggtgtgctgtcgaaggctgacctagagaatcctcaccttctggagaaaaagattacccagtggctcgaaacaaaaggcgtcgagcgactgaagcggatggccatctctggggatgactgcgtggttaaaccaattgatgacagattcgcaaacgcgttgttagccctgaacgatatgggaaaggtgaggaaggacatcccgcagtggcaacccagtaaaggctggcatgattggcagcaggtccctttctgttcccaccattttcacgaactcataatgaaggacggtcgcaaacttgtggtaccatgcagaccccaggacgagctgattgggcgggctaggatcagccaaggagccggctggtcactaaaggaaacggcatgtctgggcaaggcttacgcccagatgtggtccctcatgtatttccaccgtcgagatttgcgcctggcatctaatgccatctgcagcgcggttcctgtgcattggattccaaccagtagaactacatggtccatacacgctcatcaccagtggatgaccactgaggacatgcttacagtctggaaccgggtgtggatcgaggataatccctggatggaagacaagacccctgttacgacatgggaggatgtgccgtacctggggaagagggaagaccaatggtgtggaagcctcattggtttaacctctcgcgccacttgggcacagaacatcctgaccgccattcagcaggtcagatcattgatcggcgatgaggagtttctggactacatgccaagtatgaaacggttcaggaaggaagaggaatccgagggggctatatggtga

SEQ ID NO: 15202 - RNA, 9873 nt, synthetic construct
  misc_feature 1..9873: note = derived and/or modified CDS sequence (opt3) from DENV-3__GU131912__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgcaaaaaagcaagaggtcgtggtcctcggctcacaggaaggagctatgcacactgccctgacaggcgctaccgagatccagaacagtgggggaacaaatatcttcgccggtcacttaaagtgtcggctgaaaatggataagctagaactcaaaggcatgagctacgcaatgtgcctgaacacttttgtgcttaagaaagaggtttctgagacccagcatgggacgattttgataaaggtggaatacaagggagaggacgccccctgtaaaatccctttctccaccgaagatggccaaggtaaggctcacaacgggcgtctgattacagcgaatccagtagtcactaaaaaggaggagcccatcaacatagaagcagagccgcctttcggcgaatcaaatattgtgatcggaatcggcgacaaagccctcaagattaactggtataagaaagggagcagtatcggaaagatgtttgaggctaccgcccgcggtgcaagaaggatggccattctgggcgatacagcttgggacttcgggtctgttggaggcgtgcttaattccctgggtaaaatggtccatcagatatttgggagcgcctacactgcattgttctcgggcgtgtcttggatcatgaagattggaatcggcgtactcctgacctggatcgggttaaactccaaaaatacgtcaatgagttttagctgcattgtgataggaatcattacactgtatctaggcgcggttgtccaggctgatatgggttgtgtgatcaactggaaggggaaggaactcaaatgcggaaatggcattttcgtgaccaacgaggtccacacttggacagagcagtacaagtttcaagccgactcccccaaacggctggcaaccgccatcgctggttcttgggaaaatggcgtttgtgggatacgaagcactacccgcatggagaaccttttgtggaagcagatcgccaatgaactgaactatattctctgggagaataacatcaaactgacagtggtggtaggagatattatcggcgtcttagaacaggggaagagaacgctgaccccacagcctatggagcttaaatactcatggaagacttggggaaaggcaaaaatagtgacagctgagacccaaaacagttccttcattatcgacggccccaatacaccagaatgccccagcgcctctagggcgtggaacgtttgggaggtggaagactatggttttggggtcttcactaccaatatttggttgaagctccgggaggtgtacacgcagtcatgtgatcatcgcctgatgagtgccgctatcaaagacgaaagagcagttcacgccgatatgggatactggatagagagccagaagaacggctcctggaaactagagaaggcttcttttatcgaagtgaagacatgcacctggcctaaatcgcacactctgtggagcaatggtgtactcgagtccgacatgattatcccaaagtcactggccggcccgattagtcagcataaccacaggcccgggtatcatacccaaacagcaggaccttggcaccttggcaaattggaactggatttcaattactgcgaggggactaccgtcgtgatcgcggagaactgtggaacacgtggcccatctttacggacgaccactgtgagcggtaagctcatacacgaatggtgctgtcgatcctgcacactgccccctcttagatatatgggggaggacggatgttggtacggcatggaaattaggccaatcaatgagaaagaagagaacatggtcaagtcactggttagcgccggttctggcaaggtggataattttaccatgggggtattgtgcctcgctatcctgttcgaggaagtgatgcgcggaaaattcggcaagaaacatatgattgccggggtcctatttactttcgtgctgctcctgtccggacagatcacatggcgggacatggcacacacccttattatgataggcagtaacgctagcgatagaatgggtatgggggttacgtatttggccctgatcgcaacttttaagattcagcccttcttagccctcggatttttcctgaggaaacttacctctcgcgagaatctgctactcggcgtgggcctggctatggcgacaaccttgcaactgccggaagacatcgagcagatggccaacgggattgcattaggactcatgactctgaagcttatcacacagtttgaaacctaccagctgtggacagctttggtctccctcacttgttcaaataccatattcacgctgacagtggcctggcgaaccgccactctaatcctggctggtgttagtcttctccctctgtgccaaagctcgtccatgcggaagaccgattggttgccaatgacagtggcagccatgggcgtcccccctctgcccttatttattttctctctcaaagacactccaaagcgtaaaagctggcctctgaacgagggggtaatggcggtgggacttgtttcaatcctggctagttccttgctcagaaacgatgtgcccatggccggcccactggtcgcaggtgggctactgattgcctgttatgtgatcaccggaacgtctgctgaccttacagtagagaaggcagccgacgtgacctgggaagaggaagcggagcagactggcgtcagccataatctcatgataacagttgatgacgatggcaccatgaggattaaagacgatgaaactgagaacatcctgacagtgttgttaaagaccgctctgctcatcgtgtccgggatttttccgtactcaatacctgccacgctgcttgtctggcacacttggcagaaacagacccaacgcagcggagtgctgtgggacgttcccagtccacccgagacacagaaggcagaattggaggaaggtgtataccggatcaagcagcagggcattttcgggaaaacccaagtgggagtcggcgtgcagaaggagggtgtttttcatacaatgtggcacgtgactagaggggccgtcctaacccacaatggaaaaaggctggagcctaactgggcttctgtgaagaaagatctcatctcctatggcggcgggtggcgactgagcgcccagtggcaaaagggagaagaggtacaggtcattgcagtggaaccaggtaagaatcccaaaaacttccagacgatgcctggcatcttccagacaactaccggggagataggagctatcgcccttgactttaagccgggcacatcgggttcaccaattatcaatcgcgaagggaaagttgtgggattatacggcaacggcgtcgtgaccaagaatgggggatatgtttctggtattgcgcaaactaacgccgagcccgatggccctaccccagagctggaagaggaaatgttcaaaaagcggaatctcacaatcatggacttgcatcccgggagtggaaagacgagaaaatacctgcctgcaatagtgagggaggctattaagcgtcgcctccggactctgatccttgccccgaccagagtcgtggctgcagaaatggaggaggccctgaaaggcttgcccatcaggtatcagacaaccgcctccaagagcgaacacactggtcgagagattgtagatctaatgtgccatgctacatttaccatgcggctgctctctccagtgcgcgttcctaactacaatttaatcataatggacgaagcgcacttcacggatcccgcaagcattgccgctagagggtatatctccactagggtcggaatgggcgaggccgcagccatttttatgacagctaccccacctggcaccgcggaagccttcccccagtcaaacgcaccaatccaggacgaggagcgggacataccggaacgaagttggaatagcgggaacgagtggattactgattttgtgggaaaaacagtgtggttcgtcccttctatcaaggctggtaacgacatcgccaattgtctgagaaagaacggcaaaaaggtaattcaactttcccgcaaaacctttgatacagaataccagaagactaggctgaatgactgggatttcgtggttacgaccgacatctcagagatgggggcaaactttaaagccgatcgtgtgattgacccccggagatgcctcaagccagtcatattgacagatggacccgagagggtgatcctggctggccctatgccagttactgccgcgagtgcagcccagcgccgaggtagagtggggcggaatccccagaaggaaaacgaccaatacattttcaccggccagcctctcaataacgatgaggaccatgctcactggacagaagccaaaatgctgcttgacaatatcaacaccccggagggaatcattccagctctattcgaacccgagagggagaagagcgcagccatagatggcgaatatcgcctgaaaggggagtcccgtaagacttttgtcgaattgatgagacggggagacttacctgtgtggctggctcacaaagtagcctctgagggtatcaagtacacggataggaaatggtgcttcgacggcgaacgcaataaccagattctcgaggagaatatggatgtggaaatctggaccaaggagggggaacgaaagaaactgagaccccggtggcttgacgcaaggacatattcggatccactggcgctcaaggagtttaaagacttcgccgctggacgcaagagcattgccttggatctggttactgaaatcggcagagtcccttcacatctagcacacaggacccggaacgctctggacaatctcgtgatgcttcatacatccgagcacggtgggcgtgcctaccgccacgcagtggaggaactgcccgagaccatggaaactttattgctgctcggcctgatgatacttctgacaggaggcgccatgctctttttgatcagtgggaaaggaattggtaagacgtctatcggcctgatttgtgtcatcgttagctccgggatgttatggatggctgatgtgccactacagtggatagcgtcagccattgtactggagttctttatgatggtgctccttatccctgagccggaaaagcaacgaaccccccaggacaaccagctggcatatgtcgtgattggaatcttgactctggctgccatagttgccgcaaatgagatgggcctcctggaaacaaccaaaagagatcttggtatgtctaaggagccaggggtggtcagccctaccagttacctcgacgtagacctgcatcccgcttccgcctggacattgtatgcggtggctactacggttatcaccccaatgctgaggcacacaattgaaaacagcactgccaacgtgtctttagcagccatcgctaatcaagcagtcgtgctaatgggcctggataaaggatggcctatttcaaagatggacctcggcgtcccccttctggccttggggtgctactcccaggtgaacccgctgaccctcacagcggctgttctgcttttagtgacccattacgccatcataggaccaggcctgcaggcaaaagccactcgggaggctcagaagcgcacggccgcaggtattatgaagaatcctacagtagatgggatcatgaccatcgacctcgatcccgtgatttatgacagtaaattcgagaagcaattgggacaggtcatgctgctagttctgtgtgctgtgcagctccttctgatgagaactagctgggccttgtgcgaagcgctgaccctcgccacaggcccaatcactaccctgtgggagggttcgcccggcaaattttggaacacaacgatagcagtctctatggctaatattttcagggggtcctacttagccggagcaggccttgcttttagcatcatgaagtcagtggggaccggacggcgaggcactggtagtcagggggaaacactgggagagaaatggaagaagaaactcaaccaactatctagaaaggaattcgatctgtataaaaagtccggcattaccgaggtagaccgcactgaggccaaagaaggtttgaagaggggcgagacaacccaccatgccgtgagccgggggtcagcgaaactgcagtggtttgttgaacgtaatatggtgatccctgagggaagagtcatagatctcggctgtgggaggggaggctggagttactattgcgctggtcttaagaaggtgacggaagtccgcgggtacaccaaaggaggcccgggccacgaggagcccgtgccaatgagcacatatgggtggaacatcgttaagctgatgtccggaaaagacgtattctacttgcctcccgaaaagtgtgatactctgctctgcgacattggtgagtctagcccttccccaaccgtggaagagtcacggacaatccgagtcttaagaatggtggagccctggctgaggaataaccagttctgtattaaagttcttaatccttacatgccaaacgtgatcgaacacctggagcgcctacagcggaagtatggcgggatgctcgtcagaaatcccctgtctcgtaacagtactcatgaaatgtactggatttcgaatggaaccggcaacatcgtgagctccgtaaacatggtgtctaggttgctgctcaatcggtttacaatgacccaccgccgaccgactatagagaaggatgttgaccttggtgcagggacgagacatgtcaacgccgaacctgagacaccaaatatggacgtgattggagagaggatcaaacggatcaaggaagagcactcaagcacctggcactatgatgacgaaaacccctacaaaacttgggcttatcatggctcctacgaggtgaaggccaccggcagtgcatctagcatgattaatggggtcgttaaactgttaacaaagccttgggatgtggtaccaatggtgacgcaaatggccatgaccgacactacacccttcggacagcagcgcgtctttaaggaaaaagtggataccagaactccgaggcctatgcccggtacacgaaaggttatggagataaccgctgagtggctgtggcggacattgggccgtaacaaaaagccaagactctgcactcgcgaagagttcaccaaaaaggtgaggacgaatgcggccatgggggcagtctttaccgaagagaaccaatgggactcagctcgggccgcagtggaagatgaggagttctggaagctggtagacaaagaaagagagctacacaagcttggaaaatgtggctcctgcgtttataatatgatgggtaagcgcgaaaaaaagctgggggagtttggaaaagccaagggcagtagggctatctggtacatgtggctcggcgcccgatacctggagttcgaagcgttggggtttctgaacgaggatcattggttcagccgggaaaattcttattccggagtggagggtgaaggcctccacaagcttgggtacattctgagagacatctcaaaaattcctggaggcgcaatgtatgccgatgacacagctggttgggacactaggatcaccgaggatgacttacataacgaggaaaagataacacagcagatggatcccgagcaccgccagctggccaatgcaatctttaaattgacttaccaaaacaaggtcgtgaaagtgcagcgtccaacccccaaggggacggtcatggacattatcagccggaaggatcagagaggatcgggccaggttggcacatatgggctcaataccttcactaacatggaagctcaactggtgaggcagatggagggagaaggtgtactatctgaggccgaccttgagaaccctcacctgctcgaaaaaaagattacacagtggctggagaccaaaggcgtggaacgcttgaagcgaatggctatcagtggggatgactgcgtcgtgaaaccaatagatgaccggtttgccaatgcattactggcgctcaacgatatgggaaaggttagaaaggacattccgcagtggcaaccctccaaaggctggcatgattggcagcaggtgcctttctgtagccaccatttccacgagcttatcatgaaggacggtaggaaactggtcgtgccatgccgcccccaggacgaactaatcgggagagcccggatttcacaaggagctggctggtccctgaaggagactgcctgtctcggcaaagcatacgctcagatgtggtctttgatgtattttcacaggcgtgatctgcgacttgccagcaatgcaatatgcagtgccgtacctgttcattggatcccaacctcccgcacaacgtggagcattcacgcgcatcaccagtggatgaccactgaggacatgctgacagtgtggaacagagtctggatcgaagataatccctggatggaggacaagacccctgtgactacatgggaagatgttccgtacctcgggaagcgggaggaccaatggtgtggatctttaattggtctgacctcaagggctacgtgggcccagaacatcttgacagcaatacagcaggtgcgcagtctgatcggcgatgaggaattcctcgactacatgccatccatgaaaagatttcggaaggaggaagagagcgaaggggccatttggtga

SEQ ID NO: 15203 - RNA, 9873 nt, synthetic construct
  misc_feature 1..9873: note = derived and/or modified CDS sequence (opt3) from DENV-3__GU131913__SS-prME
  source 1..9873: mol_type = other RNA
accagcctgtgcctcatgatgatgcttcccgcaacactggctttccacttgacttccagagacggcgaacctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcagcttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccatcaatatagaagcagagccgcctttcggcgaaagcaacattgtgatcggaatcggcgacaaagccctcaagattaattggtataagaaagggagttctatcggaaagatgtttgaggctaccgcccgcggtgcaagaaggatggccattctgggcgatacagcttgggacttcgggtccgttggaggcgtgcttaacagcctgggtaaaatggtccatcagatatttgggtcggcctacactgcattgttctctggcgtgtcctggatcatgaagattggaatcggcgtactcctgacctggatcgggttaaatagtaaaaacacgtcaatgagcttttcctgcattgtgataggaatcgttacactgtatctaggcgcggtcgtgcaggctgatatgggttgtgtgattaattggaaggggaaggaactcaaatgcggaaacggcatcttcgtcaccaatgaggttcacacttggacagagcagtacaagtttcaagccgactctcccaaacggctggcaaccgccattgctggtgcctgggaaaacggcgtgtgtgggatccgaagcactacccgcatggagaatcttttgtggaagcagatagcaaacgaactgaattatatcctctgggagaacaatattaaactgacagtggtagtcggagatatcattggcgtgttagaacaggggaagagaacgctgaccccacagcctatggagcttaaatactcatggaagacttggggaaaggctaaaatcgttacagccgagacccaaaacagttccttcataattgacggccccaacacaccagaatgccccagcgcgtctagggcctggaatgtgtgggaggtcgaagactatggttttggggtgttcactaccaacatctggttgaagctccgggaggttcatacgcagtcatgtgatcaccgcctgatgagtgctgcaattaaagacgaaagagccgtgcacgctgatatgggatactggatcgagagccagaagaatggctcctggaaactagagaaggcctcttttatagaagtaaagacatgcacctggcctaaatcgcatactctgtggagcaacggtgtcctcgagtccgacatgatcattccaaagtcactggcaggcccgatcagtcagcacaatcataggcccgggtaccacacccaaacagcgggaccttggcaccttggcaaattggaactggatttcaactattgcgaggggactaccgtggtgattgccgagaattgtggaacacgtggcccatctttacggacgaccactgtcagcggtaagctcatccatgaatggtgctgtcgatcctgcacactgccccctcttagatacatgggggaggacggatgttggtatggcatggaaataaggccaattaacgagaaagaagagaatatggttaagtcactggtgagcgctggttctggcaaggtagataactttaccatgggggtgttgtgcctcgccatcctgttcgaggaagtcatgcgcggaaaattcggcaagaaacacatgatcgcaggggtgctatttactttcgttctgctcctgtccggacagattacatggcgggacatggctcatacccttatcatgattggcagtaatgccagcgatagaatgggtatgggggtgacgtacttggcactgatagccacttttaagatccagcccttcttagctctcggatttttcctgaggaaacttacctctcgcgagaacctgctactcggcgtcggcctggcgatggccacaaccttgcaactgccggaagacattgagcagatggcaaatgggatcgctttaggactcatgactctgaaacttattacacagtttgaaacctatcagctgtggacagccttggtgtccctcacttgttcaaacaccatcttcacgctgacagttgcctggcgaaccgctactctaatactggcgggtgtgagtcttctccctctgtgccaaagctcgtccatgcggaagaccgattggttgccaatgacagtcgccgcgatgggcgtaccccctctgcccttatttatcttctctctcaaagacactccaaagcgtaaaagctggcctctgaatgagggggtgatggctgttggacttgtgtcaattctggccagttccttgctcagaaacgatgtccccatggcaggcccactggtggccggtgggctactgatcgcttgttacgtaattaccggaacgtctgcagaccttacagtggagaaggccgcggacgtcacctgggaagaggaagctgagcagactggcgttagccacaacctcatgatcacagtggatgacgatggcaccatgaggataaaagacgatgaaactgagaatattctgacagtgttgttaaagaccgccctgctcatcgtctccgggatctttccgtattcaattcctgcaacgctgcttgtgtggcatacttggcagaaacagacccaacgcagcggagttctgtgggacgtacccagtccacccgagacacagaaggccgaattggaggaaggtgtgtaccggataaagcagcagggcatcttcgggaaaacccaagtcggagtgggcgttcagaaggagggtgtgtttcacacaatgtggcacgtcactagaggggctgtgctaacccataacggaaaaaggctggagcctaattgggcctctgtaaagaaagatctcatttcctacggcggcgggtggcgactgagcgcacagtggcaaaagggagaagaggtccaggtgatcgctgttgaaccaggtaagaaccccaaaaatttccagacgatgcctggcattttccagacaactaccggggagatcggagccatagcgcttgactttaagccgggcacatcgggttcaccaatcattaaccgcgaagggaaagtggtcggattatatggcaatggcgtggttaccaagaacgggggatacgtgtctggtatcgcccaaactaatgcagagcccgatggccctaccccagagctggaagaggaaatgttcaaaaagcggaacctcacaattatggacttgcaccccgggagtggaaagacgagaaaatatctgcctgctatcgtcagggaggccataaagcgtcgcctccggactctgattcttgctccgaccagagtggtagcagccgaaatggaggaggccctgaaaggcttgcccatcaggtaccagacaaccgctactaagtccgaacatacaggtcgagagatcgtggatctaatgtgccacgcgacctttacgatgcggctgctcagcccagttcgcgtccctaattataacttagtgattatggacgaagcacatttcactgatcccgcctctatcgctgccagagggtacataagcacaagggtgggaatgggcgaggcagccgctatttttatgaccgcgaccccacctggcactgccgaagcattcccccagtccaatgctccaatccaggacgaggagcgggacattccggaacgatcatggaacagtgggaatgagtggatcacagattttgtcggaaaaaccgtatggttcgtgcctagcataaaggccggtaacgacattgcaaactgtctgagaaagaatggcaaaaaggttatccaactttctcgcaaaacatttgatactgaatatcagaagacgaggctgaacgactgggatttcgtggtcaccacagacatctccgagatgggggccaattttaaagctgatcgtgtgattgacccccggagatgcctcaagccagttatcttgactgatggacccgagagggtgattctggccggccctatgccagtcaccgcggcatcagccgctcagcgccgaggtagagtggggcggaacccccagaaggaaaatgaccaatacatattcacaggccagcctctcaacaatgatgaggaccacgcccactggaccgaagctaaaatgctgcttgacaacatcaatactccggagggaattatcccagcactattcgaacccgagagggagaagagtgccgctatcgatggcgaataccgcctgaaaggggagagccgtaagacgtttgtagaattgatgagacggggagacttacctgtgtggctggcccataaagttgcatccgagggtattaagtataccgataggaaatggtgcttcgacggcgaacgcaacaatcagatactcgaggagaacatggatgtcgaaatctggacaaaggagggggaacgaaagaaactgagaccccggtggcttgacgcgaggacttactctgatccactggccctcaaggagtttaaagacttcgctgccggacgcaagtcgattgcattggatctggtgaccgaaatcggcagagtgcctagccacctagctcataggacacggaatgccctggacaacctcgtcatgcttcacacctcagagcacggtgggcgtgcatatcgccatgccgttgaggaactgcccgagactatggaaacattattgctgctcggcctgatgattcttctgacgggaggcgctatgctctttttgatctccgggaaaggaataggtaagaccagtatcggcctgatttgtgtgatcgtatctagcgggatgttatggatggcggatgtgccactacagtggattgcctccgcaatcgtcctggagttctttatgatggtgctccttatacctgagccggaaaagcaacgaactccccaggacaatcagctggcttacgttgtgattggaatcttgacactggccgccattgtcgcagctaacgagatgggcctcctggaaaccaccaaaagagatcttggtatgtcaaaggagccaggggtagtgtctcctacaagctatctcgacgttgacctgcaccccgccagtgcgtggactttgtacgctgtggccacgaccgtcatcacaccaatgctgaggcatactatagaaaattccaccgcaaacgtgagcttagccgctatcgcaaaccaagccgtcgtgctaatgggcctggataaaggatggcctatttctaagatggacctcggcgttccccttctggcgttggggtgctattcacaggtgaatccgctgacactcaccgctgccgtactgcttttagtgactcactacgcaatcattggaccaggcctgcaggccaaagctacgcgggaggcccagaagcgcacagcagctggtatcatgaagaaccctaccgtcgatgggataatgactattgacctcgatcccgttatctacgactccaaattcgagaagcaattgggacaggtgatgctgctagtcctgtgtgccgtgcagctccttctgatgagaaccagttgggcgttgtgcgaagccctgacactcgcaactggcccaatcaccacactgtgggagggtagccccggcaaattttggaatacgaccattgctgtatcgatggccaacatcttcagggggtcttatttagcaggagctggccttgccttttccataatgaaaagcgtggggactggacggcgaggcacaggttcacagggggaaaccctgggagagaaatggaagaagaaactcaatcaactaagtagaaaggagttcgatctgtacaaaaagtctggcattactgaggttgaccgcacagaggccaaagaaggtttgaagaggggcgagaccacgcatcacgcggtgtcccgggggagcgctaaactgcagtggtttgtcgaacgtaacatggtgatccctgagggaagagtcattgatctcggctgtgggaggggaggctggtcatattactgcgcaggtcttaagaaggtgaccgaagttcgcgggtatacaaaaggaggcccgggccacgaggagcccgtaccaatgagtacttacgggtggaatatcgtgaagctgatgagcggaaaagacgtcttctatttgcctcccgaaaagtgtgataccctgctctgcgacataggtgagtcctctcctagcccaacagtggaagagtcccggactatccgagttttaaaaatggtggagccctggctgagaaacaatcagttctgtattaaggtccttaacccttacatgccaaatgtgatcgaacatctggagaggctacagcgcaagtacggcgggatgctcgtacggaaccccctgtcaagaaattctacccacgaaatgtattggattagtaacggaacaggcaatatcgtgtcgagcgttaacatggtctcccgtttgctgctcaacaggtttaccatgactcatcggcgcccgacgattgagaaagatgtggaccttggtgccgggacacgacacgtgaatgctgaacctgagaccccaaacatggacgtcatcggagagagaataaagaggattaaagaagaacactcttcaacttggcattacgatgacgaaaatccctataagacctgggcctaccacggcagctatgaggttaaagcaacaggctccgccagttctatgatcaacggggtggtaaagctgttaacgaagccttgggatgtggtcccaatggtgacccaaatggctatgactgacacaacccccttcggacagcagcgggtttttaaagaaaaggtggatactcgcacaccgagacctatgcccggtaccaggaaagtcatggagatcacagcggagtggctgtggcgaactttgggccggaataagaaaccacgtctctgcaccagagaagagttcacgaagaaggtgcgcaccaacgccgcaatgggggctgtatttacagaagagaatcaatgggacagcgccagggcagccgttgaagatgaggagttctggaaactggtggacaaggaacgggagctacataaacttggaaagtgtggctcatgcgtctacaacatgatgggtaaaagagaaaagaaactgggggagtttggaaaggctaagggctcccgcgccatttggtatatgtggctcggcgcgaggttcctggagtttgaagcattggggttcctgaatgaggatcactggtttagtcgagaaaacagctactctggagtggagggtgaaggcctccataaacttgggtacatactgcgggacatctccaagattcctggaggcgccatgtatgctgatgacactgccggttgggacaccagaatcacagaggatgacttacacaatgaggagaagattactcagcagatggatcccgagcacaggcagctggcaaacgctatcttcaagttgacctaccaaaataaagtggtcaaggttcagcgcccaacgcccaaggggacagtgatggacataatctcacgtaaagatcagcggggaagcggccaggtaggcacctatgggctcaacacttttacaaatatggaagcccaactggtgagacagatggagggagaaggtgtcctatcggaggctgaccttgagaaccctcatctgctcgaaaagaaaattacccagtggctggagactaagggcgtggaaaggttgaaacgcatggccatctctggggatgactgcgttgtgaagccaattgatgaccgattcgcaaacgcgttactggccctcaatgatatgggaaaggtccggaaagacatcccgcagtggcaacccagtaagggctggcacgattggcaacaggtgcctttctgttcccatcactttcacgagcttataatgaaagacggtagaaagctggtagttccatgcaggccccaggacgaactaattgggcgcgctagaatcagccaaggagccggctggtcactgaaagagaccgcatgtctcggcaaggcttacgcccagatgtggtccttgatgtatttccatcggagggatctgcgtcttgcatctaacgccatctgcagcgcggtgcctgtccactggattccaacaagtcgaacgacctggtccatacatgctcaccatcagtggatgactacagaggacatgctgaccgtgtggaatcgcgtttggatcgaagataacccctggatgggggacaagactcctgtgacaacctgggaggatgtcccgtacctcggaaaaagagaagaccaatggtgtggtagcttaattggcctgacgtctcgggccacatgggcacagaatatcttgaccgccattcaacaggtgaggtcactgatcggggatgaggagtttctcgactatatgccaagtatgaagcgcttcagaaaagaagaggaatccgagggagctatatggtga

SEQ ID NO: 15204 - RNA, 9873 nt, synthetic construct
  misc_feature 1..9873: note = derived and/or modified CDS sequence (opt3) from DENV-3__GU131914__SS-prME
  source 1..9873: mol_type = other RNA
accagcctgtgcctcatgatgatgcttcccgcaacactggctttccacttgacttccagagacggcgaacctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtcgccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccatcaatatagaagcagagccgcctttcggcgaaagcaacattgtgatcggaatcggcgacaaagccctcaagattaattggtataagaaagggagttctatcggaaagatgtttgaggctaccgcccgcggtgcaagaaggatggccattctgggcgatacagcttgggacttcgggtccgttggaggcgtgcttaacagcctgggtaaaatggtccatcagatatttgggtcggcctacactgcattgttctctggcgtgtcctggatcatgaagattggaatcggcgtactcctgacctggatcgggttaaatagtaaaaacacgtcaatgagcttttcctgcattgtgataggaatcattacactgtatctaggcgcggttgtccaggctgatatgggttgtgtgatcaattggaaggggaaggaactcaaatgcggaaacggcattttcgtgaccaatgaggtccacacttggacagagcagtacaagtttcaagccgactctcccaaacggctggcaaccgccatcgctggtgcctgggaaaacggcgtttgtgggatacgaagcactacccgcatggagaatcttttgtggaagcagatcgcaaacgaactgaattatattctctgggagaacaatatcaaactgacagtggtggtaggagatattatcggcgtcttagaacaggggaagagaacgctgaccccacagcctatggagcttaaatactcatggaagacttggggaaaggctaaaatagtgacagccgagacccaaaacagttccttcattatcgacggccccaacacaccagaatgccccagcgcgtctagggcctggaatgtttgggaggtggaagactatggttttggggtcttcactaccaacatttggttgaagctccgggaggtgcatacgcagtcatgtgatcaccgcctgatgagtgctgcaatcaaagacgaaagagccgttcacgctgatatgggatactggatagagagccagaagaatggctcctggaaactagagaaggcctcttttatcgaagtgaagacatgcacctggcctaaatcgcatactctgtggagcaacggtgtactcgagtccgacatgattatcccaaagtcactggcaggcccgattagtcagcacaatcataggcccgggtaccacacccaaacagcgggaccttggcaccttggcaaattggaactggatttcaactattgcgaggggactaccgtcgtgatcgccgagaattgtggaacacgtggcccatctttacggacgaccactgtgagcggtaagctcatacatgaatggtgctgtcgatcctgcacactgccccctcttagatacatgggggaggacggatgttggtatggcatggaaattaggccaatcaacgagaaagaagagaatatggtcaagtcactggttagcgctggttctggcaaggtggataactttaccatgggggtattgtgcctcgccatcctgttcgaggaagtgatgcgcggaaaattcggcaagaaacacatgattgcaggggtcctatttactttcgtgctgctcctgtccggacagatcacatggcgggacatggctcatacccttattatgataggcagtaatgccagcgatagaatgggtatgggggttacgtacttggcactgatcgccacttttaagattcagcccttcttagctctcggatttttcctgaggaaacttacctctcgcgagaacctgctactcggcgtgggcctggcgatggccacaaccttgcaactgccggaagacatcgagcagatggcaaatgggattgctttaggactcatgactctgaaacttatcacacagtttgaaacctatcagctgtggacagccttggtctccctcacttgttcaaacaccatattcacgctgacagtggcctggcgaaccgctactctaatcctggcgggtgttagtcttctccctctgtgccaaagctcgtccatgcggaagaccgattggttgccaatgacagtggccgcgatgggcgtaccccctctgcccttatttattttctctctcaaagacactccaaagcgtaaaagctggcctctgaatgagggggtaatggctgtgggacttgtttcaatcctggccagttccttgctcagaaacgatgtgcccatggcaggcccactggtcgccggtgggctactgattgcttgttacgtgatcaccggaacgtctgcagaccttacagtagagaaggccgcggacgtgacctgggaagaggaagctgagcagactggcgtcagccacaacctcatgataacagttgatgacgatggcaccatgaggattaaagacgatgaaactgagaatatcctgacagtgttgttaaagaccgccctgctcatcgtgtccgggatttttccgtattcaatacctgcaacgctgcttgtctggcatacttggcagaaacagacccaacgcagcggagtgctgtgggacgttcccagtccacccgagacacagaaggccgaattggaggaaggtgtataccggatcaagcagcagggcattttcgggaaaacccaagtgggagtcggcgtgcagaaggagggtgtttttcacacaatgtggcacgtgactagaggggctgtcctaacccataacggaaaaaggctggagcctaattgggcctctgtgaagaaagatctcatctcctacggcggcgggtggcgactgagcgcacagtggcaaaagggagaagaggtacaggtcattgctgtggaaccaggtaagaaccccaaaaatttccagacgatgcctggcatcttccagacaactaccggggagataggagccatcgcgcttgactttaagccgggcacatcgggttcaccaattatcaaccgcgaagggaaagttgtgggattatatggcaatggcgtcgtgaccaagaacgggggatacgtttctggtattgcccaaactaatgcagagcccgatggccctaccccagagctggaagaggaaatgttcaaaaagcggaacctcacaatcatggacttgcaccccgggagtggaaagacgagaaaatatctgcctgctatagtgagggaggccattaagcgtcgcctccggactctgatccttgctccgaccagagtcgtggcagccgaaatggaggaggccctgaaaggcttgcccatcaggtaccagacaaccgctactaagtccgaacatacaggtcgagagattgtagatctaatgtgccacgcgacctttacgatgcggctgctcagcccagtgcgcgttcctaattataacttagtcatcatggacgaagcacatttcactgatcccgcctctatagctgccagagggtacattagcacaagggtgggaatgggcgaggcagccgctatctttatgaccgcgaccccacctggcactgccgaagcattcccccagtccaatgctccaattcaggacgaggagcgggacatcccggaacgatcatggaacagtgggaatgagtggataacagattttgtgggaaaaaccgtctggttcgtacctagcattaaggccggtaacgacatcgcaaactgtctgagaaagaatggcaaaaaggtgatccaactttctcgcaaaacatttgatactgaatatcagaagacgaggctgaacgactgggatttcgttgtgaccacagacatttccgagatgggggccaattttaaagctgatcgtgtcatcgacccccggagatgcctcaagccagtgattttgactgatggacccgagagggttatactggccggccctatgccagtgaccgcggcatcagccgctcagcgccgaggtagagtcgggcggaacccccagaaggaaaatgaccaatacatcttcacaggccagcctctcaacaatgatgaggaccacgcccactggaccgaagctaaaatgctgcttgacaacattaatactccggagggaatcatcccagcactattcgaacccgagagggagaagagtgccgctattgatggcgaataccgcctgaaaggggagagccgtaagacgtttgtggaattgatgagacggggagacttacctgtatggctggcccataaagtggcatccgagggtataaagtataccgataggaaatggtgcttcgacggcgaacgcaacaatcagatcctcgaggagaacatggatgttgaaatttggacaaaggagggggaacgaaagaaactgagaccccggtggcttgacgcgaggacttactctgatccactggccctcaaggagtttaaagacttcgctgccggacgcaagtcgatcgcattggatctggtcaccgaaattggcagagtgcctagccacctagctcataggacacggaatgccctggacaacctcgtgatgcttcacacctcagagcacggtgggcgtgcatatcgccatgccgtcgaggaactgcccgagactatggaaacattattgctgctcggcctgatgatccttctgacgggaggcgctatgctctttttgatatccgggaaaggaatcggtaagaccagtattggcctgatctgtgttattgtgtctagcgggatgttatggatggcggatgtaccactacagtggatcgcctccgcaatagtgctggagttctttatgatggtcctccttattcctgagccggaaaagcaacgaactccccaggacaatcagctggcttacgtggttatcggaattttgacactggccgccatcgtggcagctaacgagatgggcctcctggaaaccaccaaaagagatcttggtatgtcaaaggagccaggggtcgtatctcctacaagctatctcgacgtggacctgcaccccgccagtgcgtggactttgtacgctgttgccacgaccgtgataacaccaatgctgaggcatactatcgaaaattccaccgcaaacgtcagcttagccgctattgcaaaccaagccgtggtcctaatgggcctggataaaggatggcctatctctaagatggacctcggcgtgccccttctggcgttggggtgctattcacaggttaatccgctgacactcaccgctgccgtgctgcttttagtaactcactacgcaattatcggaccaggcctgcaggccaaagctacgcgggaggcccagaagcgcacagcagctggtataatgaagaaccctaccgtggatgggattatgactatcgacctcgatcccgtcatctacgactccaaattcgagaagcaattgggacaggttatgctgctagtgctgtgtgccgtccagctccttctgatgagaaccagttgggcgttgtgcgaagccctgacactcgcaactggcccaattaccacactgtgggagggtagccccggcaaattttggaatacgaccatcgctgtgtcgatggccaacatattcagggggtcttatttagcaggagctggccttgccttttccattatgaaaagcgtagggactggacggcgaggcacaggttcacagggggaaaccctgggagagaaatggaagaagaaactcaatcaactaagtagaaaggagttcgatctgtacaaaaagtctggcatcactgaggtggaccgcacagaggccaaagaaggtttgaagaggggcgagaccacgcatcacgcggtttcccgggggagcgctaaactgcagtggtttgtggaacgtaacatggtcattcctgagggaagagtgatcgatctcggctgtgggaggggaggctggtcatattactgcgcaggtcttaagaaggtcaccgaagtgcgcgggtatacaaaaggaggcccgggccacgaggagcccgttccaatgagtacttacgggtggaatatagtaaagctgatgagcggaaaagacgtgttctatttgcctcccgaaaagtgtgataccctgctctgcgacatcggtgagtcctctcctagcccaacagtcgaagagtcccggactattcgagtgttaaaaatggttgagccctggctgagaaacaatcagttctgtatcaaggtgcttaacccttacatgccaaatgtcattgaacatctggagaggctacagcgcaagtacggcgggatgctcgtgcggaaccccctgtcaagaaattctacccacgaaatgtattggatcagtaacggaacaggcaatattgtatcgagcgtgaacatggtttcccgtttgctgctcaacaggtttaccatgactcatcggcgcccgacgatcgagaaagatgtcgaccttggtgccgggacacgacacgtgaatgctgaacctgagaccccaaacatggacgtgataggagagagaattaagaggatcaaagaagaacactcttcaacttggcattacgatgacgaaaatccctataagacctgggcctaccacggcagctatgaggtcaaagcaacaggctccgccagttctatgatcaacggggttgtgaagctgttaacgaagccttgggatgtagtgccaatggtcacccaaatggctatgactgacacaacccccttcggacagcagcgggtgtttaaagaaaaggttgatactcgcacaccgagacctatgcccggtaccaggaaagtgatggagattacagcggagtggctgtggcgaactttgggccggaataagaaaccacgtctctgcaccagagaagagttcacgaagaaggtccgcaccaacgccgcaatgggggctgtgtttacagaagagaatcaatgggacagcgccagggcagccgtagaagatgaggagttctggaaactggttgacaaggaacgggagctacataaacttggaaagtgtggctcatgcgtgtacaacatgatgggtaaaagagaaaagaaactgggggagtttggaaaggctaagggctcccgcgccatatggtatatgtggctcggcgcgaggttcctggagtttgaagcattggggttcctgaatgaggatcactggtttagtcgagaaaacagctactctggagtcgagggtgaaggcctccataaacttgggtacatcctgcgggacatttccaagatccctggaggcgccatgtatgctgatgacactgccggttgggacaccagaattacagaggatgacttacacaatgaggagaagatcactcagcagatggatcccgagcacaggcagctggcaaacgctatattcaagttgacctaccaaaataaagtggtgaaggtccagcgcccaacgcccaaggggacagttatggacatcatttcacgtaaagatcagcggggaagcggccaggtgggcacctatgggctcaacacttttacaaatatggaagcccaactggtaagacagatggagggagaaggtgtgctatcggaggctgaccttgagaaccctcatctgctcgaaaagaaaatcacccagtggctggagactaagggcgtcgaaaggttgaaacgcatggccatttctggggatgactgcgtggttaagccaatcgatgaccgattcgcaaacgcgttactggccctcaatgatatgggaaaggtgcggaaagacataccgcagtggcaacccagtaagggctggcacgattggcagcaggtccctttctgttcccatcactttcacgagcttattatgaaagacggtagaaagctggtggtaccatgcaggccccaggacgaactaatcgggcgcgctagaatcagccaaggagccggctggtcactgaaagagaccgcatgtctcggcaaggcttacgcccagatgtggtccttgatgtatttccatcggagggatctgcgtcttgcatctaacgccatttgcagcgcggttcctgtgcactggataccaacaagtcgaacgacctggtccatccatgctcaccatcagtggatgactacagaggacatgctgaccgtctggaatcgcgtgtggattgaagataacccctggatgggggacaagactcctgttacaacctgggaggatgtgccgtacctcggaaaaagagaagaccaatggtgtggtagcttaatcggcctgacgtctcgggccacatgggcacagaatattttgaccgccatccagcaggtcaggtcactgataggggatgaggagtttctcgactatatgccaagtatgaagcgcttcagaaaagaagaggaatccgagggagctatctggtga

SEQ ID NO: 15205 - RNA, 9873 nt, synthetic construct
  misc_feature 1..9873: note = derived and/or modified CDS sequence (opt3) from DENV-3__GU131915__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagctgagccggaagacattgattgctggtgtaaccttaccagtacatgggttacctatgggacttgcaatcaggccggagagcatcgccgagacaagcgtagcgtggcactggccccccacgtaggcatgggtttggatacaagaacccaaacgtggatgtccgctgagggggcatggaggcaggtggaaaaagtcgagacttgggccctccggcatcctggattcaccatcctggctctgtttctcgcccactacattggcacatctttaactcagaaggtggttatcttcatactgcttatgttggtgaccccatcgatgacaatgcgctgtgtcggcgtggggaacagagactttgtagaaggactgtcaggtgcgacctgggttgatgtggtcctagagcatggcgggtgcgtgacgactatggcaaagagcaaacccacactcgacatcgagctgcagaagaccgaagccactcaacttgctacactgaggaaattgtgtattgagggaaagatcaccaatattacgaccgatagtcggtgccctacacagggcgaagccactctcccagaggaacaggaccagaactatgtgtgtaaacacacctacgtcgatcgcggttgggggaatggatgcggcctgttcggcaaggggtccttagttacatgcgcaaagtttcaatgtctggagcccatcgagggaaaagtggtacagcacgaaaacctcaagtatactgtgataattaccgtccatacaggtgaccagcaccaggtgggcaatgacacccaaggggttactgtggagatcacgcctcaggcttctacagtcgaagccgtgcttccagagtacggaaccctgggcttggaatgcagcccgcgaactggtctagatttcaacgagatgattctgctcaccatgaaaaataaggcgtggatggtacatagacagtggtttttcgacctgccccttccttggacatccggggccaccactgagacaccaacgtggaacaggaaagaactgttggttacctttaagaatgcacacgctaaaaagcaagaggtggtcgtgctcggctcacaggaaggagccatgcacactgctctgacaggcgccaccgagatccagaacagtgggggaacaagcatcttcgcaggtcatttaaagtgtcggctgaaaatggataagctagaactcaaaggcatgtcttatgccatgtgcctgaatacttttgtccttaagaaagaggtgtccgagacccagcacgggacgattttgataaaggttgaatacaagggagaggacgctccctgtaaaatccctttctcaaccgaagatggccaaggtaaggcgcatagcgggcgtctgattacagcaaacccagtggtaactaaaaaggaggagcccgtcaacatcgaagccgagccgcctttcggcgaaagtaatatagtgattggaatcggcgacaaagctctcaagatcaactggtacaagaaagggtcttccattggaaagatgtttgaggccaccgcacgcggtgccagaaggatggctatcctgggcgatacagcctgggacttcgggagcgttggaggcgtgcttaattcgctgggtaaaatggtccaccagatttttgggtctgcatatactgcgttgttctccggcgtgtcatggataatgaagatcggaattggcgtactcctgacctggatcgggttaaacagtaaaaatacgagcatgtccttttcttgcatcgtgattggaataatcacactgtacctaggcgctgttgtccaggccgatatgggttgtgtgattaactggaaggggaaggaactcaaatgcggaagcggcatcttcgtgaccaatgaggtccatacttggacagagcagtataagtttcaagcagactcacccaaacggctggccaccgctattgccggtgcatgggaaaacggcgtttgtgggatccgaagtactacccgcatggagaatcttttgtggaagcagatagctaacgaactgaattacatcctctgggagaacaatattaaactgacagtggtggtaggagatatcattggcgtcttagaacaggggaagagaacgctgaccccacagcctatggagcttaaatattcctggaagacttggggaaaggccaaaatcgtgacagcggagacccaaaacagctctttcataattgacggccccaatacaccagaatgcccctcagccagtagggcttggaacgtttgggaggtggaagactacggttttggggtcttcactaccaacatctggttgaagctccgggaggtgtatacgcagagctgtgatcaccgcctgatgtccgcagccattaaagacgaaagagctgttcacgccgatatgggatactggatcgagtctcagaagaatggctcgtggaaactagagaaggcaagctttatagaagtgaagacatgcacctggcctaaatcccatactctgtggtcaaacggtgtactcgagagtgacatgatcattccaaagtctctggcgggcccgatcagccagcacaatcataggcccgggtaccacacccaaacagccggaccttggcaccttggcaaattggaactggatttcaactattgcgaggggactaccgtcgtgattacagagaattgtggaacgcgtggcccatccttacggaccactacagtgtcaggtaagctcatccatgaatggtgctgtcgaagctgcaccctgccccctcttagatacatgggggaggacggatgttggtatggcatggaaataaggccaattaacgagaaagaagagaatatggtcaagtctctggtttccgctggtagtggcaaggtggataactttactatgggggtattgtgcctcgccatcctgttcgaggaagtgatgcgcggaaaattcggcaagaaacacatgatcgcaggggtcctatttacattcgtgctgctcctgagcggacagattacctggcgggacatggctcatacgcttatcatgattggctctaatgcctccgatagaatgggtatgggggttacttacttggcactgatagccacctttaagatccagcccttcttagctctcggatttttcctgaggaaacttacatcacgcgagaacctgctactcggcgtgggcctggcgatggccaccactttgcaactgccggaagacattgagcagatggcaaatgggatcgctttaggactcatgacactgaagcttattacccagtttgaaacatatcagctgtggactgccttggtcagtctcacctgtagcaacacgatcttcacactgaccgtggcctggcgaactgctaccctaatactggcaggtgtttcgcttctccctctgtgccaatcctctagcatgcggaagacagattggttgccaatgactgtggccgcgatgggcgtcccccctctgcccttatttatcttctcactcaaagacaccccaaagcgtagaagttggcctctgaatgagggggtaatggctgtgggacttgtttccattctggcctctagcttgctcaggaacgatgtgcccatggcaggcccactggtcgccggtgggctactgatcgcttgttacgtgattacgggaacatccgcagaccttaccgtagagaaagccgcggacgtgacttgggaagaggaagctgagcagacaggcgtctcacacaatctcatgatcaccgttgatgacgatggcactatgcgcataaaggacgatgaaacagagaacattctgaccgtgttgttaaaaacggccctgctcatcgtgagcgggatctttccgtatagtattcctgcaactctgcttgtctggcatacctggcagaagcagacacaacggtctggagtgctgtgggacgttccctccccacccgagacccagaaagccgaattggaggaaggtgtatacagaataaagcagcagggcatcttcgggaagacacaagtgggagtcggcgtgcagaaagagggtgtttttcacactatgtggcacgtgaccaggggggctgtcctaacgcataacggaaagcgactggagcctaattgggccagcgtgaaaaaggatctcatttcgtacggcggcgggtggcgcctgaacgcacagtggcaaaaaggagaagaggtacaggtcatcgctgtggaaccaggtaagaatcccaagaacttccagacaatgcctggcattttccagactaccacaggggagatcggagccatagcgcttgactttaaaccgggcacctcaggttctccaatcattaatcgggaagggaaggttgtgggattatatggcaacggcgtcgtgactaaaaatgggggatacgttagtggtatcgcccaaaccaacgcagagcccgatggccctacaccagagctggaagaggaaatgttcaagaaaagaaatctcacgattatggacttgcaccccgggtccggaaagactaggaagtatctgcctgctatcgtgcgtgaggccataaaacgccggctcagaaccctgattcttgctccgacaagggtcgtggcagccgaaatggaggaggccctgaagggcttgcccatccgataccagaccactgctacaaaaagcgaacataccggtcgggagatcgtagatctaatgtgccacgcgacgtttactatgcgcctgctctctccagtgagagttcctaactataatttagtcattatggacgaagcacatttcacagatcccgccagcatcgctgccagggggtacatatccacccgggtgggaatgggcgaggcagccgctatttttatgaccgcgactccacctggcacagccgaagcattcccccagtcaaacgctccaatccaggacgaggagcgagacattccggaaagaagttggaatagcgggaacgagtggatcaccgattttgtgggaaagacagtctggttcgtaccttctataaaagccggtaatgacattgcaaactgtctgcgcaagaacggcaagaaagtgatccaactttccaggaagacttttgatacggaatatcagaaaacccgtctgaatgactgggatttcgttgtgacaactgacatctcagagatgggggccaactttaaggctgatcgggtcattgaccccagaaggtgcctcaaaccagtgatcttgaccgatggacccgagcgcgttattctggccggccctatgccagtgacagcggcaagtgccgctcagcgaagaggtcgggtcgggaggaatccccagaaggaaaacgaccaatacatattcaccggccagcctctcaataacgatgaggaccacgcccactggactgaagctaagatgctgcttgacaatatcaacacgccggagggaattatcccagcactattcgaacccgagcgcgagaaaagcgccgctatcgatggcgaataccgtctgaagggggagtccagaaaaacctttgtggaattgatgcggaggggagacttacctgtatggctggcccataaggtggcatctgagggtattaaatatacagatcgcaagtggtgcttcgacggcgaacgaaataaccagatactcgaggagaatatggatgttgaaatctggactaaagagggggaaagaaagaagctgcggcccaggtggcttgacgcgcgcacctactcggatccactggccctcaaagagtttaaggacttcgctgccggaagaaaaagcattgcattggatctggtcacagaaatcggcagggtgccttcacacctagctcatcggacccgtaacgccctggacaatctcgtgatgcttcacacttccgagcacggtgggcgcgcatatcgacatgccgtcgaggaactgcccgagacaatggaaacgttattgctgctcggcctgatgattcttctgaccggaggcgctatgctctttttgatcagtgggaagggaataggtaaaacttctatcggcctgatttgtgttatcgtgagctccgggatgttatggatggcggatgtaccactacagtggattgcctcagcaatcgtgctggagttctttatgatggtcctccttatacctgagccggaaaagcaaagaacaccccaggacaaccagctggcttacgtggttattggaatcttgaccctggccgccattgtggcagctaatgagatgggcctcctggaaaccacaaagagggatcttggtatgtctaaagagccaggggtcgtaagccctactagttatctcgacgtggacctgcaccccgcctccgcgtggacgttgtacgctgttgccaccacagtgatcactccaatgctgcggcataccatagaaaacagcacagcaaatgtctctttagccgctatcgcaaaccaagccgtggtcctaatgggcctggataagggatggcctatttcaaaaatggacctcggcgtgccccttctggcgttggggtgctattcccaggttaacccgctgaccctcactgctgccgtgctgcttttagtaacgcactacgcaatcattggaccaggcctgcaggccaaggctacacgcgaggcccagaaaagaaccgcagctggtatcatgaagaatcctactgtggatgggataatgaccattgacctcgatcccgtcatctacgacagtaagttcgagaaacaattgggacaggttatgctgctagtgctgtgtgccgtccagctccttctgatgaggacaagctgggcgttgtgcgaagccctgactctcgcaaccggcccaatcacaacgctgtgggagggttcgcccggcaagttttggaacaccactattgctgtgtctatggccaatatcttccgggggtcctatttagcaggagctggccttgcctttagcataatgaaatcagtagggacaggacgaagaggcaccggtagtcagggggaaactctgggagagaagtggaaaaagaagctcaaccaactatctcgcaaagaattcgatctgtacaagaaatccggcattacagaggtggacaggaccgaggccaaggaaggtttgaaacggggcgagacgacccatcacgcggttagccgtgggtcagctaagctgcagtggtttgtggaaagaaatatggtcatccctgagggaagggtgattgatctcggctgtgggcgcggaggctggagttattactgcgcaggtcttaaaaaggtcacagaagtgcgggggtatactaagggaggcccgggccacgaggagcccgttccaatgagcacctacgggtggaacatcgtaaaactgatgtccggaaaggacgtgttctatttgcctcccgaaaaatgtgatacactgctctgcgacataggtgagtctagcccttccccaactgtcgaagagtcacgaaccatcagagtgttaaagatggttgagccctggctgaggaataaccagttctgtattaaagtgcttaatccttacatgccaacagtcatcgaacatctggagcgcctacagcggaagtacggcgggatgctcgtgagaaaccccctgtctcgtaatagtacccacgaaatgtattggatttcgaacggaactggcaatatcgtaagctccgtgaacatggtttctaggttgctgctcaatcggtttacgatgacacatcgccgaccgaccattgagaaggatgtcgaccttggtgccgggactagacacgtgaacgctgaacctgagaccccaaacatggacgtgatcggagagaggataaaacggattaaggaagagcactcaagcacatggcattacgatgacgaaaatccctataaaacgtgggcctaccacggctcctatgaggtcaaggcaaccggcagtgcctctagcatgatcaacggggttgtgaaactgttaactaagccttgggatgtagtgccaatggtcacacaaatggctatgaccgacactacacccttcggacagcagcgcgtgtttaaggaaaaagttgataccagaacaccgaggcctatgcccggtactcgaaaggtgatggagatcaccgcggagtggctgtggcggacgttgggccgtaataaaaagccaagactctgcacccgcgaagagttcacaaaaaaggtcaggactaacgccgcaatgggggctgtgtttaccgaagagaatcaatgggactcagcccgggcagccgtagaagatgaggagttctggaagctggttgacagagaacgcgagctacataaacttggaaagtgtggctcctgcgtgtacaacatgatgggtaaaagggaaaagaaactgggggagtttggaaaggctaaaggcagtcgagccatttggtatatgtggctcggcgcgcggtacctggagttcgaagcattggggtttctgaatgaggatcactggttcagcagagaaaactcttactccggagtcgagggtgaaggcctccataagcttgggtatatactgagggacatctcaaagattcctggaggcgccatgtacgctgatgacacagccggttgggacactcgcatcaccgaggatgacttacacaatgaggaaaaaattacgcagcagatggatcccgagcaccgtcagctggcaaacgctatctttaagttgacatatcaaaataaagtggtgaaggtccagcggccaacccccaaagggactgttatggacataatcagcagaaaggatcagaggggatcgggccaggtgggcacatacgggctcaacaccttcactaatatggaagcccaactggtacgccagatggagggagaaggtgtgctatctaaggctgaccttgagaaccctcatctgctcgagaaaaagattacccagtggctggaaacaaaaggcgtcgagcgattgaagcggatggccatcagtggggatgactgcgtggttaaaccaattgatgacagatttgcaaatgcgttactggccctcaacgatatgggaaaggtgaggaaggacatcccgcagtggcaaccctccaaaggctggcacgattggcagcaggtccctttctgtagccatcacttccacgaacttataatgaaggacggtcgcaaactggtggtaccatgcagaccccaggacgagctaattgggcgggctaggatctcacaaggagccggctggtccctgaaggaaacggcatgtctcggcaaagcttatgcccagatgtggtctttgatgtactttcatcgtcgagatctgcgccttgcaagcaacgccatctgcagtgcggttcctgtgcactggattccaacctccagaactacatggagcatacatgctcaccatcagtggatgaccactgaggacatgctgacagtctggaatcgggtgtggatcgaggataacccctggatggaagacaagacccctgttacgacatgggaggatgtgccgtatctcgggaagagggaagaccaatggtgtggatctttaattggtctgacctcacgcgccacttgggcacagaatatcttgaccgccattcagcaggtcagaagtctgatcggcgatgaggagttcctcgactacatgccatccatgaaacggtttaggaaggaagaggaaagcgagggggctatatggtga

SEQ ID NO: 15206 - RNA, 9873 nt, synthetic construct
  misc_feature 1..9873: note = derived and/or modified CDS sequence (opt3) from DENV-3__GU131916__SS-prME
  source 1..9873: mol_type = other RNA
acaagcctgtgcctcatgatgatgcttccagccacactggctttccacttgacttccagagacggcgaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaattcaaagaacacgagtatgagcttttcctgcatcgttattggaataatcacactgtatctaggcgcggtcgtgcaggctgatatgggttgtgtgattaattggaaggggaaggaactcaaatgcggatctggcatcttcgtcaccaacgaggttcacacttggacagagcagtacaagtttcaagccgacagccccaaacggctggcaaccgccattgctggtgcctgggaaaatggcgtgtgtgggatccgatcaactacccgcatggagaaccttttgtggaagcagatagcaaatgaactgaactatatcctctgggagaataacattaaactgacagtggtagtcggagatatcattggcgtgttagaacaggggaagagaacgctgaccccacagcctatggagcttaaatacagttggaagacttggggaaaggctaaaatcgttacagccgagacccaaaattccagcttcataattgacggccccaacacaccagaatgcccctctgcgtcaagggcctggaacgtgtgggaggtcgaagactatggttttggggtgttcactaccaatatctggttgaagctccgggaggtttacacgcagagttgtgatcatcgcctgatgagcgctgcaattaaagacgaaagagccgtgcacgctgatatgggatactggatcgagtcccagaagaacggctcttggaaactagagaaggcctcgtttatagaagtaaagacatgcacctggcctaaaagccacactctgtggtccaatggtgtcctcgagtcagacatgatcattccaaagagtctggcaggcccgatctctcagcataaccacaggcccgggtatcatacccaaacagcgggaccttggcaccttggcaaattggaactggatttcaattactgcgaggggactaccgtggtgattacagagaactgtggaacgcgtggccccagcttacggaccactacagtctccggtaagctcatccacgaatggtgctgtcgatcatgcaccctgccccctcttagatatatgggggaggacggatgttggtacggcatggaaataaggccaattaatgagaaagaagagaacatggttaagagcctggtgtctgccggttccggcaaggtagataattttactatgggggtgttgtgcctcgctatcctgttcgaggaagtcatgcgcggaaaattcggcaagaaacatatgatcgccggggtgctatttacattcgttctgctcctgagtggacagattacctggcgggacatggcacacacgcttatcatgattggcagcaacgcttctgatagaatgggtatgggggtgacttatttggccctgatagcaacctttaagatccagcccttcttagccctcggatttttcctgaggaaacttacatcccgcgagaatctgctactcggcgtcggcctggctatggcgaccactttgcaactgccggaagacattgagcagatggccaacgggatcgcattaggactcatgacactgaaacttattacccagtttgaaacataccagctgtggactgctttggtgtcactcacctgtagtaatacgatcttcacactgaccgttgcctggcgaactgccaccctaatactggctggtgtgagccttctccctctgtgccaatcgtcctctatgcggaagacagattggttgccaatgactgtcgcagccatgggcgtaccccctctgcccttatttatcttcagcctcaaagacaccccaaagcgtagatcatggcctctgaacgagggggtgatggcggttggacttgtgagtattctggcttcctctttgctcaggaatgatgtccccatggccggcccactggtggcgggtgggctactgatcgcctgttatgtaattacgggaacaagcgctgaccttaccgtggagaaagcagccgacgtcacttgggaagaggaagcggagcagacaggcgtttcccataacctcatgatcaccgtggatgacgatggcactatgcgcataaaggacgatgaaacagagaacattctgaccgtgttgttaaaaacggctctgctcatcgtctcagggatctttccgtacagcattcctgccactctgcttgtgtggcacacctggcagaagcagacacaacggagtggagttctgtgggacgtaccctctccacccgagacccagaaagcagaattggaggaaggtgtgtacagaataaagcagcagggcatcttcgggaagacacaagtcggagtgggcgttcagaaagagggtgtgtttcatactatgtggcacgtcacccgaggggcagtgctaacgcacaatggaaagaggctggagcctaactgggcttccgtcaagaaggatctcattagctatggcggcgggtggcgcctgtcggcccagtggcaaaaaggagaagaggtccaggtgatcgcagttgaaccaggtaagaatcccaagaacttccagacaatgcctggcattttccagactaccacaggggagatcggagctatagcccttgactttaaaccgggcacctcaggttctccaatcattaatcgggaagggaaggtggtcggattatacggcaacggcgtgatcactaaaaatgggggatatgttagtggtattgcgcaaaccaacgccgagcccgatggccctacaccagagctggaagaggaaatgttcaagaaaagaaatctcacgatcatggacttgcatcccgggtccggaaagactaggaagtacctgcctgcaatagtgcgtgaggctattaaacgccggctcagaaccctgatccttgccccgacaagggtcgtggctgcagaaatggaggaggccctgaagggcttgcccatccgatatcagaccactgccacaaaaagcgaacacaccggtcgggagattgtagatctaatgtgccatgctacgtttactatgcgcctgctctctccagtgagagttcctaactacaatttagtcatcatggacgaagcgcacttcacagatcccgcaagcatagccgctagggggtatatttccacccgggtgggaatgggcgaggccgcagccatctttatgaccgctactccacctggcacagcggaagccttcccccagtcaaacgcaccaattcaggacgaggagcgagacatcccggaaagaagttggaatagcgggaacgagtggataaccgattttgtgggaaagacagtctggttcgtaccttctattaaagctggtaatgacatcgccaactgtctgcgcaagaacggcaagaaagtgatccaactttccaggaagacttttgatacggaataccagaaaacccgtctgaatgactgggatttcgttgtgacaactgacatttcagagatgggggcaaactttaaggccgatcgggtcatcgaccccagaaggtgcctcaaaccagtgattttgaccgatggacccgagcgcgttatactggctggccctatgccagtgacagccgcgagtgcagcccagcgaagaggtcgggtcgggaggaatccccagaaggaaaacgaccaatacatcttcaccggccagcctctcaataacgatgaggaccatgctcactggactgaagccaagatgctgcttgacaatattaacacgccggagggaatcatcccagctctattcgaacccgagcgcgagaaaagcgcagccattgatggcgaatatcgtctgaagggggagtccagaaaaacctttgtggaattgatgcggaggggagacttacctgtatggctggctcacaaggtggcctctgagggtataaaatacacagatcgcaagtggtgcttcgacggcgaacgaaataaccagatcctcgaggagaatatggatgttgaaatttggactaaagagggggaaagaaagaagctgcggcccaggtggcttgacgcacgcacctattcggatccactggcgctcaaagagtttaaggacttcgccgctggaagaaaaagcatcgccttggatctggtcacagaaattggcagggtgccttcacatctagcacaccggacccgtaacgctctggacaatctcgtgatgcttcatacttccgagcacggtgggcgcgcctaccgacacgcagtcgaggaactgcccgagacaatggaaacgttattgctgctcggcctgatgatccttctgaccagtggagccatgctctttttgatatctggcaaggggatcggaaaaactagcattggtctgatctgtgttattgtgtcctcaggcatgttatggatggctgatgtaccactacagtggatcgcgtctgccatagtgctggagttctttatgatggtcctccttattcctgagccggaaaagcaaagaacaccccaggacaaccagctggcatatgtggttatcgggattttgaccctggctgccatcgtggccgcaaatgagatgggactcctggaaaccacaaagagggatcttggcatgagcaaagagccaggtgtcgtaagtcctacttcctacctcgacgtggacctgcatcccgctagcgcctggacgttgtatgcggttgctaccacagtgataactccaatgctgcggcacaccatcgaaaactctacagccaatgtctcattagcagccattgctaaccaagcagtggtcctaatggggctggataagggctggcctatctccaaaatggacctcggagtgccccttctggccttgggctgctacagtcaggttaacccgctgaccctcactgcggctgtgctgcttttagtaacgcattacgccattatcgggccaggactgcaggcaaaggccacacgcgaggctcagaaaagaaccgccgcaggcataatgaagaatcctactgtggatggtattatgaccatcgacctcgatcccgtcatctatgacagcaagttcgagaaacaattggggcaggttatgctgctagtgctgtgtgctgtccagctccttctgatgaggacatcgtgggccttgtgcgaagcgctgactctcgccaccggaccaattacaacgctgtgggagggctctcccggtaagttttggaacaccactatcgcagtgtccatggctaatatattccggggcagctacttagccggggcaggacttgctttttcaattatgaaaagtgtaggcacagggcgaagaggaaccggctctcagggtgaaactctgggggagaagtggaaaaagaagctcaaccaactatcccgcaaagagttcgatctgtataagaaaagcggaatcacagaggtggacaggaccgaggccaaggaaggcttgaaacggggtgagacgacccaccatgccgtttcacgtggcagtgcgaagctgcagtggtttgtggaaagaaatatggtcattcctgaggggagggtgatcgatctcggatgtggccgcgggggatggagctactattgcgctggccttaaaaaggtcacagaagtgcggggttacactaaagggggaccgggccacgaggagcccgttccaatgtccacctatggctggaacatagtaaaactgatgtctgggaaggacgtgttctacttgcctcccgaaaaatgtgatacactgctctgcgacatcggagagagctccccttcaccaactgtcgaagagtctcgaaccattagagtgttaaagatggttgagccctggctgaggaataaccagttctgtatcaaagtgcttaatccttacatgccaacagtcattgaacacctggagcgcctacagcggaagtatggtggcatgctcgtgagaaaccccctgagtcgtaattcgacccatgaaatgtactggatcagcaacgggactggaaatattgtatcctctgtgaacatggtttcaaggttgctgctcaatcggtttacgatgacacaccgccgaccgaccatcgagaaggatgtcgaccttggcgcaggtactagacatgtgaacgccgaacctgagaccccaaacatggacgtgataggggagaggattaaacggatcaaggaagaacacagctccacatggcactatgatgacgaaaatccctacaaaacgtgggcttatcatggaagttacgaggtcaaggccaccggctctgcaagctcaatgatcaacggcgttgtgaaactgttaactaagccttgggatgtagtgccaatggtcacacaaatggccatgaccgacactacacccttcgggcagcagcgcgtgtttaaggaaaaagttgataccagaacaccgaggcctatgcccggaactcgaaaggtgatggagattaccgctgagtggctgtggcggacgttgggtcgtaataaaaagccaagactctgcacccgcgaagagttcaccaaaaaggtcaggactaacgcggccatgggcgcagtgtttaccgaagagaatcaatgggactccgctcgggccgcagtagaagatgaggagttctggaagctggttgacagagaacgcgagctacacaaacttgggaagtgtggaagttgcgtgtataacatgatgggcaaaagggaaaagaaactgggtgagtttgggaaggccaaaggaagccgagctatatggtacatgtggctcggcgcccggtacctggagttcgaagcgttgggctttctgaatgaggatcattggttctctagagaaaactcctattcaggggtcgagggagaaggtctccacaaacttggctacatcctgagggacattagcaagatccctgggggagcaatgtatgccgatgacacagctggctgggacactcgcattaccgaggatgacttacataatgaggagaaaatcacgcagcagatggatcccgagcaccgtcagctggccaacgcaatatttaagttgacataccaaaataaagtggtgaaggtccagcggccaacccccaaaggtactgttatggacatcatttcgagaaaggatcagagggggtctggacaggtgggcacatatggcctcaacaccttcactaatatggaagctcaactggtacgccagatggagggggaagacgtgctaagtaaggccgatcttgagaaccctcatctgctcgagaaaaagatcacccagtggctggaaacaaaaggagtcgagcgattgaagcggatggctatttccggtgacgattgcgtggttaaaccaatcgacgatagatttgccaatgcattactggcgctcaacgacatgggcaaggtgaggaaggatataccgcagtggcaacccagcaaagggtggcatgactggcagcaggtccctttctgttcacaccatttccacgaacttattatgaaggacggacgcaaactggtggtaccatgcagaccccaggatgagctaatcggccgggccaggatctcccaaggtgctgggtggtctctgaaggaaacggcctgtctcggaaaagcatacgctcagatgtggagcttgatgtattttcaccgtcgagacctgcgccttgccagtaacgcaatttgctccgccgttcctgtgcattggataccaaccagcagaactacatggtctatccacgcgcatcaccagtggatgaccactgaggatatgctgacagtctggaatcgggtgtggattgaggacaacccctggatggaagataagacccctgttacgacatgggaggacgtgccgtacctcggcaagagggaagatcaatggtgtggctcattaatcgggctgaccagtcgcgctacttgggcccagaatattttgaccgcaatccagcaggtcagatccctgataggagacgaggagttcagcgattacatgccatctatgaaacggtttaggaaggaagaggaatcggagggtgccatctggtga

SEQ ID NO: 15207 - RNA, 9873 nt, synthetic construct
  misc_feature 1..9873: note = derived and/or modified CDS sequence (opt3) from DENV-3__GU131917__SS-prME
  source 1..9873: mol_type = other RNA
accagcctgtgcctcatgatgatgcttcccgcaactctggctttccacttgacttccagggacggcgaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcaccctgcttatgttggtcacaccatcgatgaccatgcgctgtgtgggcgtagggaacagagactttgttgaaggactgtcaggtgccacgtgggtggatgtcgtgctagagcatggcgggtgcgtgactacaatggcaaagagcaaacccaccctcgacatagagctgcagaagactgaagcaacacagcttgccaccctgaggaaattgtgtatcgagggaaagattacgaatatcaccacagatagtcggtgccctactcagggcgaagctaccctcccagaggaacaggaccagaactatgtctgtaaacacacatacgttgatcgcggttgggggaatggatgcggcctgttcggcaaggggtccttagtgacttgcgccaagtttcaatgtctggagcccattgagggaaaagtagtgcagtatgaaaacctcaagtacaccgtcatcataacagtgcacaccggtgaccagcatcaggttggcaatgacactcaaggggtgacggtcgagattacacctcaggcatctaccgtggaagctgtacttccagagtatggaactctgggcttggaatgcagcccgcgaaccggtctagatttcaacgagatgatcctgctcacaatgaaaaataaggcctggatggttcacagacagtggtttttcgacctgccccttccttggacctccggggcgactacagagacgccaacctggaacaggaaagaactgttggtgacttttaagaatgcccatgccaagaagcaagaggtcgtggtcctcggctcacaggaaggagctatgcacacagccctgaccggcgctacagagattcagaacagtgggggaactagcatcttcgccggtcacttaaagtgtcggctgaaaatggataagctagaactcaaaggcatgtcttacgcaatgtgcctgaatacctttgtgcttaagaaagaggtttccgagacgcagcatgggaccatcttgattaaggtggaatacaagggagaggacgccccctgtaaaatacctttctcaacagaagatggccaaggtaaggctcacaacgggcgtctgatcactgcgaacccagtagtcaccaaaaaggaggagcccgtgaatattgaagcagagccgcctttcggcgaaagcaacatcgttataggaattggcgacaaagccctcaagatcaattggtataagaaagggagttctatcggaaagatgtttgaggctacagcccgcggtgcaagaaggatggccattctgggcgatactgcttgggacttcgggtccgtgggaggcgtccttaacagcctgggtaaaatggtgcatcagatctttgggtcggcctacaccgcattgttctctggcgtatcctggattatgaagataggaatcggcgtgctcctgacgtggattgggttaaatagtaaaaacacatcaatgagcttttcctgcatcgttatcggaattataaccctgtatctaggcgcggtcgtgcaggctgatatgggttgtgtgatcaattggaaggggaaggaactcaaatgcggaaacggcattttcgtcactaatgaggttcacacatggaccgagcagtacaagtttcaagccgactctcccaaacggctggcaactgccatcgctggtgcctgggaaaacggcgtgtgtgggattcgaagcaccacacgcatggagaatcttttgtggaagcagatcgcaaacgaactgaattatatactctgggagaacaatatcaaactgacggtggtagtcggagatattatcggcgtgttagaacaggggaagagaaccctgactccacagcctatggagcttaaatactcatggaagacatggggaaaggctaaaattgttaccgccgagacacaaaacagttccttcatcatagacggccccaacactccagaatgccccagcgcgtctagggcctggaatgtgtgggaggtcgaagactatggttttggggtgttcaccacgaacatttggttgaagctccgggaggtttacacacagtcatgtgatcatcgcctgatgagtgctgcaatcaaagacgaaagagccgtgcacgctgatatgggatactggattgagagccagaagaatggctcctggaaactagagaaggcctcttttatcgaagtaaagacctgcacttggcctaaatcgcacaccctgtggagcaacggtgtcctcgagtccgacatgataatcccaaagtcactggcaggcccgattagtcagcataatcacaggcccgggtatcatacacaaactgcgggaccttggcaccttggcaaattggaactggatttcaactactgcgaggggaccacagtggtgatcgccgagaattgtggaacgcgtggcccatctttacggaccactacagtcagcggtaagctcattcacgaatggtgctgtcgatcctgcaccctgccccctcttagatatatgggggaggacggatgttggtacggcatggaaatcaggccaataaacgagaaagaagagaatatggttaagtcactggtgagcgctggttctggcaaggtagataactttactatgggggtgttgtgcctcgccattctgttcgaggaagtcatgcgcggaaaattcggcaagaaacatatgatcgcaggggtgctatttacattcgttctgctcctgtccggacagatcacctggcgggacatggctcacacgcttattatgatcggcagtaatgccagcgatagaatgggtatgggggtgacttatttggcactgattgccacctttaagatacagcccttcttagctctcggatttttcctgaggaaacttacatctcgcgagaacctgctactcggcgtcggcctggcgatggccaccactttgcaactgccggaagacatcgagcagatggcaaatgggattgctttaggactcatgacactgaaacttatcacccagtttgaaacataccagctgtggactgccttggtgtccctcacctgttcaaacacgattttcacactgaccgttgcctggcgaactgctaccctaatcctggcgggtgtgagtcttctccctctgtgccaaagctcgtccatgcggaagacagattggttgccaatgactgtcgccgcgatgggcgtaccccctctgcccttatttatattctctctcaaagacaccccaaagcgtagaagctggcctctgaatgagggggtgatggctgttggacttgtgtcaatcctggccagttccttgctcaggaacgatgtccccatggcaggcccactggtggccggtgggctactgattgcttgttatgtaatcacgggaacatctgcagaccttaccgtggagaaagccgcggacgtcacttgggaagaggaagctgagcagacaggcgttagccataacctcatgattaccgtggatgacgatggcactatgcgcatcaaggacgatgaaacagagaatatactgaccgtgttgttaaaaacggccctgctcattgtctccgggatctttccgtactcaatccctgcaactctgcttgtgtggcacacctggcagaagcagacacaacggagcggagttctgtgggacgtacccagtccacccgagacccagaaagccgaattggaggaaggtgtgtacagaattaagcagcagggcatattcgggaagacacaagtcggagtgggcgttcagaaagagggtgtgtttcatactatgtggcacgtcaccagaggggctgtgctaacgcacaacggaaagcgactggagcctaattgggcctctgtcaaaaaggatctcatctcctatggcggcgggtggcgcctgagcgcacagtggcaaaaaggagaagaggtccaggtgattgctgttgaaccaggtaagaaccccaagaatttccagacaatgcctggcatcttccagactaccacaggggagattggagccatcgcgcttgactttaaaccgggcacctcgggttcaccaataatcaaccgggaagggaaggtggtcggattatacggcaatggcgtggttactaaaaacgggggatatgtgtctggtattgcccaaaccaatgcagagcccgatggccctacaccagagctggaagaggaaatgttcaagaaaagaaacctcacgatcatggacttgcatcccgggagtggaaagactaggaagtacctgcctgctattgtccgtgaggccatcaaacgccggctcagaaccctgatacttgctccgacaagggtggtagcagccgaaatggaggaggccctgaagggcttgcccattcgatatcagaccactgctacaaaatccgaacacaccggtcgggagatcgtggatctaatgtgccatgcgacgtttactatgcgcctgctcagcccagttagagtccctaattacaacttagtgatcatggacgaagcacacttcacagatcccgcctctattgctgccagggggtatatcagcacccgggtgggaatgggcgaggcagccgctatatttatgaccgcgactccacctggcacagccgaagcattcccccagtccaatgctccaattcaggacgaggagcgagacatcccggaaagatcatggaacagtgggaatgagtggattaccgattttgtcggaaagacagtatggttcgtgcctagcatcaaagccggtaacgacatagcaaactgtctgcgcaagaatggcaagaaagttattcaactttctaggaagacttttgatacggaataccagaaaacccgtctgaacgactgggatttcgtggtcacaactgacatctccgagatgggggccaattttaaggctgatcgggtgatcgaccccagaaggtgcctcaaaccagttattttgaccgatggacccgagcgcgtgatcctggccggccctatgccagtcacagcggcatcagccgctcagcgaagaggtcgggtggggaggaacccccagaaggaaaatgaccaatacattttcaccggccagcctctcaacaatgatgaggaccatgcccactggactgaagctaagatgctgcttgacaacataaatacgccggagggaatcattccagcactattcgaacccgagcgcgagaaaagtgccgctatcgatggcgaatatcgtctgaagggggagagcagaaaaacctttgtagaattgatgcggaggggagacttacctgtgtggctggcccacaaggttgcatccgagggtatcaaatacacagatcgcaagtggtgcttcgacggcgaacgaaacaatcagattctcgaggagaacatggatgtcgaaatatggactaaagagggggaaagaaagaagctgcggcccaggtggcttgacgcgcgcacctattctgatccactggccctcaaagagtttaaggacttcgctgccggaagaaaatcgatcgcattggatctggtgacagaaattggcagggtgcctagccatctagctcaccggacccgtaatgccctggacaacctcgtcatgcttcatacttcagagcacggtgggcgcgcataccgacacgccgttgaggaactgcccgagacaatggaaacgttattgctgctcggcctgatgatccttctgaccggaggcgctatgctctttttgatttccgggaagggaatcggtaaaacaagtataggcctgatctgtgtgattgtatctagcgggatgttatggatggcggatgtgccactacagtggatcgcctccgcaattgtcctggagttctttatgatggtgctccttatccctgagccggaaaagcaaagaacaccccaggacaatcagctggcttatgttgtgataggaattttgaccctggccgccatcgtcgcagctaacgagatgggcctcctggaaaccacaaagagggatcttggtatgtcaaaagagccaggggtagtgtctcctactagctacctcgacgttgacctgcatcccgccagtgcgtggacgttgtatgctgtggccaccacagtcattactccaatgctgcggcacaccatcgaaaattccacagcaaacgtgagcttagccgctatagcaaaccaagccgtcgtgctaatgggcctggataagggatggcctatctctaaaatggacctcggcgttccccttctggcgttggggtgctactcacaggtgaatccgctgaccctcactgctgccgtactgcttttagtgacgcattacgcaattatcggaccaggcctgcaggccaaggctacacgcgaggcccagaaaagaaccgcagctggtattatgaagaaccctactgtcgatgggatcatgaccatagacctcgatcccgttatttatgactccaagttcgagaaacaattgggacaggtgatgctgctagtcctgtgtgccgtgcagctccttctgatgaggacaagttgggcgttgtgcgaagccctgactctcgcaaccggcccaatcacaacgctgtgggagggtagccccggcaagttttggaataccactatcgctgtatcgatggccaacattttccgggggtcttacttagcaggagctggccttgccttttccatcatgaaaagcgtggggacaggaaagcgaggcaccggttcacagggggaaactctgggagagaaatggaagaagaaactcaatcaactaagtagaaaggagttcgatctgtataaaaagtctggcataacagaggttgaccgctccgaggccaaagaaggtttgaagaggggcgagaccacgcaccatgcggtgagccgggggtcagctaaactgcagtggtttgtcgaacgtaacatggtgattcctgagggaagagtcatcgatctcggctgtgggaggggaggctggagttactattgcgcaggtcttaagaaggtgaccgaagttcgcgggtacacaaaaggaggcccgggccacgaggagcccgtaccaatgagcacttatgggtggaatattgtgaagctgatgtccggaaaagacgtcttctacttgcctcccgaaaagtgtgataccctgctctgcgacatcggtgagtctagcccttccccaacagtggaagagtcacggactatacgagttttaaaaatggtggagccctggctgagaaacaatcagttctgtatcaaggtccttaacccttacatgccaaccgtgattgaacacctggagaggctacagcgcaagtatggcgggatgctcgtacggaatcccctgtctagaaacagtacacatgaaatgtactggatctcgaatggaaccggcaacattgtgagctccgttaatatggtctctcgtttgctgctcaacaggtttactatgacgcaccggcgcccgacaatcgagaaagatgtggaccttggtgccgggacccgacatgtgaacgctgaacctgagactccaaatatggacgtcattggagagagaatcaagaggataaaagaagaacactcaagcacctggcactatgatgacgaaaacccctacaagacatgggcctatcatggctcctacgaggttaaagcaacgggcagtgcctctagcatgattaatggggtggtaaagctgttaaccaagccttgggatgtggtcccaatggtgactcaaatggctatgacagacaccactcccttcggacagcagcgggtttttaaagaaaaggtggatacacgcaccccgagacctatgcccggtacaaggaaagtcatggagatcactgcggagtggctgtggcgaaccttgggccggaacaagaaaccacgtctctgcacgagagaagagttcaccaagaaggtgcgcacaaatgccgcaatgggggctgtatttactgaagagaaccaatgggactcagccagggcagccgttgaagatgaggagttctggaaactggtggacaaggaacgggagctacacaaacttggaaagtgtggctcctgcgtctataatatgatgggtaaaagagaaaagaaactgggggagtttggaaaggctaagggcagtcgcgccatctggtacatgtggctcggcgcgaggtacctggagttcgaagcattggggtttctgaacgaggatcattggttcagccgagaaaattcttattccggagtggagggtgaaggcctccacaaacttgggtacattctgcgggacatatcaaagatccctggaggcgccatgtatgctgatgacaccgccggttgggacacaagaattactgaggatgacttacataacgaggagaaaatcacccagcagatggatcccgagcacaggcagctggcaaatgctatttttaagttgacgtaccaaaacaaagtggtcaaggttcagcgcccaacacccaaggggaccgtgatggacatcataagccgtaaagatcagcggggatcgggccaggtaggcacttatgggctcaatacattcaccaacatggaagcccaactggtgagacagatggagggagaaggtgtcctatctaaggctgaccttgagaatcctcatctgctcgagaaaaagatcattcagtggctggaaactaaaggcgtggagaggttgaagcgcatggccatcagtggggatgactgcgttgtgaagccaattgatgaccgatttgcaaacgcgttactggccctcaacgatatgggaaaagtccggaaggacatcccgcagtggcaaccctccaaaggctggcatgattggcaacaggtgcctttctgtagccaccatttccacgaacttataatgaaggacggtagaaaactggtagttccatgcaggccccaggacgagctaattgggcgcgctagaatctcacaaggagccggctggtccctgaaggaaaccgcatgtctcggcaaggcttacgcccagatgtggtctttgatgtattttcaccggagggatctgcgtcttgcaagcaatgccatctgcagtgcggtgcctgtccattggattccaacatcccgaacgacctggagcatacacgctcatcaccagtggatgactacagaggacatgctgtctgtgtggaaccgcgtttggatcgaggataatccctggatggaagacaaaacccctgtgactacatgggaggatgtcccgtacctcgggaagagagaagaccaatggtgtggatcattaattggtctgaccagtcgggccacgtgggcacagaacatcttgacagccattcaacaggtgaggtccctgatcggcgatgaggagttcctcgactacatgccaagcatgaaacgctttagaaaggaagaggaatctgagggggctatatggtga

SEQ ID NO: 15208 - RNA, 9873 nt, synthetic construct
  misc_feature 1..9873: note = derived and/or modified CDS sequence (opt3) from DENV-3__GU131918__SS-prME
  source 1..9873: mol_type = other RNA
accagcctgtgcctcatgatgatgcttcccgccactctggctttccacttgacttccagagacggcgaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcagcttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaatagtaaaaacacgtcaatgagcttttcctgcatcgttattggaataatcacactgtatctaggcgcggtcgtgcaggctgatatgggttgtgtgattaattggaaggggaaggaactcaaatgcggaaacggcatcttcgtcaccaatgaggttcacacttggacagagcagtacaagtttcaagccgactctcccaaacggctggcaaccgccattgctggtgcctgggaaaacggcgtgtgtgggatccgaagcactacccgcatggagaatcttttgtggaagcagatagcaaacgaactgaattatatcctctgggagaacaatattaaactgacagtggtagtcggagatatcattggcgtgttagaacaggggaagagaacgctgaccccacagcctatggagcttaaatactcatggaagacttggggaaaggctaaaatcgttacagccgagacccaaaacagttccttcataattgacggccccaacacaccagaatgccccagcgcgtctagggcctggaatgtgtgggaggtcgaagactatggttttggggtgttcactaccaacatctggttgaagctccgggaggtttacacgcagtcatgtgatcatcgcctgatgagtgctgcaattaaagacgaaagagccgtgcacgctgatatgggatactggatcgagagccagaagaatggctcctggaaactagagaaggcctcttttatagaagtaaagacatgcacctggcctaaatcgcacactctgtggagcaacggtgtcctcgagtccgacatgatcattccaaagtcactggcaggcccgatcagtcagcataatcacaggcccgggtatcatacccaaacagcgggaccttggcaccttggcaaattggaactggatttcaactactgcgaggggactaccgtggtgattacagagaattgtggaacgcgtggcccatctttacggaccactacagtcagcggtaagctcatccacgaatggtgctgtcgatcctgcaccctgccccctcttagatatatgggggaggacggatgttggtacggcatggaaataaggccaattaacgagaaagaagagaatatggttaagtcactggtgagcgccggttctggcaaggtagataactttactatgggggtgttgtgcctcgctatcctgttcgaggaagtcatgcgcggaaaattcggcaagaaacatatgatcgccggggtgctatttacattcgttctgctcctgtccggacagattacctggcgggacatggcacacacgcttatcatgattggcagtaatgctagcgatagaatgggtatgggggtgacttatttggccctgatagcaacctttaagatccagcccttcttagccctcggatttttcctgaggaaacttacatctcgcgagaacctgctactcggcgtcggcctggctatggcgaccactttgcaactgccggaagacattgagcagatggccaatgggatcgcattaggactcatgacactgaaacttattacccagtttgaaacataccagctgtggactgctttggtgtccctcacctgttcaaacacgatcttcacactgaccgttgcctggcgaactgccaccctaatactggctggtgtgagtcttctccctctgtgccaaagctcgtccatgcggaagacagattggttgccaatgactgtcgcagccatgggcgtaccccctctgcccttatttatcttctctctcaaagacaccccaaagcgtagaagctggcctctgaatgagggggtgatggcggttggacttgtgtcaattctggctagttccttgctcaggaacgatgtccccatggccggcccactggtggcgggtgggctactgatcgcctgttatgtaattacgggaacatctgctgaccttaccgtggagaaagcagccgacgtcacttgggaagaggaagcggagcagacaggcgttagccataacctcatgatcaccgtggatgacgatggcactatgcgcataaaggacgatgaaacagagaatattctgaccgtgttgttaaaaacggctctgctcatcgtctccgggatctttccgtactcaattcctgccactctgcttgtgtggcacacctggcagaagcagacacaacggagcggagttctgtgggacgtacccagtccacccgagacccagaaagcagaattggaggaaggtgtgtacagaataaagcagcagggcatcttcgggaagacacaagtcggagtgggcgttcagaaagagggtgtgtttcatactatgtggcacgtcacccgaggggcagtgctaacgcacaacggaaagaggctggagcctaattgggcttctgtcaaaaaggatctcatttcctatggcggcgggtggcgcctgagcgcccagtggcaaaaaggagaagaggtccaggtgatcgcagttgaaccaggtaagaaccccaagaatttccagacaatgcctggcattttccagactaccacaggggagatcggagctatagcccttgactttaaaccgggcacctcgggttcaccaatcattaaccgggaagggaaggtggtcggattatacggcaatggcgtggttactaaaaacgggggatatgtgtctggtatcgcgcaaaccaatgccgagcccgatggccctacaccagagctggaagaggaaatgttcaagaaaagaaacctcacgattatggacttgcatcccgggagtggaaagactaggaagtacctgcctgcaatcgtccgtgaggctataaaacgccggctcagaaccctgattcttgccccgacaagggtggtagctgcagaaatggaggaggccctgaagggcttgcccatccgatatcagaccactgccacaaaatccgaacacaccggtcgggagatcgtggatctaatgtgccatgctacgtttactatgcgcctgctcagcccagttagagtccctaattacaacttagtgattatggacgaagcgcacttcacagatcccgcatctatcgccgctagggggtatataagcacccgggtgggaatgggcgaggccgcagccatttttatgaccgctactccacctggcacagcggaagccttcccccagtccaatgcaccaatccaggacgaggagcgagacattccggaaagatcatggaacagtgggaatgagtggatcaccgattttgtcggaaagacagtatggttcgtgcctagcataaaagctggtaacgacattgccaactgtctgcgcaagaatggcaagaaagttatccaactttctaggaagacttttgatacggaataccagaaaacccgtctgaacgactgggatttcgtggtcacaactgacatctccgagatgggggcaaattttaaggccgatcgggtgattgaccccagaaggtgcctcaaaccagttatcttgaccgatggacccgagcgcgtgattctggctggccctatgccagtcacagccgcgtcagcagcccagcgaagaggtcgggtggggaggaacccccagaaggaaaatgaccaatacatattcaccggccagcctctcaacaatgatgaggaccatgctcactggactgaagccaagatgctgcttgacaacatcaatacgccggagggaattatcccagctctattcgaacccgagcgcgagaaaagtgcagccatcgatggcgaatatcgtctgaagggggagagcagaaaaacctttgtagaattgatgcggaggggagacttacctgtgtggctggctcacaaggttgcctccgagggtattaaatacacagatcgcaagtggtgcttcgacggcgaacgaaacaatcagatactcgaggagaacatggatgtcgaaatctggactaaagagggggaaagaaagaagctgcggcccaggtggcttgacgcacgcacctattctgatccactggcgctcaaagagtttaaggacttcgccgctggaagaaaatcgattgccttggatctggtgacagaaatcggcagggtgcctagccatctagcacaccggacccgtaatgctctggacaacctcgtcatgcttcatacttcagagcacggtgggcgcgcctaccgacacgcagttgaggaactgcccgagacaatggaaacgttattgctgctcggcctgatgattcttctgaccggaggcgccatgctctttttgatctccgggaagggaataggtaaaacaagtatcggcctgatttgtgtgatcgtatctagcgggatgttatggatggctgatgtgccactacagtggattgcgtccgccatcgtcctggagttctttatgatggtgctccttatacctgagccggaaaagcaaagaacaccccaggacaatcagctggcatatgttgtgattggaatcttgaccctggctgccattgtcgccgcaaacgagatgggcctcctggaaaccacaaagagggatcttggtatgtcaaaagagccaggggtagtgtctcctactagctacctcgacgttgacctgcatcccgctagtgcctggacgttgtatgcggtggctaccacagtcatcactccaatgctgcggcacaccatagaaaattccacagccaacgtgagcttagcagccatcgctaaccaagcagtcgtgctaatgggcctggataagggatggcctatttctaaaatggacctcggcgttccccttctggccttggggtgctactcacaggtgaatccgctgaccctcactgcggctgtactgcttttagtgacgcattacgccatcattggaccaggcctgcaggcaaaggccacacgcgaggctcagaaaagaaccgccgcaggtatcatgaagaaccctactgtcgatgggataatgaccattgacctcgatcccgttatctatgactccaagttcgagaaacaattgggacaggtgatgctgctagtcctgtgtgctgtgcagctccttctgatgaggacaagttgggccttgtgcgaagcgctgactctcgccaccggcccaatcacaacgctgtgggagggtagccccggcaagttttggaataccactattgcagtatcgatggctaacatcttccgggggtcttacttagccggagcaggccttgctttttccataatgaaaagcgtggggacaggaaagcgaggcaccggttcacagggggaaactctgggagagaaatggaagaagaaactcaatcaactaagtagaaaggagttcgatctgtataaaaagtctggcattacagaggttgaccgctccgaggccaaagaaggtttgaagaggggcgagaccacgcaccatgccgtgagccgggggtcagcgaaactgcagtggtttgtcgaacgtaacatggtgatccctgagggaagagtcattgatctcggctgtgggaggggaggctggagttactattgcgctggtcttaagaaggtgaccgaagttcgcgggtacacaaaaggaggcccgggccacgaggagcccgtaccaatgagcacttatgggtggaatatcgtgaagctgatgtccggaaaagacgtcttctacttgcctcccgaaaagtgtgataccctgctctgcgacataggtgagtctagcccttccccaacagtggaagagtcacggactatccgagttttaaaaatggtggagccctggctgagaaacaatcagttctgtattaaggtccttaacccttacatgccaaccgtgatcgaacacctggagaggctacagcgcaagtatggcgggatgctcgtacggaatcccctgtctagaaacagtacacatgaaatgtactggatttcgaatggaaccggcaacatcgtgagctccgttaatatggtctctcgtttgctgctcaacaggtttactatgacgcaccggcgcccgacaattgagaaagatgtggaccttggtgcagggacccgacatgtgaacgccgaacctgagactccaaatatggacgtcatcggagagagaataaagaggattaaagaagaacactcaagcacctggcactatgatgacgaaaacccctacaagacatgggcttatcatggctcctacgaggttaaagccacgggcagtgcatctagcatgatcaatggggtggtaaagctgttaaccaagccttgggatgtggtcccaatggtgactcaaatggccatgacagacaccactcccttcggacagcagcgggtttttaaagaaaaggtggatacacgcaccccgagacctatgcccggtacaaggaaagtcatggagatcactgctgagtggctgtggcgaaccttgggccggaacaagaaaccacgtctctgcacgagagaagagttcaccaagaaggtgcgcacaaatgcggccatgggggcagtatttactgaagagaaccaatgggactcagctagggccgcagttgaagatgaggagttctggaaactggtggacaaggaacgggagctacacaaacttggaaagtgtggctcctgcgtctataatatgatgggtaaaagagaaaagaaactgggggagtttggaaaggccaagggcagtcgcgctatttggtacatgtggctcggcgccaggtacctggagttcgaagcgttggggtttctgaacgaggatcattggttcagccgagaaaattcttattccggagtggagggtgaaggcctccacaaacttgggtacatactgcgggacatctcaaagattcctggaggcgcaatgtatgccgatgacaccgctggttgggacacaagaatcactgaggatgacttacataacgaggagaaaattacccagcagatggatcccgagcacaggcagctggccaatgcaatctttaagttgacgtaccaaaacaaagtggtcaaggttcagcgcccaacacccaaggggaccgtgatggacataatcagccgtaaagatcagcggggatcgggccaggtaggcacttatgggctcaatacattcaccaacatggaagctcaactggtgagacagatggagggagaaggtgtcctatctaaggccgaccttgagaatcctcatctgctcgagaaaaagattatccagtggctggaaactaaaggcgtggagaggttgaagcgcatggctattagtggggatgactgcgttgtgaagccaatcgatgaccgatttgccaacgcattactggcgctcaacgatatgggaaaagtccggaaggacataccgcagtggcaaccctccaaaggctggcatgattggcaacaggtgcctttctgtagccaccatttccacgaacttattatgaaggacggtagaaaactggtagttccatgcaggccccaggacgagctaatcgggcgcgccagaatctcacaaggagctggctggtccctgaaggaaaccgcctgtctcggcaaggcatacgctcagatgtggtctttgatgtattttcaccggagggatctgcgtcttgccagcaatgcaatttgcagtgccgtgcctgtccattggataccaacatcccgaacgacctggagcatccacgcgcatcaccagtggatgactacagaggacatgctgtctgtgtggaaccgcgtttggattgaggataatccctggatggaagacaaaacccctgtgactacatgggaggatgtcccgtacctcgggaagagagaagaccaatggtgtggatcattaatcggtctgaccagtcgggctacgtgggcccagaacattttgacagcaatccaacaggtgaggtccctgataggcgatgaggagttcctcgactacatgccaagcatgaaacgctttagaaaggaagaggaatctgagggggccatctggtga

SEQ ID NO: 15209 - RNA, 9873 nt, synthetic construct
  misc_feature 1..9873: note = derived and/or modified CDS sequence (opt3) from DENV-3__GU131933__SS-prME
  source 1..9873: mol_type = other RNA
accagcctgtgcctcatgatgatgcttcccgccacactggctttccacttgacttccagagacggcgaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaatagtaaaaacacgtcaatgagcttttcctgcatcgttattggaataatcacactgtatctaggcgcggtcgtgcaggctgatatgggttgtgtgattaattggaaggggaaggaactcaaatgcggatctggcatcttcgtcaccaacgaggttcacacttggacagagcagtacaagtttcaagccgacagccccaaacggctggcaaccgccattgctggtgcctgggaaaatggcgtgtgtgggatccgatcaactacccgcatggagaaccttttgtggaagcagatagcaaatgaactgaactatatcctctgggagaatagtattaaactgacagtggtagtcggagatatcattggcgtgttagaacaggggaagagaacgctgaccccacagcctatggagcttaaatactcctggaagacttggggaaaggctaaaatcgttacagccgagacccaaaacagctctttcataattgacggccccaatacaccagaatgcccctcagcgagtagggcctggaacgtgtgggaggtcgaagactatggttttggggtgttcactaccaacatctggttgaagctccgggaggtttacacgcagagctgtgatcatcgcctgatgtccgctgcaattaaagacgaaagagccgtgcacgctgatatgggatactggatcgagtctcagaagaatggctcgtggaaactagagaaggccagctttatagaagtaaagacatgcacctggcctaaatcccacactctgtggtcaaacggtgtcctcgagagtgacatgatcattccaaagtctctggcaggcccgatcagccagcataatcacaggcccgggtatcatacccaaacagcgggaccttggcaccttggcaaattggaactggatttcaactactgcgaggggactaccgtggtgattacagagaattgtggaacgcgtggcccatccttacggaccactacagtctcaggtaagctcatccacgaatggtgctgtcgaagctgcaccctgccccctcttagatatatgggggaggacggatgttggtacggcatggaaataaggccaattaacgagaaagaagagaatatggttaagtctctggtgtccgccggtagtggcaaggtagataactttactatgggggtgttgtgcctcgctatcctgttcgaggaagtcatgcgcggaaaattcggcaagaaacatatgatcgccggggtgctatttacattcgttctgctcctgagcggacagattacctggcgggacatggcacacacgcttatcatgattggctctaatgcttccgatagaatgggtatgggggtgacttatttggccctgatagcaacctttaagatccagcccttcttagccctcggatttttcctgaggaaacttacatcacgcgagaacctgctactcggcgtcggcctggctatggcgaccactttgcaactgccggaagacattgagcagatggccaatgggatcgcattaggactcatgacactgaaacttattacccagtttgaaacataccagctgtggactgctttggtgagtctcacctgtagcaacacgatcttcacactgaccgttgcctggcgaactgccaccctaatactggctggtgtgtcgcttctccctctgtgccaatcctctagcatgcggaagacagattggttgccaatgactgtcgcagccatgggcgtaccccctctgcccttatttatcttctcactcaaagacaccccaaagcgtagaagttggcctctgaatgagggggtgatggcggttggacttgtgtccattctggcttctagcttgctcaggaacgatgtccccatggccggcccactggtggcgggtgggctactgatcgcctgttatgtaattacgggaacatccgctgaccttaccgtggagaaagcagccgacgtcacttgggaagaggaagcggagcagacaggcgtttcacataatctcatgatcaccgtggatgacgatggcactatgcgcataaaggacgatgaaacagagaacattctgaccgtgttgttaaaaacggctctgctcatcgtcagcgggatctttccgtacagtattcctgccactctgcttgtgtggcacacctggcagaagcagacacaacggtctggagttctgtgggacgtaccctccccacccgagacccagaaagcagaattggaggaaggtgtgtacagaataaagcagcagggcatcttcgggaagacacaagtcggagtgggcgttcagaaagagggtgtgtttcatactatgtggcacgtcacccgaggggcagtgctaacgcacaacggaaagaggctggagcctaattgggctagcgtcaagaaggatctcatttcgtatggcggcgggtggcgcctgtcagcccagtggcaaaaaggagaagaggtccaggtgatcgcagttgaaccaggtaagaaccccaagaatttccagacaatgcctggcattttccagactaccatgggggagatcggagctatagcccttgactttaaaccgggcacatctggtagtccaatcattaaccgggaagggaaggtggtcggattatacggcaatggcgtggttaccaaaaacgggggatatgtgtccggtatcgcgcaaactaatgccgagcccgatggccctaccccagagctggaagaggaaatgttcaagaaaagaaacctcacaattatggacttgcatcccgggagcggaaagacgaggaagtacctgcctgcaatcgtccgtgaggctataaaacgccggctcagaactctgattcttgccccgaccagggtggtagctgcagaaatggaggaggccctgaagggcttgcccatccgatatcagacaaccgccactaaatctgaacacacaggtcgggagatcgtggatctaatgtgccatgctacctttacgatgcgcctgctcagcccagttagagtccctaattacaacttagtgattatggacgaagcgcacttcactgatcccgcatccatcgccgctagggggtatatatcaacacgggtgggaatgggcgaggccgcagccatttttatgaccgctaccccacctggcactgcggaagccttcccccagagtaatgcaccaatccaggacgaggagcgagacattccggaaagaagctggaactctgggaatgagtggatcacagattttgtcggaaagaccgtatggttcgtgccttccataaaagctggtaacgacattgccaattgtctgcgcaagaacggcaagaaagttatccaactttcaaggaagacatttgatactgaataccagaaaacgcgtctgaacgactgggatttcgtggtcaccacagacatcagtgagatgggggcaaattttaaggccgatcgggtgattgaccccagaaggtgcctcaaaccagttatcttgactgatggacccgagcgcgtgattctggctggccctatgccagtcaccgccgcgagcgcagcccagcgaagaggtcgggtggggaggaacccccagaaggaaaatgaccaatacatattcacaggccagcctctcaacaatgatgaggaccatgctcactggaccgaagccaagatgctgcttgacaacatcaatactccggagggaattatcccagctctattcgaacccgagcgcgagaaatccgcagccatcgatggcgaatatcgtctgaagggggagtctagaaaaacgtttgtagaattgatgcggaggggagacttacctgtgtggctggctcacaaggttgcctcggagggtattaaatacaccgatcgcaagtggtgcttcgacggcgaacgaaacaatcagatactcgaggagaacatggatgtcgaaatctggacaaaagagggggaaagaaagaagctgcggcccaggtggcttgacgcacgcacttatagcgatccactggcgctcaaagagtttaaggacttcgccgctggaagaaaatcaattgccttggatctggtgaccgaaatcggcagggtgccttcccatctagcacaccggacacgtaatgctctggacaacctcgtcatgcttcataccagtgagcacggtgggcgcgcctaccgacacgcagttgaggaactgcccgagactatggaaacattattgctgctcggcctgatgattcttctgacgggaggcgccatgctctttttgatctctgggaagggaataggtaaaaccagcatcggcctgatttgtgtgatcgcttcctcagggatgttatggatggcggatgtaccactacagtggattgcctctgcaatcgtgctggagttctttatgatggtcctccttatacctgagccggaaaagcaaagaactccccaggacaatcagctggcttatgtggttattggaatcttgacactggccgccattgtggcagctaacgagatgggcctcctggaaaccaccaagagggatcttggtatgagcaaagagccaggggtcgtaagtcctacatcctacctcgacgtggacctgcatcccgccagcgcgtggactttgtatgctgttgccacgaccgtgatcacaccaatgctgcggcacactatagaaaattctaccgcaaacgtctcattagccgctatcgcaaatcaagccgtggtcctaatgggcctggataagggatggcctatttccaaaatggacctcggcgtgccccttctggcgttggggtgctacagtcaggttaacccgctgacactcaccgctgccgtgctgcttttagtaactcattacgcaatcattggaccaggcctgcaggccaaggctacgcgcgaggcccagaaaagaacagcagctggtatcatgaagaaccctaccgtggatgggataatgactattgacctcgatcccgtcatctatgacagcaagttcgagaaacaattgggacaggttatgctgctagtgctgtgtgccgtccagctccttctgatgaggacctcgtgggcgttgtgcgaagccctgacactcgcaactggcccaatcaccacactgtgggagggttctcccggcaagttttggaatacgaccattgctgtgtccatggccaacatcttccgggggagctacttagcaggagctggccttgccttttcaataatgaaaagtgtagggactggacgaagaggcacaggttctcagggggaaaccctgggagagaagtggaaaaagaagctcaatcaactatcccgcaaagagttcgatctgtataagaaaagcggcattactgaggtggacaggacagaggccaaggaaggtttgaaacggggcgagaccacgcaccatgcggtttcacgtgggagtgctaagctgcagtggtttgtggaaagaaacatggtcatccctgagggaagggtgattgatctcggctgtgggcgcggaggctggagctactattgcgcaggtcttaaaaaggtcaccgaagtgcgggggtacacaaagggaggcccgggccacgaggagcccgttccaatgtccacttatgggtggaatatcgtaaaactgatgtctggaaaggacgtgttctacttgcctcccgaaaaatgtgataccctgctctgcgacataggtgagagctccccttcaccaacagtcgaagagtctcgaactatcagagtgttaaagatggttgagccctggctgaggaacaatcagttctgtattaaagtgcttaacccttacatgccaaccgtcatcgaacacctggagcgcctacagcggaagtatggcgggatgctcgtgagaaatcccctgagtcgtaactcgacacatgaaatgtactggattagcaatggaaccggcaacatcgtatcctctgtgaatatggtttcaaggttgctgctcaaccggtttactatgacgcaccgccgaccgacaattgagaaggatgtcgaccttggtgccgggaccagacatgtgaatgctgaacctgagactccaaacatggacgtgatcggagagaggataaaacggattaaggaagaacacagctccacctggcactatgatgacgaaaacccctacaaaacatgggcctatcatggcagttacgaggtcaaggcaacgggctctgccagctcaatgatcaatggggttgtgaaactgttaaccaagccttgggatgtagtgccaatggtcactcaaatggctatgacagacaccactcccttcggacagcagcgcgtgtttaaggaaaaagttgatacaagaaccccgaggcctatggcgggtacacgaaaggtgatggagatcactgccgagtggctgtggcggaccttgggccgtaacaaaaagcccagactctgcacgcgcgaagagttcaccaaaaaggtcaggacaaatgcagctatgggggccgtgtttactgaagagaaccaatgggactccgcacgggccgctgtagaagatgaggagttctggaagctggttgacagagaacgcgagctacacaaacttggaaagtgtggcagttgcgtgtataatatgatgggtaaaagggaaaagaaactgggggagtttggaaaggccaaaggcagccgagcgatttggtacatgtggctcggcgcacggtacctggagttcgaagccttggggtttctgaacgaggatcattggttctctagagaaaattcctattcaggagtcgagggtgaaggcctccacaaacttgggtacatactgagggacatcagcaagattccaggaggcgctatgtatgccgatgacaccgcaggttgggacacacgcatcactgaggatgacttacataacgaggagaaaattacccagcagatggatcctgagcaccgtcagctggctaatgccatctttaagttgacgtaccaaaacaaagtggtgaaggtccagcggcccacaccaaaagggaccgttatggacataatctcgagaaaggatcagaggggatctggccaggtgggcacttatgggctcaatacattcaccaacatggaagctcaactggtacgccagatggagggagaaggtgtgctaagtaaggccgaccttgagaatccccatctgctcgagaaaaagattactcagtggctggaaaccaaaggcgtcgagcgattgaagcggatggcaatctccggggatgactgcgtggttaaacctattgatgacagatttgcgaacgccttactggctctcaatgatatgggaaaggtgaggaaggacatcccacagtggcaaccgagcaaaggctggcatgattggcagcaggtccccttctgttcacaccatttccacgaacttataatgaaggacggtcgcaaactggtggtaccttgcagaccacaggacgagctaattgggcgggccaggatctcccaaggagcaggctggtctctgaaggaaacagcttgtctcggcaaagcctacgcacagatgtggagcttgatgtattttcaccgtcgagatctgcgccttgccagtaacgcgatctgctccgctgttcccgtgcattggattcctacgagcagaaccacttggtctatacacgcccatcaccagtggatgacaaccgaggacatgctgactgtctggaaccgggtgtggatcgaggataatccatggatggaagacaagacacccgttaccacgtgggaggatgtgccttacctcgggaagagggaagaccaatggtgtggatcattaattggtctgacaagtcgcgcaacctgggcccagaacatcttgactgctattcagcaggtcagatccctgatcggcgatgaggagttcctcgactacatgccgagcatgaaacggtttaggaaggaagaggaatctgagggggccatatggtga

SEQ ID NO: 15210 - RNA, 9873 nt, synthetic construct
  misc_feature 1..9873: note = derived and/or modified CDS sequence (opt3) from DENV-3__GU131934__SS-prME
  source 1..9873: mol_type = other RNA
accagcctgtgcctcatgatgatgcttcccgcaaccctggctttccacttgacttccagggacggagaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctggatcgatgtggtcctagagcatggcgggtgcgtgacgactatggcaaagagcaaacccacactcgacattgagctgcagaagaccgaagcaactcagcttgccacactgaggaaattgtgtatcgagggaaagattaccaatatcacgaccgatagtcggtgccctacacagggcgaagctactctcccagaggaacaggaccagaactatgtgtgtaaacacacctacgtcgatcgcggttgggggaatggatgcggcctgttcggcaaggggtccttagttacatgcgccaagtttcaatgtctggagcccatagagggaaaagtggtacagtatgaaaacctcaagtacactgtgattatcaccgtccacacaggtgaccagcatcaggtgggcaatgacacccaaggggttactgtggagattacgcctcaggcatctacagtcgaagctgtgcttccagagtatggaaccctgggcttggaatgcagcccgcgaactggtctagatttcaacgagatgatcctgctcaccatgaaaaataaggcctggatggtacacagacagtggtttttcgacctgccccttccttggacatccggggcgaccactgagacaccaacgtggaacaggaaagaactgttggttacctttaagaatgcccatgccaagaagcaagaggtggtcgtgctcggctcacaggaaggagctatgcacactgccctgacaggcgctaccgagatccagaacagtgggggaacaagcattttcgccggtcacttaaagtgtcggctgaaaatggataagctagaactcaaaggcatgtcttacgcaatgtgcctgaatacttttgtccttaagaaagaggtgtccgagacccagcatgggacgatattgatcaaggttgaatacaagggagaggacgccccctgtaaaattcctttctcaaccgaagatggccaaggtaaggctcacaacgggcgtctgatcacagcgaacccagtggtaactaaaaaggaggagcccgtcaatatagaagcagagccgcctttcggcgaaagcaacattgtgatcggaatcggcgacaaagccctcaagattaattggtataagaaagggagttctatcggaaagatgtttgaggctaccgcccgcggtgcaagaaggatggccattctgggcgatacagcttgggacttcgggtccgttggaggcgtgcttaacagcctgggtaaaatggtccatcagatatttgggtcggcctacactgcattgttctctggcgtgtcctggatcatgaagattggaatcggcgtactcctgacctggatcgggttaaatagtaaaaacacgtcaatgagcttttcctgcattgtgataggagttatcacactgtatctaggcgcggtcgtgcaggctgatatgggttgtgtgattaattggaaggggaaggaactcaaatgcggaaacggcatcttcgtcaccaatgaggttcacacttggacagagcagtacaagtttcaagccgactctcccaaacggctggcaaccgccattgctggtgcctgggaaaacggcgtgtgtgggatccgaagcactacccgcatggagaatcttttgtggaagcagatagcaaacgaactgaattatatcctctgggagaacaatattaaactgacagtggtagtcggagatatcattggcgtgttagaacaggggaagagaacgctgaccccacagcctatggagcttaaatactcatggaagacttggggaaaggctaaaatcgttacagccgagaaccaaaacagttccttcataattgacggccccaataccccagaatgccccagcgcgtctagggcctggaacgtgtgggaggtcgaagactatggttttggggtgttcacaactaatatctggttgaagctccgggaggtttacacccagtcatgtgatcatcgcctgatgagtgctgcaattaaagacgaaagagccgtgcacgctgatatgggatactggatcgagagccagaagaacggctcctggaaactagagaaggcctcttttatagaagtaaagacgtgcacatggcctaaatcgcacaccctgtggagcaatggtgtcctcgagtccgacatgatcattccaaagtcactggcaggcccgatcagtcagcataaccacaggcccgggtatcatactcaaaccgcgggaccttggcaccttggcaaattggaactggatttcaattactgcgaggggacaactgtggtgattgccgagaactgtggaacccgtggcccatctttacggacaacgaccgtcagcggtaagctcatccacgaatggtgctgtcgatcctgcactctgccccctcttagatatatgggggaggacggatgttggtacggcatggaaataaggccaattaatgagaaagaagagaacatggttaagtcactggtgagcgctggttctggcaaggtagataattttacaatgggggtgttgtgcctcgccatcctgttcgaggaagtcatgcgcggaaaattcggcaagaaacatatgatcgcaggggtgctatttaccttcgttctgctcctgtccggacagattacttggcgggacatggctcacacacttatcatgattggcagtaacgccagcgatagaatgggtatgggggtgacctatttggcactgatagccacgtttaagatccagcccttcttagctctcggatttttcctgaggaaacttacttctcgcgagaatctgctactcggcgtcggcctggcgatggccaccacattgcaactgccggaagacattgagcagatggcaaacgggatcgctttaggactcatgaccctgaaacttattactcagtttgaaacataccagctgtggaccgccttggtgtccctcacatgttcaaatactatcttcaccctgacggttgcctggcgaacagctaccctaatactggcgggtgtgagtcttctccctctgtgccaaagctcgtccatgcggaagactgattggttgccaatgaccgtcgccgcgatgggcgtaccccctctgcccttatttatcttctctctcaaagacacaccaaagcgtagaagctggcctctgaacgagggggtgatggctgttggacttgtgtcaattctggccagttccttgctcaggaacgatgtccccatggcaggcccactggtggccggtgggctactgatcgcttgttatgtaattactggaacctctgcagaccttacggtggagaaagccgcggacgtcacatgggaagaggaagctgagcagaccggcgttagccataatctcatgatcactgtggatgacgatggcacaatgcgcataaaggacgatgaaaccgagaacattctgactgtgttgttaaaaacagccctgctcatcgtctccgggatctttccgtactcaattcctgcaaccctgcttgtgtggcacacgtggcagaagcagactcaacggagcggagttctgtgggacgtacccagtccacccgagacccagaaagccgaattggaggaaggtgtgtacagaataaagcagcagggcatcttcgggaagacacaagtcggagtgggcgttcagaaagagggtgtgtttcataccatgtggcacgtcacaagaggggctgtgctaactcacaatggaaagcgactggagcctaactgggcctctgtcaagaaggatctcatttcctatggcggcgggtggcgcctgagcgcacagtggcaaaaaggagaagaggtccaggtgatcgctgttgaaccaggtaagaatcccaagaacttccagaccattcctggcatcttccagacgacaactggggagataggagccatcgcgcttgactttaaaccgggcacctcgggttcaccaattatcaatcgggaagggaaggtggtcggattatacggcaacggcgtggttactaagaatgggggatatgtgtctggtattgcccaaaccaacgcagagcccgatggccctactccagagctggaagaggaaatgttcaagaaaagaaatctcaccatcatggacttgcatcccgggagtggaaagacaaggaagtacctgcctgctatagtccgtgaggccattaaacgccggctcagaacgctgatccttgctccgactagggtggtagcagccgaaatggaggaggccctgaagggcttgcccatccgatatcagaccacagctaccaaatccgaacacactggtcgggagattgtggatctaatgtgccatgcgacatttaccatgcgcctgctcagcccagttagagtccctaactacaatttagtgatcatggacgaagcacacttcacggatcccgcctctatagctgccagggggtatattagcactcgggtgggaatgggcgaggcagccgctatctttatgacagcgaccccacctggcaccgccgaagcattcccccagtccaacgctccaattcaggacgaggagcgagacatcccggaaagatcatggaatagtgggaacgagtggataactgattttgtcggaaagacagtatggttcgtgcctagcattaaagccggtaacgacatcgcaaattgtctgcgcaagaacggcaagaaagttatccaactttctaggaagacctttgatacagaataccagaaaactcgtctgaatgactgggatttcgtggtcacgaccgacatttccgagatgggggccaactttaaggctgatcgggtgatcgaccccagaaggtgcctcaaaccagttattttgacagatggacccgagcgcgtgatactggccggccctatgccagtcactgcggcatcagccgctcagcgaagaggtcgggtggggaggaatccccagaaggaaaacgaccaatacatcttcaccggccagcctctcaataacgatgaggaccatgcccactggacagaagctaagatgctgcttgacaatattaacaccccggagggaatcatcccagcactattcgaacccgagcgcgagaaaagtgccgctattgatggcgaatatcgtctgaagggggagagcagaaaaacttttgtagaattgatgcggaggggagacttacctgtgtggctggcccacaaggttgcatccgagggtataaaatacacggatcgcaagtggtgcttcgacggcgaacgaaataaccagatcctcgaggagaatatggatgtcgaaatttggaccaaagagggggaaagaaagaagctgcggcccaggtggcttgacgcgcgcacatattctgatccactggccctcaaagagtttaaggacttcgctgccggaagaaaatcgatcgcattggatctggtgactgaaattggcagggtgcctagccatctagctcaccggacccgtaacgccctggacaatctcgtcatgcttcatacatcagagcacggtgggcgcgcataccgacacgccgttgaggaactgcccgagaccatggaaactttattgctgctcggcctgatgatccttctgacaggaggcgctatgctctttttgatatccgggaagggaatcggtaaaacgagtattggcctgatctgtgtgattgtatctagcgggatgttatggatggcggatgtgccactacagtggatcgcctccgcaatagtcctggagttctttatgatggtgctccttattcctgagccggaaaagcaaagaacaccccaggacaaccagctggcttatgttgtgatcggaattttgactctggccgccatcgtcgcagctaatgagatgggcctcctggaaacaaccaagagggatcttggtatgtcaaaagagccaggggtagtgtctcctaccagctacctcgacgttgacctgcatcccgccagtgcgtggacattgtatgctgtggccactacggtcataaccccaatgctgcggcacacaatcgaaaactccactgcaaacgtgagcttagccgctattgcaaatcaagccgtcgtgctaatgggcctggataagggatggcctatctctaaaatggacctcggcgttccccttctggcgttggggtgctactcacaggtgaacccgctgaccctcacagctgccgtactgcttttagtgacccattacgcaattatcggaccaggcctgcaggccaaggctactcgcgaggcccagaaaagaacggcagctggtataatgaagaatcctacagtcgatgggattatgaccatcgacctcgatcccgttatctatgactccaagttcgagaaacaattgggacaggtgatgctgctagtcctgtgtgccgtgcagctccttctgatgaggacaagttgggcgttgtgcgaagccctgaccctcgcaacaggcccaattactaccctgtgggagggtagccccggcaagttttggaacacaacgatcgctgtatcgatggccaatatattccgggggtcttacttagcaggagctggccttgccttttccattatgaaaagcgtggggaccggacgaagaggcactggttcacagggggaaacactgggagagaagtggaaaaagaagctcaaccaactaagtcgcaaagagttcgatctgtataagaaatctggcatcaccgaggttgacaggactgaggccaaggaaggtttgaaacggggcgagacaacccaccatgcggtgtcccgtgggagcgctaagctgcagtggtttgtcgaaagaaatatggtgattcctgagggaagggtcatcgatctcggctgtgggcgcggaggctggtcatactattgcgcaggtcttaaaaaggtgacggaagttcgggggtacaccaagggaggcccgggccacgaggagcccgtaccaatgagtacatatgggtggaacatagtgaaactgatgagcggaaaggacgtcttctacttgcctcccgaaaaatgtgatactctgctctgcgacatcggtgagtcctctcctagcccaaccgtggaagagtcccgaacaattagagttttaaagatggtggagccctggctgaggaataaccagttctgtatcaaagtccttaatccttacatgccaactgtgattgaacacctggagcgcctacagcggaagtatggcgggatgctcgtaagaaaccccctgtcacgtaattctacccatgaaatgtactggatcagtaacggaacaggcaatattgtgtcgagcgttaacatggtctccaggttgctgctcaaccggtttaccatgactcaccgccgaccgacgatcgagaaggatgtggaccttggtgccgggacaagacatgtgaatgctgaacctgagaccccaaacatggacgtcataggagagaggattaaacggatcaaggaagaacactcttcaacttggcactatgatgacgaaaatccctacaaaacctgggcctatcatggcagctacgaggttaaggcaacaggctccgccagttctatgatcaacggggtggtaaaactgttaacgaagccttgggatgtggtcccaatggtgacccaaatggctatgactgacacaacccccttcggacagcagcgcgtttttaaggaaaaagtggatactagaacaccgaggcctatgcccggtacccgaaaggtcatggagattacagcggagtggctgtggcggactttgggccgtaataaaaagccaagactctgcacccgcgaagagttcacgaaaaaggtgaggaccaacgccgcaatgggggctgtatttacagaagagaatcaatgggacagcgcccgggcagccgttgaagatgaggagttctggaagctggtggacaaagaaagagagctacacaaacttggaaaatgtggctcatgcgtctataacatgatgggtaagcgcgagaaaaagctgggggagtttggaaaagctaagggctccagggccatatggtacatgtggctcggcgcgcgatacctggagttcgaagcattggggtttctgaatgaggatcattggttcagtcgggaaaacagctattctggagtggagggtgaaggcctccacaaacttgggtacatcctgagagacatttccaaaatccctggaggcgccatgtatgctgatgacactgccggttgggacaccaggattacagaggatgacttacataatgaggaaaagatcactcagcagatggatcccgagcaccgccagctggcaaacgctatatttaaattgacctaccaaaataaggtggtcaaagttcagcgtccaacgcccaaggggacagtgatggacatcatttcacggaaggatcagagaggaagcggccaggtaggcacctatgggctcaacactttcacaaatatggaagcccaactggtgaggcagatggagggagaaggtgtcctatcgaaagctgaccttgagaaccctcatctgctcgagaagaaaatcacccagtggctggaaactaagggcgtggagcgcttgaaacgaatggccatttctggggatgactgcgttgtgaagccaatcgatgaccggtttgcaaacgcgttactggccctcaatgatatgggaaaggtcagaaaagacataccgcagtggcaacccagtaagggctggcatgattggcaacaggtgcctttctgttcccaccatttccacgaacttattatgaaagacggtaggaagctggtagttccatgccgcccccaggacgagctaatcgggagagctcggatcagccaaggagccggctggtcactgaaagaaaccgcatgtctcggcaaggcttacgcccagatgtggtccttgatgtattttcacaggcgtgatctgcgacttgcatctaacgccatttgcagcgcggtgcctgtccattggataccaacaagtcgcacgacctggtccatccacgctcatcaccagtggatgactacagaggacatgctgaccgtgtggaatagagtttggattgaggataacccctggatggaagacaagactcctgtgacaacctgggaggatgtcccgtacctcgggaaacgggaagaccaatggtgtggcagcttaatcggtctgacgtctagggccacatgggcacagaatattttgaccgccatccaacaggtgcgctcactgataggcgatgaggagttcctcgactacatgccaagtatgaagagatttcggaaagaagaggaaactgagggggctatctggtga

SEQ ID NO: 15211 - RNA, 9873 nt, synthetic construct
  misc_feature 1..9873: note = derived and/or modified CDS sequence (opt3) from DENV-3__GU131935__SS-prME
  source 1..9873: mol_type = other RNA
accagcctgtgcctcatgatgatgcttcccgcaactctggctttccacttgacttccagggacggagaacctaggatgatcgtggggaagaacgaacggggaaaatctttactgtttaagacggcatcaggtattaatatgtgtaccctaatagccatggatctcggcgagatgtgcgacgatactgtcacttacaaatgtccactgatcgcggaagttgagccggaagacattgattgctggtgtaaccttaccagtacttgggtgacctatgggacttgcaatcaggctggagagcaccgccgagacaagcgtagcgtcgccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcagcttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaattcaaagaacacgagtatgagcttttcctgcatcgttattggaataatcacactgtatctaggcgcggtcgtgcaggctgatatgggttgtgccattaattggaaggggaaggaactcaaatgcggatctggcatcttcgtgaccaacgaggtccacacttggacagagcagtacaagtttcaagcagacagccccaaacggctggccaccgctattgccggtgcatgggaaaatggcgtttgtgggatccgatcaactacccgcatggagaaccttttgtggaagcagatagctaatgaactgaactatatcctctgggagaataacattaaactgacagtggtggtaggagatatcattggcgtcttagaacaggggaagagaacgctgaccccacagcctatggagcttaaatacagttggaagacttggggaaaggccaaaatcgtgacagcggagacccaaaattccagcttcataattgacggccccaacacaccagaatgcccctctgcctcaagggcttggaacgtttgggaggtggaagactatggttttggggtcttcactaccaatatctggttgaagctccgggaggtgtacacgcagagttgtgatcatcgcctgatgagcgcagccattaaagacgaaagagctgttcacgccgatatgggatactggatcgagtcccagaagaacggctcttggaaactagagaaggcatcgtttatagaagtgaagacatgcacctggcctaaaagccacactctgtggtccaatggtgtactcgagtcagacatgatcattccaaagagtctggcgggcccgatctctcagcataaccacaggcccgggtatcatacccaaacagccggaccttggcaccttggcaaattggaactggatttcaattactgcgaggggactaccgtcgtgattacagagaactgtggaacgcgtggccccagcttacggaccactacagtgtccggtaagctcatccacgaatggtgctgtcgatcatgcaccctgccccctcttagatatatgggggaggacggatgttggtacggcatggaaataaggccaattaatgagaaagaagagaacatggtcaagagcctggtttctgctggttccggcaaggtggataattttactatgggggtattgtgcctcgccatcctgttcgaggaagtgatgcgcggaaaattcggcaagaaacatatgatcgcaggggtcctatttacattcgtgctgctcctgagtggacagattacctggcgggacatggctcacacgcttatcatgattggcagcaacgcctctgatagaatgggtatgggggttacttatttggcactgatagccacctttaagatccagcccttcttagctctcggatttttcctgaggaaacttacatcccgcgagaatctgctactcggcgtgggcctggcgatggccaccactttgcaactgccggaagacattgagcagatggcaaacgggatcgctttaggactcatgacactgaaacttattacccagtttgaaacataccagctgtggactgccttggtctcactcacctgtagtaatacgatcttcacactgaccgtggcctggcgaactgctaccctaatactggcgggtgttagccttctccctctgtgccaatcgtcctctatgcggaagacagattggttgccaatgactgtggccgcgatgggcgtaccacctctgcccttatttatcttcagcctcaaagacaccccaaagcgtagatcatggcctctgaacgagggggtaatggctgtgggacttgttagtattctggcctcctctttgctcaggaatgatgtgcccatggcaggcccactggtcgccggtgggctactgatcgcttgttatgtgattacgggaacaagcgcagaccttaccgtagagaaagccgcggacgtgacttgggaagaggaagctgagcagacaggcgtctcccataacctcatgatcaccgttgatgacgatggcactatgcgcataaaggacgatgaaacagagaacattctgaccgtgttgttaaaaacggccctgctcatcgtgtcagggatctttccgtacagcattcctgcaactctgcttgtctggcacacctggcagaagcagacacaacggagtggagtgctgtgggacgttccctctccacccgagacccagaaagccgaattggaggaaggtgtatacagaataaagcagcagggcatcttcgggaagacacaagtgggagtcggcgtgcagaaagagggtgtttttcatactatgtggcacgtgaccagaggggctgtcctaacgcacaatggaaagcgactggagcctaactgggcctccgtgaaaaaggatctcattagctatggcggcgggtggcgcctgaatgcacagtggcaaaaaggagaagaggtacaggtcatcgctgtggaaccaggtaagaaccccaagaatttccagacaatgcctggcattttccagactaccacaggggagatcggagccatagcgcttgactttaaaccgggcacctcgggttcaccaatcattaaccgggaagggaaggttgtgggattatacggcaatggcgtcgtgactaaaaacgggggatatgtttctggtatcgcccaaaccaatgcagagcccgatggccctacaccagagctggaagaggaaatgttcaagaaaagaaacctcacgattatggacttgcatcccgggagtggaaagactaggaagtacctgcctgctatcgtgcgtgaggccataaaacgccggctcagaaccctgattcttgctccgacaagggtcgtggcagccgaaatggaggaggccctgaagggcttgcccatccgatatcagaccactgctacaaaatccgaacacaccggtcgggagatcgtagatctaatgtgccatgcgacgtttactatgcgcctgctcagcccagtgagagttcctaattacaacttagtcattatggacgaagcacacttcacagatcccgcctctatcgctgccagggggtatataagcacccgggtgggaatgggcgaggcagccgctatttttatgaccgcgactccacctggcacagccgaagcattcccccagtccaatgctccaatccaggacgaggagcgagacattccggaaagatcatggaacagtgggaatgagtggatcaccgattttgtgggaaagacagtctggttcgtacctagcataaaagccggtaacgacattgcaaactgtctgcgcaagaatggcaagaaagtgatccaactttctaggaagacttttgatacggaataccagaaaacccgtctgaacgactgggatttcgttgtgacaactgacatctccgagatgggggccaattttaaggctgatcgggtcattgaccccagaaggtgcctcaaaccagtgatcttgaccgatggacccgagcgcgttattctggccggccctatgccagtgacagcggcatcagccgctcagcgaagaggtcgggtcgggaggaacccccagaaggaaaatgaccaatacatattcaccggccagcctctcaacaatgatgaggaccatgcccactggactgaagctaagatgctgcttgacaacatcaatacgccggagggaattatcccagcactattcgaacccgagcgcgagaaaagtgccgctatcgatggcgaatatcgtctgaagggggagagcagaaaaacctttgtggaattgatgcggaggggagacttacctgtatggctggcccacaaggtggcatccgagggtattaaatacacagatcgcaagtggtgcttcgacggcgaacgaaacaatcagatactcgaggagaacatggatgttgaaatctggactaaagagggggaaagaaagaagctgcggcccaggtggcttgacgcgcgcacctattctgatccactggccctcaaagagtttaaggacttcgctgccggaagaaaatcgattgcattggatctggtcacagaaatcggcagggtgcctagccatctagctcaccggacccgtaatgccctggacaacctcgtgatgcttcatacttcagagcacggtgggcgcgcataccgacacgccgtcgaggaactgcccgagacaatggaaacgttattgctgctcggcctgatgattcttctgaccggaggcgttatgctctttttgatctccgggaagggaataggtaaaacaagtatcggcctgatttgtgtgatcgtatctagcgggatgttatggatggctgatgtgccactacagtggattgcgtccgccatcgtcctggagttctttatgatggtgctccttatacctgagccggaaaagcaaagaacaccccaggacaatcagctggcatatgttgtgattggaatcttgaccctggctgccattgtcgccgcaaacgagatgggcctcctggaaaccacaaagagggatcttggtatgtcaaaagagccaggggtagtgtctcctactagctacctcgacgttgacctgcatcccgctagtgcctggacgttgtatgcggtggctaccacagtcatcactccaatgctgcggcacaccatagaaaattccacagccaacgtgagcttagcagccatcgctaaccaagcagtcgtgctaatgggcctggataagggatggcctatttctaaaatggacctcggcgttccccttctggccttggggtgctactcacaggtgaatccgctgaccctcactgcggctgtactgcttttagtgacgcattacgccatcattggaccaggcctgcaggcaaaggccacacgcgaggctcagaaaagaaccgccgcaggtatcatgaagaaccctactgtcgatgggataatgaccattgacctcgatcccgttatctatgactccaagttcgagaaacaattgggacaggtgatgctgctagtcctgtgtacagtgcagctccttctgatgaggacaagttgggctttgtgcgaagccctgaccctcgcgacaggcccaatcacgaccctgtgggagggtagccccggcaagttttggaatactacaattgccgtatcgatggcaaacatcttccgggggtcttacttagctggagccggccttgcattttccataatgaaaagcgtggggaccggacgaagaggcactggttcacagggggaaacactgggagagaagtggaaaaagaagctcaatcaactaagtcgcaaagagttcgatctgtataagaaatctggcattaccgaggttgacaggacggaggctaaggaaggtttgaaacggggcgagaccacacaccatgccgtgtcccgtgggagcgccaagctgcagtggtttgtcgaaagaaacatggtgatccctgagggaagggtcattgatctcggctgtgggcgcggaggctggtcatactattgcgcgggtcttaaaaaggtgactgaagttcgggggtacaccaagggaggcccgggccacgaggagcccgtaccaatgagtacatatgggtggaatatcgtgaaactgatgagcggaaaggacgtcttctacttgcctcccgaaaaatgtgatactctgctctgcgacataggtgagtcctctcctagcccaaccgtggaagagtcccgaacaatcagagttttaaagatggtggagccctggctgaggaacaatcagttctgtattaaagtccttaacccttacatgccaaccgtgatcgaacacctggagcgcctacagcggaagtatggcgggatgctcgtaagaaatcccctgtcacgtaactctactcatgaaatgtactggattagtaatggaacgggcaacatcgtgtcgagcgttaatatggtctccaggttgctgctcaaccggtttacaatgacccaccgccgaccgactattgagaaggatgtggaccttggtgctgggaccagacatgtgaacgcagaacctgagacaccaaatatggacgtcatcggagagaggataaaacggattaaggaagaacactcttcaacgtggcactatgatgacgaaaacccctacaaaacctgggcctatcatggcagctacgaggttaaggctactggctccgccagttctatgatcaatggggtggtaaaactgttaacaaagccttgggatgtggtcccaatggtgacccaaatggcaatgactgacacaacccccttcggacagcagcgcgtttttaaggaaaaagtggatacaagaactccgaggcctatgcccggtacccgaaaggtcatggagatcacggccgagtggctgtggcggaccttgggccgtaacaaaaagccaagactctgcacacgcgaagagttcactaaaaaggtgaggaccaatgctgcgatgggggccgtatttacagaagagaaccaatgggacagcgcacgggctgccgttgaagatgaggagttctggaagctggtggacagagaacgcgagctacacaaacttggaaagtgtggctcatgcgtctataatatgatgggtaaaagggaaaagaaactgggggagtttggaaaggcaaaaggctcccgagccatttggtacatgtggctcggcgctcggtacctggagttcgaagccttggggtttctgaacgaggatcattggttcagtagagaaaatagctattctggagtggagggtgaaggcctccacaaacttgggtacatactgagggacatctccaagattcctggaggcgcgatgtatgcagatgacactgccggttgggacacccgcatcacggaggatgacttacataacgaggagaaaattacacagcagatggatcccgagcaccgtcagctggctaatgccatctttaagttgacctaccaaaacaaagtggtcaaggttcagcggccaactcccaaagggacagtgatggacataatctcaagaaaggatcagaggggaagcggccaggtaggcacctatgggctcaatactttcaccaacatggaagcacaactggtgcgccagatggagggagaaggtgtcctatcgaaggctgaccttgagaatcctcatctgctcgagaaaaagattacacagtggctggaaacgaaaggcgtggagcgattgaagcggatggccatctctggggatgactgcgttgtgaaaccaattgatgacagatttgctaacgccttactggcactcaacgatatgggaaaggtcaggaaggacatcccgcagtggcaacccagtaaaggctggcatgattggcaacaggtgcctttctgttcccaccatttccacgaacttataatgaaggacggtcgcaaactggtagttccatgcagaccccaggacgagctaattgggcgggcgaggatcagccaaggagccggctggtcactgaaggaaaccgcttgtctcggcaaagcctacgcacagatgtggtccttgatgtattttcaccgtcgagatctgcgccttgcttctaatgccatctgcagcgcagtgcctgtccattggattccaacaagtagaacaacctggtccatacacgcccatcaccagtggatgactacagaggacatgctgaccgtgtggaaccgggtttggatcgaggataatccctggatggaagacaagacgcctgtgacaacctgggaggatgtcccgtacctcgggaagagggaagaccaatggtgtggcagcttaattggtctgacttctcgcgcgacctgggctcagaacatcttgacagccattcaacaggtgagatcactgatcggcaatgaggagttcctcgattacatgccaagtatgaaacggtttaggaaggaagaggaatccgagggggcaatatggtga

SEQ ID NO: 15212 - RNA, 9873 nt, synthetic construct
  misc_feature 1..9873: note = derived and/or modified CDS sequence (opt3) from DENV-3__GU131936__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagtctatcgagggaaaagtagtgcagtatgaaaacctcaagtacactgtcataattaccgtgcacacaggtgaccagcatcaggttggcaatgacacccaaggggtgactgtcgagatcacgccccaggcaagcacagtggaagctgtacttcctgagtatggaaccctgggcttggaatgctccccacgaactggtctagatttcaacgagatgattctgctcaccatgaaaaataaggcctggatggttcacagacagtggtttttcgacctgccgcttccctggacatcaggggcgaccactgagacacctacgtggaacaggaaagaactgttggtgacctttaagaatgcccatgcaaaaaagcaagaggtcgtggtcctcggcagtcaggaaggagctatgcacactgccctgacaggcgctaccgagatccagaacagcgggggaacatctatcttcgccggtcacttaaagtgtcggctgaaaatggataagctagaactcaaaggcatgtcctacgcaatgtgcctgaatacttttgtgcttaagaaagaggtttcagagacccagcatgggacgattttgataaaggtggaatacaagggagaggacgccccatgtaaaatccccttcagcaccgaagatggccaaggtaaggctcacaacgggcgtctgattacagcgaaccctgtagtcactaaaaaggaggagccagtgaatatcgaagcagagcccccgttcggcgaaagtaacatagttattggaatcggcgacaaagccctcaagatcaattggtataagaaagggtcttccattggaaagatgtttgaggctaccgcccgcggtgcaagaaggatggccatcctgggcgatacagcttgggacttcgggagcgtgggaggcgtccttaactcgctgggtaaaatggtgcatcagatttttgggtctgcctacactgcattgttctccggcgtatcatggataatgaagatcggaattggcgtgctcctgacctggatcgggttaaatagtaaaaacacgagcatgtccttttcttgcatcgttattggaataatcacactgtatctaggcgcggtcgtgcaggctgatatgggttgtgtgattaattggaaggggaaggaactcaaatgcggaaacggcatcttcgtcaccaatgaggttcacacttggacagagcagtacaagtttcaagccgacagccctaaacggctggcaaccgccattgctggtgcctgggaaaacggcgtgtgtgggatccgatcaactacccgcatggagaatcttttgtggaagcagatagcaaacgaactgaattatatcctctgggagaacaatattaaactgacagtggtagtcggagatatcattggcgtgttagaacaggggaagagagctctgacgccccagccaatggagcttaaatacagttggaagacctggggaaaggccaaaatcgttactgcggagacacaaaactccagcttcataattgacggccctaacacccccgaatgcccatctgcctcaagggcttggaatgtgtgggaggtcgaagactatggttttggggtgttcacaactaacatctggttgaagctccgggaggtttacacccagagttgtgatcatcgcctgatgagcgcagccattaaagacgaaagagctgtgcacgccgatatgggatactggatcgagtcccagaagaatggctcttggaaactagagaaggcatcgtttatagaagtaaagacgtgcacatggcccaaaagccacaccctgtggtccaacggtgtcctcgagtcagacatgatcattcctaagagtctggcgggcccaatctctcagcataatcacaggccggggtatcatactcaaaccgccggaccctggcaccttggcaaattggaactggatttcaactactgcgaggggacaactgtggtgattgctgagaattgtggaacccgtggccctagcttacggacaacgaccgtctccggtaagctcatccacgaatggtgctgtcgatcatgcactctgccaccccttagatatatgggggaggacggatgttggtacggcatggaaataaggcctattaacgagaaagaagagaatatggttaagagcctggtgtctgccggttccggcaaggtagataactttacaatgggggtgttgtgcctcgcaatcctgttcgaggaagtcatgcgcggaaaattcggcaagaaacatatgatcgctggggtgctatttaccttcgttctgctcctgagtggacagattacttggcgggacatggcccacacacttatcatgattggcagcaatgcatctgatagaatgggtatgggggtgacctatttggccctgatagctacgtttaagatccagccattcttagcgctcggatttttcctgaggaaacttacttcccgcgagaacctgctactcggcgtcggcctggccatggcaaccacattgcaactgcccgaagacattgagcagatggctaatgggatcgccttaggactcatgaccctgaagcttattactcagtttgaaacataccagctgtggaccgccttggtgtcactcacatgtagtaacactatcttcaccctgacggttgcttggcgaacagcaaccctaatactggccggtgtgagccttctcccgctgtgccaatcgtcctctatgcggaagactgattggttgcctatgaccgtcgcggctatgggcgtaccacccctgcctttatttatcttcagcctcaaagacacacccaagcgtagatcatggccactgaatgagggggtgatggccgttggacttgtgagtattctggcatcctctttgctcaggaacgatgtccctatggccggccccctggtggctggtgggctactgatcgcatgttatgtaattactggaaccagcgccgaccttacggtggagaaagcggctgacgtcacatgggaagaggaagccgagcagaccggcgtttcccataacctcatgatcactgtggatgacgatggcacaatgaagataaaagacgatgaaaccgagaatattctgactgtgttgttaaagacagcactgctcatcgtctcagggatctttccatacagcattccggccaccctgcttgtgtggcacacgtggcagaaacagactcaacgcagtggagttctgtgggacgtaccttctcccccagagacccagaaggctgaattggaggaaggtgtgtaccggataaagcagcagggcatcttcgggaaaacacaagtcggagtgggcgttcagaaggagggtgtgtttcataccatgtggcacgtcacaagaggggccgtgctaactcacaacggaaaaaggctggagcccaattgggcatccgtaaagaaagatctcattagctatggcggcgggtggcgactgtcggctcagtggcaaaagggagaagaggtccaggtgatcgccgttgaacctggtaagaacccaaaaaatttccagaccatgcccggcattttccagacgacaactggggagatcggagcgatagcccttgactttaagcctggcacctcaggttctccgatcattaaccgcgaagggaaagtggtcggattatacggcaatggcgtggttacaaagaacgggggatatgtgagtggtatcgcacaaaccaatgctgagccagatggccccactcctgagctggaagaggaaatgttcaaaaagcggaacctcaccattatggacttgcatccagggtccggaaagacaagaaaatacctgcccgccatcgtcagggaggctataaagcgtcgcctccggacgctgattcttgcacctactagagtggtagccgccgaaatggaggaggctctgaaaggcttgccgatcaggtatcagaccacagcgaccaagagcgaacacactggtcgagagatcgtggatctaatgtgccatgcaacatttaccatgcggctgctctctcccgttcgcgtcccaaattacaacttagtgattatggacgaagcccacttcacggatcctgctagcatcgccgcaagagggtatatatccactagggtgggaatgggcgaggccgctgcgatttttatgacagccacccccccaggcaccgcagaagctttccctcagtcaaatgcccccatccaggacgaggagcgggacattccagaacgaagttggaacagcgggaatgagtggatcactgattttgtcggaaaaacagtatggttcgtgccgtctataaaggcaggtaacgacattgccaactgtctgagaaagaatggcaaaaaggttatccaactttcccgcaaaacctttgatacagaataccagaagactaggctgaacgactgggatttcgtggtcacgaccgacatctcagagatgggggctaattttaaagccgatcgtgtgattgaccctcggagatgcctcaagcccgttatcttgacagatggaccagagagggtgattctggcgggccccatgcctgtcactgcagccagtgctgcccagcgccgaggtagagtggggcggaacccacagaaggaaaatgaccaatacatattcatgggccagcccctcaacaatgatgaggaccatgctcactggaccgaagcaaaaatgctgcttgacaacatcaatacacctgagggaattatcccggccctattcgaaccagagagggagaagagcgctgccatcgatggcgaatatcgcctgaaaggggagtcccgtaagacctttgtagaattgatgagacggggagacttacccgtgtggctggcacacaaagttgcgtctgagggtattaagtacactgataggaaatggtgcttcgacggcgaacgcaacaatcagatactcgaggagaacatggatgtcgaaatctggacgaaggagggggaacgaaagaaactgagacctcggtggcttgacgccaggacctattcggatcccctggctctcaaggagtttaaagacttcgccgcaggacgcaagagcattgctttggatctggtgacagaaatcggcagagtgccatcacatctagcccacaggactcggaatgcactggacaacctcgtcatgcttcatacctccgagcacggtgggcgtgcctaccgccacgctgttgaggaactgcctgagacaatggaaaccttattgctgctcggcctgatgattcttctgactggaggcgcgatgctctttttgatcagtgggaaaggaataggtaagacatctatcggcctgatttgtgtgatcgtaagctccgggatgttatggatggccgatgtgcccctacagtggattgcatcagctatcgtcctggagttctttatgatggtgctccttataccagagcctgaaaagcaacgaacgccgcaggacaatcagctggcctatgttgtgattggaatcttgaccctggccgcaattgtcgctgccaacgagatgggcctcctggaaactacaaaaagagatcttggtatgtctaaggagcccggggtagtgagcccaaccagttacctcgacgttgacctgcatcctgcgtccgcttggaccttgtatgccgtggcaacaactgtcatcacgcccatgctgaggcacaccatagaaaatagcacagccaacgtgtctttagctgcaatcgccaaccaagcggtcgtgctaatgggcctggataaaggatggccaatttcaaagatggacctcggcgttcctcttctggctttggggtgctactcccaggtgaatcccctgactctcaccgccgcagtactgcttttagtgacacattacgccatcattggaccgggcctgcaggctaaagccacccgggaggcacagaagcgcactgctgccggtatcatgaagaacccaacggtcgatgggataatgacaattgacctcgatcctgttatctatgacagtaaattcgagaagcaattgggacaggtgatgctgctagtcctgtgtgcggtgcagctccttctgatgagaaccagctgggccttgtgcgaagcactgactctcgctaccggccccatcacaactctgtgggagggttcgccaggcaaattttggaataccacaattgccgtatctatggcaaacatcttcagggggtcctacttagctggagccggccttgcctttagcataatgaagtcagtggggacgggacggcgaggcaccggtagtcagggggaaactctgggagagaaatggaagaagaaactcaatcaactatctagaaaggaattcgatctgtataaaaagtccggcattacagaggttgaccgcaccgaggcgaaagaaggtttgaagaggggcgagactacacaccatgctgtgagccgggggtcagcaaaactgcagtggtttgtcgaacgtaacatggtgatccccgagggaagagtcattgatctcggctgtgggaggggaggctggagttactattgcgccggtcttaagaaggtgaccgaagttcgcgggtacacgaaaggaggccctggccacgaggagccggtacccatgagcacctatgggtggaatatcgtgaagctgatgtccggaaaagacgtcttctacttgccacctgaaaagtgtgatacactgctctgcgacataggtgagtctagcccctcccctactgtggaagagtcacggaccatccgagttttaaaaatggtggagccatggctgagatctaaccagttctgtattaaggtccttaatccctacatgcctacagtgatcgaacacctggagaggctacagcgcaagtatggcgggatgctcgtacggaacccactgagtagaaattcgactcatgaaatgtactggattagcaacggaaccggcaatatcgtgtcctctgttaacatggtctcacgtttgctgctcaataggtttacaatgacccaccggcgccccactattgagaaagatgtggaccttggtgctgggacgcgacatgtgaacgccgaaccggagacacctaacatggacgtcatcggagagagaataaagaggattaaagaagagcacagctccacctggcactatgatgacgaaaatccatacaagacttgggcatatcatggcagttacgaggttaaagccaccggctctgctagctcaatgatcaacggggtggtaaagctgttaacaaagccctgggatgtggtccctatggtgacgcaaatggcgatgaccgacactacaccattcggacagcagcgggtttttaaagaaaaggtggatacccgcactcccagaccgatgcctggtacaaggaaagtcatggagatcaccgccgagtggctgtggcgaacattgggccggaataagaaaccccgtctctgcactagagaagagttcaccaagaaggtgcgcacgaacgcagctatgggggccgtatttaccgaagagaatcaatgggactccgcaagggccgctgttgaagatgaggagttctggaaactggtggacaaggaacgggagctacacaaacttggaaagtgtggcagttgcgtctataacatgatgggtaaaagagaaaagaaactgggggagtttggaaaggccaagggcagccgcgcgatttggtacatgtggctcggcgcaaggtacctggagttcgaagccttggggtttctgaatgaggatcattggttctctcgagaaaactcctattcaggagtggagggtgaaggcctccacaaacttgggtacatactgcgggacatcagcaagattccaggaggcgctatgtatgccgatgacacagcaggttgggacactagaatcaccgaggatgacttacataatgaggaaaaaattacacagcagatggatcctgagcacaggcagctggctaacgccatctttaagttgacttaccaaaataaagtggtcaaggttcagcgccccaccccaaaggggacggtgatggacataatctcgcgtaaagatcagcggggatctggccaggtaggcacatatgggctcaacaccttcactaatatggaagctcaactggtgagacagatggagggagaaggtgtcctaagtaaggccgaccttgagaacccccacctgctcgagaaaaagattacacagtggctggaaaccaaaggcgtggagaggttgaagcgcatggcaatctccggggatgactgcgttgtgaagcctattgatgaccgatttgcgaatgccttactggctctcaacgatatgggaaaagtccggaaggacatcccacagtggcaaccgagcaaaggctggcatgattggcagcaggtgcccttctgttcacaccatttccacgaacttataatgaaggacggtagaaaactggtagttccttgcaggccacaggacgagctaattgggcgcgccagaatctcccaaggagcaggctggtctctgaaggaaactgcttgtctcggcaaggcctacgcacagatgtggagcttgatgtattttcaccggagggatctgcgtcttgccagtaacgcgatctgctccgctgtgcccgtccattggattcctaccagccgaacaacgtggtctatacacgcccatcaccagtggatgaccactgaggacatgctgacagtgtggaatcgcgtttggatcgaggataacccatggatggaagacaaaacccccgtgactacatgggaggatgtcccttacctcgggaagagagaagaccaatggtgtggatcattaattggtctgaccagtcgggcaacgtgggcccagaatatcttgacagctattcagcaggtgaggtccctgatcggcgatgaggagttcctcgactacatgccgagcatgaaacgctttagaaaggaagaggaaaccgagggggccatatggtga

SEQ ID NO: 15213 - RNA, 9873 nt, synthetic construct
  misc_feature 1..9873: note = derived and/or modified CDS sequence (opt3) from DENV-3__GU131937__SS-prME
  source 1..9873: mol_type = other RNA
accagcctgtgcctcatgatgatgcttcccgcaactctggctttccacttgacttccagggacggagaacctaggatgatcgtggggaagaacgaacggggaaaatctttactgtttaagacggcatcaggtattaatatgtgtaccctaatagccatggatctcggcgagatgtgcgacgataccgtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcagcttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaatagtaaaaacacgtcaatgagcttttcctgcatcgttattggaataatcacactgtatctaggcgcggtcgtgcaggctgatatgggttgtgtgattaattggaaggggaaggaactcaaatgcggatctggcatcttcgtcaccaacgaggttcacacttggacagagcagtacaagtttcaagccgacagccccaaacggctggcaaccgccattgctggtgcctgggaaaatggcgtgtgtgggatccgatcaactacccgcatggagaaccttttgtggaagcagatagcaaatgaactgaactatatcctctgggagaataacattaaactgacagtggtagtcggagatatcattggcgtgttagaacaggggaagagaacgctgaccccacagcctatggagcttaaatacagttggaagacttggggaaaggctaaaatcgttacagccgagacccaaaattccagcttcataattgacggccccaacacaccagaatgcccctctactttgagggcgtggaacgtgtgggaggtcgaagactatggttttggggtgttcaccacgaatatctggctcaagctgcgggaggtttacacacagtcatgtgatcatcgcctaatgagtgccgctattaaagacgaaagagcagtgcacgccgatatgggatactggatcgagagccagaagaacggctcctggaaactggagaaggcttcttttatagaagtaaagacctgcacttggcctaaatcgcacaccctctggagcaatggtgtcctggagtccgacatgatcattccaaagtcacttgccggcccgatcagtcagcataactataggcccgggtaccacacacaaactgcaggaccttggcatttgggcaaactggaattagatttcaattattgcgaggggaccacagtggtgattacggagaactgtggaacccgtggcccatctctccggactacaaccgtcagcggtaagctgatccacgaatggtgctgtcgatcctgcactcttccccctctgagatacatgggggaggacggatgttggtatggcatggaaataaggccaattaatgagaaagaagagaacatggttaagtcattggtgagcgcgggttctggcaaggtagataattttacaatgggggtgctctgcctggccatcctattcgaggaagtcatgcgcggaaaattcggcaagaaacacatgatcgctggggtgctgtttaccttcgttctcctgctttccggacagattacgtggcgggacatggcccatactttgatcatgattggcagtaacgcaagcgatagaatgggtatgggggtgacctacctggctttaatagccacatttaagatccagcccttcctcgcactgggatttttccttaggaaactgacctctcgcgagaatctactcctgggcgtcggcttggccatggctactacactgcaattaccggaagacattgagcagatggcgaacgggatcgccctcggactgatgacccttaagctgattacacagtttgaaacttatcagttgtggaccgcactcgtgtccctgacgtgttcaaatacaatcttcaccctaactgttgcttggcgaaccgccacactgatacttgccggtgtgagtctcctgcctttgtgccaaagctcgtccatgcggaagactgattggctgccaatgaccgtcgctgcaatgggcgtaccccctttacccctctttatcttctctctgaaagacacgccaaagcgtagaagctggcctcttaacgagggggtgatggccgttggactggtgtcaattttggcgagttccctcctgaggaatgatgtccccatggctggcccgctagtagccggtgggctgcttatcgcatgttacgtaattacaggaacctctgccgacctcactgtggagaaagctgcagacgtcacatgggaagaggaagccgagcagaccggcgttagccacaacctgatgatcactgtggatgacgatggcacaatgcgcataaaggacgatgaaaccgagaacattttgacggtgttactgaaaactgcgctcctgatcgtctccgggatctttccatactcaattcctgctacccttctggtgtggcatacatggcagaagcagacccaacggagcggagttttgtgggacgtacccagtccacccgagacacagaaagccgaactagaggaaggtgtgtatagaataaagcagcagggcatcttcgggaagactcaagtcggagtgggcgttcagaaagagggtgtgtttcacaccatgtggcatgtcacgagaggggcggtgctgacacacaatggaaagcgactcgagcctaactgggcctctgtgaagaaggatctgatttcctacggcggcgggtggcgccttagcgctcagtggcaaaaaggagaagaggtccaggtgatcgccgttgaaccaggtaagaatcccaagaacttccagactatgcctggcattttccagaccacaaccggggagatcggagcaatagctttagactttaaaccgggcacttcgggttcaccaatcattaatcgggaagggaaggtggtcggactgtatggcaacggcgtggttaccaaaaatgggggatacgtgtctggtatcgcccaaacaaacgcggagcccgatggccctacgccagagctcgaagaggaaatgttcaagaaaagaaatttgactattatggacctgcaccccgggagtggaaagaccaggaagtatctccctgccatcgtccgtgaggcaataaaacgccggctgagaacacttattctggctccgaccagggtggtagccgctgaaatggaggaggcattgaagggcctacccatccgataccagactacagccaccaaatccgaacatacgggtcgggagatcgtggatctgatgtgccacgccacttttacaatgcgcctcttaagcccagttagagtccctaactataatctggtgattatggacgaagctcatttcaccgatcccgcgtctatcgcagccagggggtacataagcacccgggtgggaatgggcgaggctgccgcaatttttatgactgccacaccacctggcaccgctgaagcgttcccccagtccaacgccccaatccaggacgaggagcgagacattccggaaagatcatggaatagtgggaacgagtggatcacagattttgtcggaaagactgtatggttcgtgcctagcataaaagcaggtaatgacattgctaactgtcttcgcaagaacggcaagaaagttatccaactgtctaggaagacgtttgataccgaataccagaaaacacgtctcaatgactgggatttcgtggtcactaccgacatctccgagatgggggccaactttaaggcagatcgggtgattgaccccagaaggtgcttgaaaccagttatcctgacagatggacccgagcgcgtgattctcgccggccctatgccagtcaccgctgcctcagcggcacagcgaagaggtcgggtggggaggaatccccagaaggaaaacgaccaatatatattcactggccagcctctgaataacgatgaggaccacgcccattggacggaagctaagatgcttctagacaatatcaacaccccggagggaattatcccagccctgttcgaacccgagcgcgagaaaagtgctgcaatcgatggcgaataccgtttgaagggggagagcagaaaaacatttgtagaattaatgcggaggggagacctgcctgtgtggctcgcccacaaggttgcttccgagggtattaaatatactgatcgcaagtggtgcttcgacggcgaacgaaataaccagatactggaggagaatatggatgtcgaaatctggaccaaagagggggaaagaaagaaacttcggcccaggtggctggacgcccgcacatactctgatccactcgcattgaaagagtttaaggacttcgcggccggaagaaaatcgattgctctggatctagtgaccgaaatcggcagggtgcctagccacctggcccatcggactcgtaacgcactcgacaatcttgtcatgctgcacacatcagagcatggtgggcgcgcttatcgacacgccgttgaggaattacccgagacgatggaaaccttgctgctcctgggccttatgatttccctgactggaggcgcaatgctctttttgatcagtgggaagggaataggtaaaacatctatcggcctgatttgtgtgatcgtaagctccgggatgttatggatggccgatgtgccactacagtggattgcttcagcgatcgtcctggagttctttatgatggtgctccttatacctgagccggaaaagcaaagaacaccccaggacaaccagctggcctacgttgtgattggaatcttgaccctggcagctattgtcgccgccaatgagatgggcctcctggaaacaactaagagggatcttggtatgtctaaagagccaggggtagtgagccctacgagttatctcgacgttgacctgcaccccgcatccgcttggaccttgtacgccgtggcgacaactgtcatcaccccaatgctgcggcatacaatagaaaacagcaccgctaatgtgtctttagccgcaatcgccaaccaagctgtcgtgctaatgggcctggataagggatggcctatttcaaaaatggacctcggcgttccccttctggcattggggtgctactcccaggtgaacccgctgactctcacggccgcggtactgcttttagtgacacactatgctatcattggaccaggcctgcaggccaaggcaacccgcgaggcccagaaaagaactgctgccggtatcatgaagaatcctaccgtcgatgggataatgacaattgacctcgatcccgttatctacgacagtaagttcgagaaacaattgggacaggtgatgctgctagtcctgtgtgcagtgcagctccttctgatgaggactagctgggctttgtgcgaagccctgaccctcgcgacaggcccaatcacgaccctgtgggagggttcgcccggcaagttttggaacactacaattgccgtatctatggcaaatatcttccgggggtcctatttagctggagccggccttgcatttagcataatgaaatcagtggggaccggacgaagaggcactggtagtcagggggaaacactgggagagaagtggaaaaagaagctcaaccaactatctcgcaaagagttcgatctgtacaagaaatccggcattaccgaggttgacaggacggaggctaaggaaggtttgaaacggggcgagaccacacatcacgccgtgagccgtgggtcagccaagctgcagtggtttgtcgaaagaaatatggtgatccctgagggaagggtcattgatctcggctgtgggcgcggaggctggagttattactgcgcgggtcttaaaaaggtgactgaagttcgggggtataccaagggaggcccgggccatgaggagcccgtaccaatgagcacatacgggtggaacatcgtgaaactgatgtccggaaaggacgtcttctacttgcctcccgaaaaatgtgatactctgctctgcgacataggtgagtctagcccttccccaaccgtggaagagaatcgaacaatcagagttttaaagatggtggagccctggctgaggaacaatcagttctgtattaaagtccttaacccttatatgccaaccgtgatcgaacacctggagcgcctacagcggaagtacggcgggatgctcgtaagaaatcccctgtcacgtaactctactcacgaaatgtattggattagtaatggaacgggcaacatcgtgtcgagcgttaatatggtctccaggttgctgctcaaccggtttacaatgacccatcgccgaccgactattgagaaggatgtggaccttggtgctgggaccagacacgtgaacgcagaacctgagacaccaaatatggacgtcatcggagagaggataaaacggattaaggaagaacactcttcaacgtggcactacgatgacgaaaacccctataaaacctgggcctaccacggcagctatgaggttaaggctactggctccgccagttctatgatcaatggggtggtaaaactgttaacaaagccttgggatgtggtcccaatggtgacccaaatggcaatgactgacacaacccccttcggacagcagcgcgtttttaaggaaaaagtggatacaagaactccgaggcctatgcccggtacccgaaaggtcatggagatcacggccgagtggctgtggcggaccttgggccgtaacaaaaagccaagactctgcacacgcgaagagttcactaaaaaggtgaggaccaatgctgcgatgggggccgtatttacagaagagaaccaatgggacagcgcacgggctgccgttgaagatgaggagttctggaagctggtggacagagaacgcgagctacataaacttggaaagtgtggctcatgcgtctacaatatgatgggtaaaagggaaaagaaactgggggagtttggaaaggcaaaaggctcccgagccatttggtacatgtggctcggcgctcggtatctggagttcgaagccttggggtttctgaacgaggatcactggttcagtagagaaaatagctactctggagtggagggtgaaggcctccataaacttgggtatatactgagggacatctccaagattcctggaggcgcgatgtacgcagatgacactgccggttgggacacccgcatcacggaggatgacttacacaacgaggagaaaattacacagcagatggatcccgagcatcgtcagctggctaatgccatctttaagttgacctatcaaaacaaagtggtcaaggttcagcggccaactcccaaagggacagtgatggacataatctcaagaaaggatcagaggggaagcggccaggtaggcacctacgggctcaatactttcaccaacatggaagcacaactggtgcgccagatggagggagaaggtgtcctatcgaaggctgaccttgagaatcctcatctgctcgagaaaaagattacacagtggctggaaacgaaaggcgtggagcgattgaagcggatggccatctctggggatgactgcgttgtgaaaccaattgatgacagatttgctaacgccttactggcactcaacgatatgggaaaggtcaggaaggacatcccgcagtggcaacccagtaaaggctggcacgattggcaacaggtgcctttctgttcccatcacttccatgaacttataatgaaggacggtcgcaaactggtagttccatgcagaccccaggacgagctaattgggcgggcgaggatcagccaaggagccggctggtcactgaaggaaaccgcttgtctcggcaaagcctatgcacagatgtggtccttgatgtactttcaccgtcgagatctgcgccttgcttctaatgccatctgcagcgcagtgcctgtccactggattccaacaagtagaacaacctggtccatacatgcccaccatcagtggatgactacagaggacatgctgaccgtgtggaaccgggtttggatcgaggataatccctggatggaagacaagacgcctgtgacaacctgggaggatgtcccgtacctcgggaagagggaagaccaatggtgtggcagcttaattggtctgacttctcgcgcgacctgggctcagaacatcttgacagccattcaacaggtgagatcactgatcggcgatgaggagttcctcgactatatgccaagtatgaaacggtttaggaaggaagaggaatccgagggggcaatatggtga

SEQ ID NO: 15214 - RNA, 9873 nt, synthetic construct
  misc_feature 1..9873: note = derived and/or modified CDS sequence (opt3) from DENV-3__GU131938__SS-prME
  source 1..9873: mol_type = other RNA
accagcctgtgcctcatgatgatgcttcccgcaaccctggctttccacttgacttcccgggacggcgaacctaggatgatcgtggggaagaacgaacggggaaaatctttactgtttaagacggcgtcaggtattaatatgtgtaccctaatagccatggatctcggcgaaatgtgcgacgatacagtcacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagggactttgttgaaggactgtcaggtgccacctgggtggatgtcgtgctagagcatggcgggtgcgtgacgactatggcaaagagcaaacccacactcgacatcgagctgcagaagaccgaagcaactcagcttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagtctatcgagggaaaagtagtgcagtatgaaaacctcaagtacactgtcataattaccgtgcacacaggtgaccagcatcaggttggcaatgacacccaaggggtgactgtcgagatcacgccccaggcaagcacagtggaagctgtacttcctgagtatggaaccctgggcttggaatgctccccacgaactggtctagatttcaacgagatgattctgctcaccatgaaaaataaggcctggatggttcacagacagtggtttttcgacctgccgcttccctggacatcaggggcgaccactgagacacctacgtggaacaggaaagaactgttggtgacctttaagaatgcccatgccaagaagcaagaggtcgtggtcctcggcagtcaggaaggagctatgcacactgccctgacaggcgctaccgagatccagaacagcgggggaacatctatcttcgccggtcacttaaagtgtcggctgaaaatggataagctagaactcaaaggcatgtcctacgcaatgtgcctgaatacttttgtgcttaagaaagaggtttcagagacccagcatgggacgattttgataaaggtggaatacaagggagaggacgccccatgtaaaatccccttcagcaccgaagatggccaaggtaaggctcacaacgggcgtctgattacagcgaaccctgtagtcactaaaaaggaggagccagtgaatatcgaagcagagcccccgttcggcgaaagtaacatagttattggaatcggcgacaaagccctcaagatcaattggtataagaaagggtcttccattggaaagatgtttgaggctaccgcccgcggtgcaagaaggatggccatcctgggcgatacagcttgggacttcgggagcgtgggaggcgtccttaactcgctgggtaaaatggtgcatcagatttttgggtctgcctacactgcattgttctccggcgtatcatggataatgaagatcggaattggcgtgctcctgacctggatcgggttaaatagtaaaaacacgagcatgtccttttcttgcatcgttattggaataatcacactgtatctaggcgcggtcgtgcaggctgatatgggttgtgtgattaattggaaggggaaggaactcaaatgcggaaacggcatcttcgtcaccaatgaggttcacacttggacagagcagtacaagtttcaagccgacagccctaaacggctggcaaccgccattgctggtgcctgggaaaacggcgtgtgtgggatccgatcaactacccgcatggagaatcttttgtggaagcagatagcaaacgaactgaattatatcctctgggagaacaatattaaactgacagtggtagtcggagatatcattggcgtgttagaacaggggaagagagctctgacgccccagccaatggagcttaaatacagttggaagacctggggaaaggccaaaatcgttactgcggagacacaaaactccagcttcataattgacggccctaacacccccgaatgcccatctgcctcaagggcttggaatgtgtgggaggtcgaagactatggttttggggtgttcacaactaacatctggttgaagctccgggaggtttacacccagagttgtgatcatcgcctgatgagcgcagccattaaagacgaaagagctgtgcacgccgatatgggatactggatcgagtcccagaagaatggctcttggaaactagagaaggcatcgtttatagaagtaaagacgtgcacatggcccaaaagccacaccctgtggtccaacggtgtcctcgagtcagacatgatcattcctaagagtctggcgggcccaatctctcagcataatcacaggccggggtatcatactcaaaccgccggaccctggcaccttggcaaattggaactggatttcaactactgcgaggggacaactgtggtgattgctgagaattgtggaacccgtggccctagcttacggacaacgaccgtctccggtaagctcatccacgaatggtgctgtcgatcatgcactctgccaccccttagatatatgggggaggacggatgttggtacggcatggaaataaggcctattaacgagaaagaagagaatatggttaagagcctggtgtctgccggttccggcaaggtagataactttacaatgggggtgttgtgcctcgcaatcctgttcgaggaagtcatgcgcggaaaattcggcaagaaacatatgatcgctggggtgctatttaccttcgttctgctcctgagtggacagattacttggcgggacatggcccacacacttatcatgattggcagcaatgcatctgatagaatgggtatgggggtgacctatttggccctgatagctacgtttaagatccagccattcttagcgctcggatttttcctgaggaaacttacttcccgcgagaacctgctactcggcgtcggcctggccatggcaaccacattgcaactgcccgaagacattgagcagatggctaatgggatcgccttaggactcatgaccctgaaacttattactcagtttgaaacataccagctgtggaccgccttggtgtcactcacatgtagtaacactatcttcaccctgacggttgcttggcgaacagcaaccctaatactggccggtgtgagccttctcccgctgtgccaatcgtcctctatgcggaagactgattggttgcctatgaccgtcgcggctatgggcgtaccacccctgcctttatttatcttcagcctcaaagacacacccaagcgtagatcatggccactgaatgagggggtgatggccgttggacttgtgagtattctggcatcctctttgctcaggaacgatgtccctatggccggccccctggtggctggtgggctactgatcgcatgttatgtaattactggaaccagcgccgaccttacggtggagaaagcggctgacgtcacatgggaagaggaagccgagcagaccggcgtttcccataacctcatgatcactgtggatgacgatggcacaatgaagataaaagacgatgaaaccgagaatattctgactgtgttgttaaagacagcactgctcatcgtctcagggatctttccatacagcattccggccaccctgcttgtgtggcacacgtggcagaaacagactcaacgcagtggagttctgtgggacgtaccttctcccccagagacccagaaggctgaattggaggaaggtgtgtaccggataaagcagcagggcatcttcgggaaaacacaagtcggagtgggcgttcagaaggagggtgtgtttcataccatgtggcacgtcacaagaggggccgtgctaactcacaacggaaaaaggctggagcccaattgggcatccgtaaagaaagatctcattagctatggcggcgggtggcgactgtcggctcagtggcaaaagggagaagaggtccaggtgatcgccgttgaacctggtaagaaccccaaaaatttccagaccatgcccggcattttccagacgacaactggggagatcggagcgatagcccttgactttaagcctggcacctcaggttctccgatcattaaccgcgaagggaaagtggtcggattatacggcaatggcgtggttacaaagaacgggggatatgtgagtggtatcgcacaaaccaatgctgagccagatggccccactcctgagctggaagaggaaatgttcaaaaagcggaacctcaccattatggacttgcatccagggtccggaaagacaagaaaatacctgcccgccatcgtcagggaggctataaagcgtcgcctccggacgctgattcttgcacctactagagtggtagccgccgaaatggaggaggctctgaaaggcttgccgatcaggtatcagaccacagcgaccaagagcgaacacactggtcgagagatcgtggatctaatgtgccatgcaacatttaccatgcggctgctctctcccgttcgcgtcccaaattacaacttagtgattatggacgaagcccacttcacggatcctgctagcatcgccgcaagagggtatatatccactagggtgggaatgggcgaggccgctgcgatttttatgacagccacaccaccaggcaccgcagaggctttccctcagtcaaatgcccccatccaggacgaggagcgggacattccagaacgaagttggaacagcgggaatgagtggatcactgattttgtcggaaaaacagtatggttcgtgccgtctataaaggcaggtaacgacattgccaactgtctgagaaagaatggcaaaaaggttatccaactttcccgcaaaacctttgatacagaataccagaagactaggctgaacgactgggatttcgtggtcacgaccgacatctcagagatgggggctaattttaaagccgatcgtgtgattgaccctcggagatgcctcaagcccgttatcttgacagatggaccagagagggtgattctggcgggccccatgcctgtcactgcagccagtgctgcccagcgccgaggtagagtggggcggaacccacagaaggaaaatgaccaatacatattcatgggccagcccctcaacaatgatgaggaccatgctcactggaccgaagcaaaaatgctgcttgacaacatcaatacacctgaggccattatcccggctctattcgaaccagagagggaaaagagcgccgcaatcgatggagaatatcgcctgaaaggcgagtcccgtaagacctttgtagaattgatgagaagaggggacttacccgtgtggctggcgcacaaagttgcctctgagggaattaagtacactgataggaaatggtgcttcgacggtgaacgcaacaatcagatactcgaggagaacatggatgtcgaaatctggacgaaggagggcgaacgaaagaaactgagacctcggtggcttgacgctaggacctattcggatcccctggccctcaaggagtttaaagacttcgcagctgggcgcaagagcattgccttggatctggtgacagaaatcggaagagtgccatcacatctagcacacaggactcggaatgccctggacaacctcgtcatgcttcatacctccgagcacggcggtcgtgcttaccgccacgcggttgaggaactgcctgagacaatggaaaccttattgctgctcgggctgatgattcttctgactggcggagccatgctctttttgatcagtggcaaagggataggaaagacatctatcggtctgatttgtgtgatcgtaagctccggcatgttatggatggcagatgtgcccctacagtggattgcttcagccatcgtcctggagttctttatgatggtgctccttataccagagcctgaaaagcaacgaacgccgcaggacaatcagctggcctatgttgtgattgggatcttgaccctggcagctattgtcgccgcgaacgagatgggactcctggaaactacaaaaagagatcttggcatgtctaaggagcccggtgtagtgagcccaaccagttacctcgacgttgacctgcatcctgcttccgcctggaccttgtatgcagtggccacaactgtcatcacgcccatgctgaggcacaccatagaaaatagcacagctaacgtgtctttagcagccatcgcgaaccaagctgtcgtgctaatggggctggataaaggctggccaatttcaaagatggacctcggagttcctcttctggccttgggctgctactcccaggtgaatcccctgactctcaccgcagccgtactgcttttagtgacacattacgctatcattgggccgggactgcaggccaaagcaacccgggaggctcagaagcgcactgccgcgggcatcatgaagaacccaacggtcgatggtataatgacaattgacctcgatcctgttatctatgacagtaaattcgagaagcaattgggacaggtgatgctgctagtcctgtgtgccgtgcagctccttctgatgagaaccagctgggcattgtgcgaagctctgactctcgccaccggacccatcacaactctgtgggagggctcgccaggtaaattttggaataccacaattgcagtatctatggctaacatcttcaggggctcctacttagccggggccggacttgcgtttagcataatgaagtcagtgggcacggggcggcgaggaaccggcagtcagggtgaaactctgggggagaaatggaagaagaaactcaatcaactatctagaaaggagttcgatctgtataaaaagtccggaattacagaggttgaccgcaccgaggctaaagaaggcttgaagaggggtgagactacacaccatgcagtgagccggggctcagccaaactgcagtggtttgtcgaacgtaacatggtgatccccgaggggagagtcattgatctcggatgtggcagaggcgggtggagttactattgcgctgggcttaagaaggtgaccgaagttcgcggttacacgaaagggggacctggccacgaggagccggtacccatgagcacctatggctggaatatcgtgaagctgatgtccgggaaagacgtcttctacttgccacctgaaaagtgtgatacactgctctgcgacataggagagtctagcccctcccctactgtggaagagtcacggaccatccgagttttaaaaatggtggagccatggctgagatctaaccagttctgtattaaggtccttaatccctacatgcctacagtgatcgaacacctggagaggctacagcgcaagtatggtggcatgctcgtacggaacccactgagtagaaattcgactcatgaaatgtactggattagcaacgggaccggaaatatcgtgtcctctgttaacatggtctcacgtttgctgctcaataggtttacaatgacccaccggcgccccactattgagaaagatgtggaccttggcgccggtacgcgacatgtgaacgcagaaccggagacacctaacatggacgtcatcggggagagaataaagaggattaaagaagaacacagctccacctggcactatgatgacgaaaatccatacaagacttgggcctatcatggaagttacgaggttaaagctaccggctctgcgagctcaatgatcaacggcgtggtaaagctgttaacaaagccctgggatgtggtccctatggtgacgcaaatggccatgaccgacactacaccattcgggcagcagcgggtttttaaagaaaaggtggatacccgcactcccagaccgatgcctggaacaaggaaagtcatggagatcaccgcagagtggctgtggcgaacattgggtcggaataagaaaccccgtctctgcactagagaagagttcaccaagaaggtgcgcacgaacgctgccatgggcgcagtatttaccgaagagaatcaatgggactccgccagggctgccgttgaagatgaggagttctggaaactggtggacaaggaacgggagctacacaaacttgggaagtgtggaagttgcgtctataacatgatgggcaaaagagaaaagaaactgggtgagtttgggaaggcgaagggaagccgcgcaatttggtacatgtggctcggcgccaggtacctggagttcgaggctttgggctttctgaatgaggatcattggttctctcgagaaaactcctattcaggggtggagggagaaggtctccacaaacttggctacatactgcgggacatcagcaagattccagggggagccatgtatgcagatgacacagctggctgggacactagaatcaccgaggatgacttacataatgaggagaaaattacacagcagatggatcctgagcacaggcagctggccaacgctatctttaagttgacttaccaaaataaagtggtcaaggttcagcgccccaccccaaagggtacggtgatggacataatctcgcgtaaagatcagcgggggtctggacaggtaggcacatatggcctcaacaccttcactaatatggaagcccaactggtgagacagatggagggggaaggagtcctaagtaaggcagaccttgagaacccccatctgctcgagaaaaagattacacagtggctggaaaccaaaggtgtggagaggttgaagcgcatggcgatctccggcgatgactgcgttgtgaagcctattgatgaccgatttgccaatgctttactggccctcaacgatatggggaaagtccggaaggacatcccacagtggcaaccgagcaaaggatggcatgattggcaacaggtgcccttctgttcacaccatttccacgaacttataatgaaggacggcagaaaactggtagttccttgcaggccacaggacgagctaattggtcgcgcaagaatctcccaaggggctggatggtctctgaaggaaactgcctgtctcggcaaggcatacgcccagatgtggagcttgatgtattttcaccggagggatctgcgtcttgcgagtaacgctatctgctccgccgtgcccgtccattggattcctaccagccgaacaacgtggtctatacacgcacatcaccagtggatgaccactgaggacatgctgacagtgtggaatcgcgtttggatcgaggataacccatggatggaagacaaaacccccgtgactacatgggaggatgtcccttacctcggcaagagagaagaccaatggtgtgggtcattaattggactgaccagtcgggccacgtgggctcagaatatcttgacagccattcaacaggtgaggtccctgatcggtgatgaggagttcctcgactacatgccgagcatgaaacgctttagaaaggaagaggaaaccgagggcgcaatatggtga

SEQ ID NO: 15215 - RNA, 9873 nt, synthetic construct
  misc_feature 1..9873: note = derived and/or modified CDS sequence (opt3) from DENV-3__GU131939__SS-prME
  source 1..9873: mol_type = other RNA
accagcctgtgcctcatgatgatgcttcccgcaacactggctttccacttgacttccagagacggagaacctaggatgatcgtggggaagaacgaacggggaaaatctttactgtttaagacggcatcaggtattaatatgtgtaccctaatagcaatggatctcggcgaaatgtgcgacgatacagtcacttacaaatgtccactgatcgcggaagttgaaccggaagacattgattgctggtgtaaccttaccagtacatgggtgacctatgggacttgcaatcaggctggagagcaccgccgagacaagcgtagcgtcgccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaaaagcaaacccacactcgacatcgagctgcagaagaccgaagcaactcagcttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccatcaatatagaagcagagccgcctttcggcgaaagcaacattgtgatcggaatcggcgacaaagccctcaagattaattggtataagaaagggagttctatcggaaagatgtttgaggctaccgcccgcggtgcaagaaggatggccattctgggcgatacagcttgggacttcgggtccgttggaggcgtgcttaacagcctgggtaaaatggtccatcagatatttgggtcggcctacactgcattgttctctggcgtgtcctggatcatgaagattggaatcggcgtactcctgacctggatcgggttaaatagtaaaaacacgtcaatgagcttttcctgcattgtgataggaatcattacactgtatctaggcgcggttgtccaggctgatatgggttgtgtgatcaattggaaggggaaggaactcaaatgcggaaacggcattttcgtgaccaatgaggtccacacttggacagagcagtacaagtttcaagccgactctcccaaacggctggcaaccgccatcgctggtgcctgggaaaacggcgtttgtgggatacgaagcactacccgcatggagaatcttttgtggaagcagatcgcaaacgaactgaattatattctctgggagaacaatatcaaactgacagtggtggtaggagatattatcggcgtcttagaacaggggaagagaacgctgaccccacagcctatggagcttaaatactcatggaagacttggggaaaggctaaaatagtgacagccgagacccaaaacagttccttcattatcgacggccccaacacaccagaatgccccagcgcgtctagggcctggaatgtttgggaggtggaagactatggttttggggtcttcactaccaacatttggttgaagctccgggaggtgtacacgcagtcatgtgatcatcgcctgatgagtgctgcaatcaaagacgaaagagccgttcacgctgatatgggatactggatagagagccagaagaatggctcctggaaactagagaaggcctcttttatcgaagtgaagacatgcacctggcctaaatcgcacactctgtggagcaacggtgtactcgagtccgacatgattatcccaaagtcactggcaggcccgattagtcagcataatcacaggcccgggtatcatacccaaacagcgggaccttggcaccttggcaaattggaactggatttcaactactgcgaggggactaccgtcgtgatcgccgagaattgtggaacacgtggcccatctttacggacgaccactgtgagcggtaagctcatacacgaatggtgctgtcgatcctgcacactgccccctcttagatatatgggggaggacggatgttggtacggcatggaaattaggccaatcaacgagaaagaagagaatatggtcaagtcactggttagcgctggttctggcaaggtggataactttaccatgggggtattgtgcctcgccatcctgttcgaggaagtgatgcgcggaaaattcggcaagaaacatatgattgcaggggtcctatttactttcgtgctgctcctgtccggacagatcacatggcgggacatggctcacacccttattatgataggcagtaatgccagcgatagaatgggtatgggggttacgtatttggcactgatcgccacttttaagattcagcccttcttagctctcggatttttcctgaggaaacttacctctcgcgagaacctgctactcggcgtgggcctggcgatggccacaaccttgcaactgccggaagacatcgagcagatggcaaatgggattgctttaggactcatgactctgaaacttatcacacagtttgaaacctaccagctgtggacagccttggtctccctcacttgttcaaacaccatattcacgctgacagtggcctggcgaaccgctactctaatcctggccggtgttagtcttctccctctgtgccaaagctcgtccatgcggaagaccgattggttgccaatgacagtggccgcgatgggcgtaccccctctgcccttatttattttctctctcaaagacactccaaagcgtaaaagctggcctctgaatgagggggtaatggctgtgggacttgtttcaatcctggccagttccttgctcagaaacgatgtgcccatggcaggcccactggtcgccggtgggctactgattgcttgttatgtgatcaccggaacgtctgcagaccttacagtagagaaggccgcggacgtgacctgggaagaggaagctgagcagactggcgtcagccataacctcatgataacagttgatgacgatggcaccatgaggattaaagacgatgaaactgagaatatcctgacagtgttgttaaagaccgccctgctcatcgtgtccgggatttttccgtactcaatacctgcaacgctgcttgtctggcacacttggcagaaacagacccaacgcagcggagtgctgtgggacgttcccagtccacccgagacacagaaggccgaattggaggaaggtgtataccggatcaagcagcagggcattttcgggaaaacccaagtgggagtcggcgtgcagaaggagggtgtttttcatacaatgtggcacgtgactagaggggctgtcctaacccacaacggaaaaaggctggagcctaattgggcctctgtgaagaaagatctcatctcctatggcggcgggtggcgactgagcgcacagtggcaaaagggagaagaggtacaggtcattgctgtggaaccaggtaagaaccccaaaaatttccagacgatgcctggcatcttccagacaactaccggggagataggagccatcgcgcttgactttaagccgggcacatcgggttcaccaattatcaaccgcgaagggaaagttgtgggattatacggcaatggcgtcgtgaccaagaacgggggatatgtttctggtattgcccaaactaatgcagagcccgatggccctaccccagagctggaagaggaaatgttcaaaaagcggaacctcacaatcatggacttgcatcccgggagtggaaagacgagaaaatacctgcctgctatagtgagggaggccattaagcgtcgcctccggactctgatccttgctccgaccagagtcgtggcagccgaaatggaggaggccctgaaaggcttgcccatcaggtatcagacaaccgctactaagtccgaacacacaggtcgagagattgtagatctaatgtgccatgcgacctttacgatgcggctgctcagcccagtgcgcgttcctaattacaacttaatcataatggacgaagcacacttcactgatcccgcctctattgctgccagagggtatatcagcacaagggtcggaatgggcgaggcagccgctatttttatgaccgcgaccccacctggcactgccgaagcattcccccagtccaatgctccaatccaggacgaggagcgggacataccggaacgatcatggaacagtgggaatgagtggattacagattttgtgggaaaaaccgtgtggttcgtccctagcatcaaggccggtaacgacatcgcaaactgtctgagaaagaatggcaaacgcgtaattcaactttctaggaagacatttgatactgaataccagaaaacgcgtctgaacgactgggatttcgtggttaccacagacatctccgagatgggggccaattttaaggctgatcgggtgattgaccccagaaggtgcctcaaaccagtcatattgactgatggacccgagcgcgtgatcctggccggccctatgccagttaccgcggcatcagccgctcagcgaagaggtcgggtggggaggaacccccagaaggaaaatgaccaatacattttcacaggccagcctctcaacaatgatgaggaccatgcccactggaccgaagctaagatgctgcttgacaacatcaatactccggagggaatcattccagcactattcgaacccgagcgcgagaaaagtgccgctatagatggcgaatatcgtctgaagggggagagcagaaaaacgtttgtcgaattgatgcggaggggagacttacctgtgtggctggcccacaaggtagcatccgagggtatcaaatacaccgatcgcaagtggtgcttcgacggcgaacgaaacaatcagattctcgaggagaacatggatgtggaaatctggacaaaagagggggaaagaaagaagctgcggcccaggtggcttgacgcgcgcacttattctgatccactggccctcaaagagtttaaggacttcgctgccggaagaaaatcgattgcattggatctggttaccgaaatcggcagggtccctagccatctagctcaccggacacgtaatgccctggacaacctcgtgatgcttcatacctcagagcacggtgggcgcgcataccgacacgccgtggaggaactgcccgagactatggaaacattattgctgctcggcctgatgatacttctgacgggaggcgctatgctctttttgatctccgggaagggaattggtaaaaccagtatcggcctgatttgtgtcatcgtttctagcgggatgttatggatggcggatgtgccactacagtggatagcctccgcaattgtactggagttctttatgatggtgctccttatccctgagccggaaaagcaaagaactccccaggacaatcagctggcttatgtcgtgattggaatcttgacactggccgccatagttgcagctaacgagatgggcctcctggaaaccaccaagagggatcttggtatgtcaaaagagccaggggtggtctctcctacaagctacctcgacgtagacctgcatcccgccagtgcgtggactttgtatgctgtggccacgaccgttatcacaccaatgctgcggcacactattgaaaattccaccgcaaacgtgagcttagccgctatcgcaaaccaagccgtcgtgctaatgggcctggataagggatggcctatttctaaaatggacctcggcgtcccccttctggcgttggggtgctactcacaggtgaatccgctgacactcaccgctgccgttctgcttttagtgactcattacgcaatcataggaccaggcctgcaggccaaggctacgcgcgaggcccagaaaagaacagcagctggtattatgaagaaccctaccgtagatgggatcatgactatcgacctcgatcccgtgatttatgactccaagttcgagaaacaattgggacaggtcatgctgctagttctgtgtgccgtgcagctccttctgatgaggaccagttgggcgttgtgcgaagccctgacactcgcaactggcccaatcaccacactgtgggagggtagccccggcaagttttggaatacgaccatagctgtctcgatggccaacattttccgggggtcttacttagcaggagctggccttgccttttccatcatgaaaagcgtggggactggacgaagaggcacaggttcacagggggaaaccctgggagagaagtggaaaaagaagctcaatcaactaagtcgcaaagagttcgatctgtataagaaatctggcattactgaggtagacaggacagaggccaaggaaggtttgaaacggggcgagaccacgcaccatgcggtgtcccgtgggagcgctaagctgcagtggtttgttgaaagaaacatggtgatccctgagggaagggtcatagatctcggctgtgggcgcggaggctggtcatactattgcgcaggtcttaaaaaggtgaccgaagtccgggggtacacaaagggaggcccgggccacgaggagcccgtgccaatgagtacttatgggtggaatatcgttaaactgatgagcggaaaggacgtattctacttgcctcccgaaaaatgtgataccctgctctgcgacattggtgagtcctctcctagcccaacagtggaagagtcccgaactatcagagtcttaaagatggtggagccctggctgaggaacaatcagttctgtattaaagttcttaacccttacatgccaaatgtgatcgaacacctggagcgcctacagcggaagtatggcgggatgctcgtcagaaaccccctgtcacgtaattctacccatgaaatgtactggattagtaacggaacaggcaatatcgtgtcgagcgtaaacatggtgtccaggttgctgctcaaccggtttaccatgactcaccgccgaccgacgatagagaaggatgttgaccttggtgccgggacaagacatgtcaatgctgaacctgagaccccaaacatggacgtgattggagagaggatcaaacggatcaaggaagaacactcttcaacttggcactatgatgacgaaaatccctacaaaacctgggcctatcatggcagctacgaggtgaaggcaacaggctccgccagttctatgattaacggggtcgttaaactgttaacgaagccttgggatgtggtaccaatggtgacccaaatggctatgactgacacaacccccttcggacagcagcgcgtctttaaggaaaaagtggatactagaacaccgaggcctatgcccggtacccgaaaggttatggagataacagcggagtggctgtggcggactttgggccgtaataaaaagccaagactctgcacccgcgaagagttcacgaaaaaggtgaggaccaacgccgcaatgggggctgtctttacagaagagaatcaatgggacagcgcccgggcagccgtggaagatgaggagttctggaagctggtagacaaagaaagagagctacacaaacttggaaaatgtggctcatgcgtttataacatgatgggtaagcgcgagaagaagctgggggagtttggaaaagctaagggctccagggccatctggtacatgtggctcggcgcgcgatacctggagttcgaagcattggggtttctgaatgaggatcattggttcagtcgggaaaacagctattctggagtggagggtgaaggcctccacaaacttgggtacattctgagagacatctccaaaattcctggaggcgccatgtatgctgatgacactgccggttgggacaccaggatcacagaggatgacttacataatgaggaaaagataactcagcagatggatcccgagcaccgccagctggcaaacgctatctttaaattgacctaccaaaataaggtcgtgaaagtgcagcgtccaacgcccaaggggacagtcatggacattatctcacggaaggatcagagaggaagcggccaggttggcacctatgggctcaacactttcacaaatatggaagcccaactggtgaggcagatggagggagaaggtgtactatcggaggctgaccttgagaaccctcatctgctcgagaagaagattacccagtggctggagactaaaggcgtggaacgcttgaagcgaatggccatctctggggatgactgcgtcgtgaaaccaatagatgaccggtttgcaaacgcgttactggccctcaatgatatgggaaaggttagaaaggacattccgcagtggcaacccagtaaaggctggcatgattggcaacaggtgcctttctgttcccaccatttccacgagcttatcatgaaggacggtaggaaactggtcgtgccatgccgcccccaggacgaactaatcgggagagctcggattagccaaggagccggctggtcactgaaggagaccgcatgtctcggcaaggcttacgcccagatgtggtccttgatgtattttcacaggcgtgatctgcgacttgcatctaacgccatatgcagcgcggtacctgttcattggatcccaacaagtcgcacgacctggtccattcacgctcatcaccagtggatgactacagaggacatgctgaccgtgtggaatagagtctggatcgaagataacccctggatggaggacaagactcctgtgacaacctgggaagatgttccgtacctcgggaagcgggaggaccaatggtgtggcagcttaattggtctgacgtctagggccacatgggcacagaatatcttgaccgccatacaacaggtgcgctcactgatcggcgatgaggagttcctcgactacatgccaagtatgaaaagatttcggaaggaggaagagtccgaaggggctatttggtga

SEQ ID NO: 15216 - RNA, 9873 nt, synthetic construct
  misc_feature 1..9873: note = derived and/or modified CDS sequence (opt3) from DENV-3__GU131940__SS-prME
  source 1..9873: mol_type = other RNA
accagcctgtgcctcatgatgatgcttcccgccactctggctttccacttgacttccagagacggagaacctaggatgatcgtggggaagaacgaacggggaaaatctttactgtttaagacggcatcaggtattaatatgtgtaccctaatagccatggatctcggcgagatgtgcgacgatactgtcacttacaaatgtccactgatcgcggaagttgagccggaagacattgattgctggtgtaaccttaccagtacctgggtgacctatgggacttgcaatcaggctggagagcatcgccgagacaagcgtagcgtcgccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaattcaaagaacacgagtatgagcttttcctgcatcgttattggaataatcacactgtatctaggcaccgtcgtgcaggcggatatgggttgtgctattaattggaaggggaaggaactcaaatgcggatctggcatcttcgtgactaacgaggtccacacatggaccgagcagtacaagtttcaagccgacagccccaaacggctggcaactgccattgctggtgcctgggaaaatggcgtttgtgggatccgatcaaccacacgcatggagaaccttttgtggaagcagatagcaaatgaactgaactatatcctctgggagaataacattaaactgacggtggtggtaggagatatcattggcgtcttagaacaggggaagagaaccctgactccacagcctatggagcttaaatacagttggaagacatggggaaaggctaaaatcgtgaccgccgagacacaaaattccagcttcataattgacggccccaacactccagaatgcccctctgcgtcaagggcctggaacgtttgggaggtggaagactatggttttggggtcttcaccacgaatatctggttgaagctccgggaggtgtacacacagagttgtgatcatcgcctgatgagcgctgcaattaaagacgaaagagccgttcacgctgatatgggatactggatcgagtcccagaagaacggctcttggaaactagagaaggcctcgtttatagaagtgaagacctgcacttggcctaaaagccacaccctgtggtccaatggtgtactcgagtcagacatgatcattccaaagagtctggcaggcccgatctctcagcataaccacaggcccgggtatcatacacaaactgcgggaccttggcaccttggcaaattggaactggatttcaattactgcgaggggaccacagtcgtgattacggagaactgtggaacccgtggccccagcttacggactacaaccgtgtccggtaagctcatccacgaatggtgctgtcgatcatgcactctgccccctcttagatatatgggggaggacggatgttggtacggcatggaaataaggccaattaatgagaaagaagagaacatggtcaagagcctggtttctgccggttccggcaaggtggataattttacaatgggggtattgtgcctcgctatcctgttcgaggaagtgatgcgcggaaaattcggcaagaaacatatgatcgccggggtcctatttaccttcgtgctgctcctgagtggacagattacgtggcgggacatggcacacactcttatcatgattggcagcaacgcttctgatagaatgggtatgggggttacctatttggccctgatagcaacatttaagatccagcccttcttagccctcggatttttcctgaggaaacttacctcccgcgagaatctgctactcggcgtgggcctggctatggcgactacattgcaactgccggaagacattgagcagatggccaacgggatcgcattaggactcatgaccctgaaacttattacacagtttgaaacttaccagctgtggaccgctttggtctcactcacgtgtagtaatacaatcttcaccctgactgtggcctggcgaaccgccacactaatactggctggtgttagccttctccctctgtgccaatcgtcctctatgcggaagactgattggttgccaatgaccgtggcagccatgggcgtaccacctctgcccttatttatcttcagcctcaaagacacgccaaagcgtagatcatggcctctgaacgagggggtaatggcggtgggacttgttagtattctggcttcctctttgctcaggaatgatgtgcccatggccggcccactggtcgcgggtgggctactgatcgcctgttatgtgattacaggaaccagcgctgaccttactgtagagaaagcagccgacgtgacatgggaagaggaagcggagcagaccggcgtctcccataacctcatgatcactgttgatgacgatggcacaatgcgcataaaggacgatgaaaccgagaacattctgacggtgttgttaaaaactgctctgctcatcgtgtcagggatctttccgtacagcattcctgccaccctgcttgtctggcacacatggcagaagcagacccaacggagtggagtgctgtgggacgttccctctccacccgagacacagaaagcagaattggaggaaggtgtatacagaataaagcagcagggcatcttcgggaagactcaagtgggagtcggcgtgcagaaagagggtgtttttcataccatgtggcacgtgacgcgaggggcagtcctaacacacaatggaaagaggctggagcctaactgggcttccgtgaaaaaggatctcattagctatggcggcgggtggcgcctgaatgcccagtggcaaaaaggagaagaggtacaggtcatcgcagtggaaccaggtaagaaccccaagaatttccagactatgcctggcattttccagaccacaaccggggagatcggagctatagcccttgactttaaaccgggcacttcgggttcaccaatcattaaccgggaagggaaggttgtgggattatacggcaatggcgtcgtgaccaaaaacgggggatatgtttctggtatcgcgcaaacaaatgccgagcccgatggccctacgccagagctggaagaggaaatgttcaagaaaagaaacctcactattatggacttgcatcccgggagtggaaagaccaggaagtacctgcctgcaatcgtgcgtgaggctataaaacgccggctcagaacactgattcttgccccgaccagggtcgtggctgcagaaatggaggaggccctgaagggcttgcccatccgatatcagactacagccaccaaatccgaacacacgggtcgggagatcgtagatctaatgtgccatgctacttttacaatgcgcctgctcagcccagtgagagttcctaattacaacttagtcattatggacgaagcgcacttcaccgatcccgcatctatcgccgctagggggtatataagcacccgggtgggaatgggcgaggccgcagccatttttatgactgctacaccacctggcaccgcggaagccttcccccagtccaatgcaccaatccaggacgaggagcgagacattccggaaagatcatggaacagtgggaatgagtggatcacagattttgtgggaaagactgtctggttcgtacctagcataaaagctggtaacgacattgccaactgtctgcgcaagaatggcaagaaagtgatccaactttctaggaagacgtttgataccgaataccagaaaacacgtctgaacgactgggatttcgttgtgactaccgacatctccgagatgggggcaaattttaaggccgatcgggtcattgaccccagaaggtgcctcaaaccagtgatcttgacagatggacccgagcgcgttattctggctggccctatgccagtgaccgccgcgtcagcagcccagcgaagaggtcgggtcgggaggaacccccagaaggaaaatgaccaatacatattcactggccagcctctcaacaatgatgaggaccatgctcactggacggaagccaagatgctgcttgacaacatcaataccccggagggaattatcccagctctattcgaacccgagcgcgagaaaagtgcagccatcgatggcgaatatcgtctgaagggggagagcagaaaaacatttgtggaattgatgcggaggggagacttacctgtatggctggcttacaaggtggcctccgagggtattaaatatactgatcgcaagtggtgcttcgacggcgaacgaaacaatcagatactcgaggagaacatggatgttgaaatctggaccaaagagggggaaagaaagaagctgcggcccaggtggcttgacgcacgcacatactctgatccactggcgctcaaagagtttaaggacttcgccgctggaagaaaatcgattgccttggatctggtcaccgaaatcggcagggtgcctagccacctagcacatcggactcgtaatgctctggacaacctcgtgatgcttcacacatcagagcatggtgggcgcgcctatcgacacgcagtcgaggaactgcccgagacgatggaaaccttattgctgctcggcctgatgattcttctgactggaggcgccatgctctttttgatctccgggaagggaataggtaaaacaagtatcggcctgatttgtgttatcgtgtctagcgggatgttatggatggctgatgtaccactacagtggattgcgtccgccatcgtgctggagttctttatgatggtcctccttatacctgagccggaaaagcaaagaacaccccaggacaatcagctggcatacgtggttattggaatcttgaccctggctgccattgtggccgcaaacgagatgggcctcctggaaacaactaagagggatcttggtatgtcaaaagagccaggggtcgtatctcctacgagctatctcgacgtggacctgcaccccgctagtgcctggaccttgtacgcggttgctacaactgtgatcaccccaatgctgcggcatacaatagaaaattccaccgccaacgtcagcttagcagccatcgctaaccaagcagtggtcctaatgggcctggataagggatggcctatttctaaaatggacctcggcgtgccccttctggccttggggtgctactcacaggttaatccgctgactctcacggcggctgtgctgcttttagtaacacactatgccatcattggaccaggcctgcaggcaaaggccacccgcgaggctcagaaaagaactgccgcaggtatcatgaagaaccctaccgtggatgggataatgacaattgacctcgatcccgtcatctacgactccaagttcgagaaacaattgggacaggttatgctgctagtgctgtgtgctgtccagctccttctgatgaggacaagttgggccttgtgcgaagcgctgaccctcgccacaggcccaatcacgaccctgtgggagggtagccccggcaagttttggaatactacaattgcagtgtcgatggctaacatcttccgggggtcttatttagccggagcaggccttgctttttccataatgaaaagcgtagggaccggacgaagaggcactggttcacagggggaaacactgggagagaagtggaaaaagaagctcaatcaactaagtcgcaaagagttcgatctgtacaagaaatctggcattaccgaggtggacaggacggaggccaaggaaggtttgaaacggggcgagaccacacatcacgccgtttcccgtgggagcgcgaagctgcagtggtttgtggaaagaaacatggtcatccctgagggaagggtgattgatctcggctgtgggcgcggaggctggtcatattactgcgctggtcttaaaaaggtcactgaagtgcgggggtataccaagggaggcccgggccatgaggagcccgttccaatgagtacatacgggtggaatatcgtaaaactgatgagcggaaaggacgtgttctacttgcctcccgaaaaatgtgatactctgctctgcgacataggtgagtcctctcctagcccaaccgtcgaagagtcccgaacaatcagagtgttaaagatggttgagccctggctgaggaacaatcagttctgtattaaagtgcttaacccttatatgccaaccgtcatcgaacacctggagcgcctacagcggaagtacggcgggatgctcgtgagaaatcccctgtcacgtaactctactcacgaaatgtattggattagtaatggaacgggcaacatcgtatcgagcgtgaatatggtttccaggttgctgctcaaccggtttacaatgacccatcgccgaccgactattgagaaggatgtcgaccttggtgcagggaccagacacgtgaacgccgaacctgagacaccaaatatggacgtgatcggagagaggataaaacggattaaggaagaacactcttcaacgtggcactacgatgacgaaaacccctataaaacctgggcttaccacggcagctatgaggtcaaggccactggctccgcaagttctatgatcaatggggttgtgaaactgttaacaaagccttgggatgtagtgccaatggtcacccaaatggccatgactgacacaacccccttcggacagcagcgcgtgtttaaggaaaaagttgatacaagaactccgaggcctatgcccggtacccgaaaggtgatggagatcacggctgagtggctgtggcggaccttgggccgtaacaaaaagccaagactctgcacacgcgaagagttcactaaaaaggtcaggaccaatgcggccatgggggcagtgtttacagaagagaaccaatgggacagcgctcgggccgcagtagaagatgaggagttctggaagctggttgacagagaacgcgagctacataaacttggaaagtgtggctcatgcgtgtacaatatgatgggtaaaagggaaaagaaactgggggagtttggaaaggccaaaggctcccgagctatttggtacatgtggctcggcgcccggtatctggagttcgaagcgttggggtttctgaacgaggatcactggttcagtagagaaaatagctactctggagtcgagggtgaaggcctccataaacttgggtatatactgagggacatctccaagattcctggaggcgcaatgtacgccgatgacactgctggttgggacacccgcatcacggaggatgacttacacaacgaggagaaaattacacagcagatggatcccgagcatcgtcagctggccaatgcaatctttaagttgacctatcaaaacaaagtggtgaaggtccagcggccaactcccaaagggacagttatggacataatctcaagaaaggatcagaggggaagcggccaggtgggcacctacgggctcaatactttcaccaacatggaagctcaactggtacgccagatggagggagaaggtgtgctatcgaaggccgaccttgagaatcctcatctgctcgagaaaaagattacacagtggctggaaacgaaaggcgtcgagcgattgaagcggatggctatctctggggatgactgcgtggttaaaccaattgatgacagatttgccaacgcattactggcgctcaacgatatgggaaaggtgaggaaggacatcccgcagtggcaacccagtaaaggctggcacgattggcagcaggtccctttctgttcccatcacttccatgaacttataatgaaggacggtcgcaaactggtggtaccatgcagaccccaggacgagctaattgggcgggccaggatcagccaaggagctggctggtcactgaaggaaaccgcctgtctcggcaaagcatatgctcagatgtggtccttgatgtactttcaccgtcgagatctgcgccttgcctctaatgcaatctgcagcgccgttcctgtgcactggattccaacaagtagaacaacctggtccatacatgcgcaccatcagtggatgactacagaggacatgctgaccgtctggaaccgggtgtggatcgaggataatccctggatggaagacaagacgcctgttacaacctgggaggatgtgccgtacctcgggaagagggaagaccaatggtgtggcagcttaattggtctgacttctcgcgctacctgggcccagaacatcttgacagcaattcagcaggtcagatcactgatcggcgatgaggagttcctcgactatatgccaagtatgaaacggtttaggaaggaagaggaatccgagggggccatatggtga

SEQ ID NO: 15217 - RNA, 9873 nt, synthetic construct
  misc_feature 1..9873: note = derived and/or modified CDS sequence (opt3) from DENV-3__GU131942__SS-prME
  source 1..9873: mol_type = other RNA
accagcctgtgcctcatgatgatgttccccgcaactcttgcttttcacctgacttccagagacggcgagcctaggatgatcgtggggaagaacgaacggggaaaatctttgttattcaagacggcatcaggtattaatatgtgtaccctgatagccatggatctcggcgagatgtgcgacgatacagtcacttacaaatgtccactcatcgcggaagttgagccggaagacattgattgctggtgtaacctgaccagtacatgggtgacctatgggacttgcaatcaggctggagagcatcgccgagacaagcgtagcgtagcccttgcaccccacgtgggcatgggtctggatacaagaacccagacgtggatgtccgccgagggggcttggaggcaggtcgaaaaagtggagacttgggcattgcggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaaaagcaaacccacactggacatcgagctccagaagaccgaagcaactcaactggccacacttaggaaactgtgtattgagggaaagatcaccaatattacgaccgatagtcggtgccctacacagggcgaagctactttgccagaggaacaggaccagaactatgtctgtaaacacacctacgttgatcgcggttgggggaatggatgcggcctctttggcaaggggtccctggtgacatgcgccaagttccaatgtttagagcccatcgagggaaaagtagtgcagtatgaaaacctgaagtacactgtcataattaccgtgcacacaggtgaccagcatcaggttggcaatgacacccaaggggtgactgtcgagatcacgcctcaggcatctacagtggaagctgtactcccagagtatggaacccttggcctggaatgcagcccgcgaactggtttggattttaacgagatgattctactgaccatgaaaaataaggcctggatggttcacagacagtggttctttgacctccccctgccttggacatccggggcgaccactgagacaccaacgtggaacaggaaagaacttctggtgaccttcaagaatgcccatgccaaaaagcaagaggtcgtggtcttgggctcacaggaaggagctatgcacactgccctcacaggcgctaccgagatccagaacagtgggggaacaagcatctttgccggtcacctgaagtgtcggttaaaaatggataagctggaactaaaaggcatgtcttacgcaatgtgcctcaatactttcgtgctgaagaaagaggtttccgagacccagcatgggacgattcttataaaggtggaatacaagggagaggacgccccctgtaaaatccctttctcaaccgaagatggccaaggtaaggctcacagcgggcgtttgattacagcgaacccagtagtcactaaaaaggaggagcccgtgaacatcgaagcagagccgccttttggcgaaagtaatatagttattggaatcggcgacaaagccctgaagatcaactggtataagaaagggtcttccattggaaagatgttcgaggctaccgcccgcggtgcaagaaggatggccatcctcggcgatacagcttgggactttgggagcgtgggaggcgtcctaaattcgcttggtaaaatggtgcatcagattttcgggtctgcctacactgcactgttttccggcgtatcatgggtgatgaagataggaatcggcgttttgctcacctggattgggctgaacagtaaaaatacgagcatgtccttctcttgcatcgtcatcggaattataacattatatctgggcgcggtggtgcaggctgatatgggttgtgtcatcaactggaaggggaaggaactaaaatgcggaagcggcatttttgttaccaatgaggtgcacacttggacagagcagtacaagttccaagccgactcacccaaacggctcgcaaccgccatcgctggtgcctgggaaaacggcgtgtgtgggattcgaagtactacccgcatggagaatctgctttggaagcagatcgcaaacgaattgaattatatactgtgggagaacaatatcaaactcacagtagtcgtgggagatattatcggcgttctggaacaggggaagagaacgttaaccccacagcctatggagctgaaatactcctggaagacttggggaaaggctaaaattgtgacagccgagacccaaaacagctcttttatcatagacggccccaatacaccagaatgcccctcagcgagtagggcctggaacgtctgggaggtggaagactatggtttcggggtttttactaccaacatttggcttaagttgcgggaggtgtacacgcagagctgtgatcatcgcctcatgtccgctgcaatcaaagacgaaagagccgtacacgctgatatgggatactggattgagtctcagaagaatggctcgtggaaactggagaaggccagcttcatcgaagtcaagacatgcacctggcctaaatcccacactctatggtcaaacggtgtgctggagagtgacatgataatcccaaagtctctcgcaggcccgattagccagcataatcacaggcccgggtatcatacccaaacagcgggaccttggcacctgggcaaacttgaattggattttaactactgcgaggggactaccgtggtcatcacagagaattgtggaacgcgtggcccatccctgcggaccactacagtttcaggtaagttaattcacgaatggtgctgtcgaagctgcaccctaccccctctgagatatatgggggaggacggatgttggtacggcatggaaatcaggccaataaacgagaaagaagagaatatggtgaagtctcttgtatccgccggtagtggcaaggtggataacttcactatgggggtcctgtgcttggctattctcttcgaggaagtgatgcgcggaaaatttggcaagaaacatatgatcgccggggttctgttcacatttgtgctactgctcagcggacagatcacctggcgggacatggcacacacgctgattatgatcggctctaatgcttccgatagaatgggtatgggggtcacttatcttgccttgattgcaaccttcaagatacagccctttctggccttaggattctttctcaggaaactgacatcacgcgagaaccttctgctaggcgtgggcctcgctatggcgaccactctgcaattgccggaagacatcgagcagatggccaatgggattgcactgggattaatgacactcaagctgatcacccagttcgaaacataccagctttggactgctctggttagtttgacctgtagcaacacggtgtttacactcaccgtcgcctggcgaactgccaccctgattctagctggtgtatcgctgcttcctctctgccaatcctctagcatgcggaagacagattggctgccaatgactgtggcagccatgggcgttccccctttgcccctgttcatcttttcattaaaagacaccccaaagcgtagaagttggcctctcaatgagggggtgatggcggtcggactggtgtccatacttgcttctagcctgttgaggaacgatgtacccatggccggcccactcgtggccggtgggctgctaatcgcctgttatgtcattacgggaacatccgctgacctgaccgttgagaaagcagccgacgtgacttgggaagaggaagcggagcagacaggcgtgtcacataatcttatgatcaccgtcgatgacgatggcactatgcgcattaaggacgatgaaacagagaacatcctcaccgtgctgttgaaaacggctttactgatagttagcgggattttcccgtacagtatccctgccactctcctggtatggcacacctggcagaagcagacacaacggtctggagtgctttgggacgtcccctccccacccgagacccagaaagcagaactggaggaaggtgtgtacagaatcaagcagcagggcatttttgggaagacacaagttggagtgggcgtccagaaagagggtgtgttccatactatgtggcacgtaacccgaggggcagtcttgacgcacaacggaaagaggctagagcctaattgggctagcgtgaaaaaggatctgatatcgtatggcggcgggtggcgcctcaacgcccagtggcaaaaaggagaagaggttcaggtgatcgcagtcgaaccaggtaagaatcccaagaacttccagacaatgcctggcatttttcagactaccacaggggagatcggagctattgccctggacttcaaaccgggcacctcaggttctccaatcataaatcgggaagggaaggtggttggactttacggcaacggcgtggtcactaaaaatgggggatatgtgagtggtatcgcgcaaaccaacgccgagcccgatggccctacaccagagttagaagaggaaatgtttaagaaaagaaatctgacgattatggacctccatcccgggtccggaaagactaggaagtacttgcctgcaatcgtacgtgaggctattaaacgccggctgagaaccctcatcctggccccgacaagggtggttgctgcagaaatggaggaggcccttaagggcctgcccatacgatatcagaccactgccacaaaaagcgaacacaccggtcgggagattgtcgatttgatgtgccatgctacgttcactatgcgcctactgtctccagtgagagtgcctaactacaatctcgtcatcatggacgaagcgcactttacagatcccgcaagcatcgccgctagggggtatatttccacccgggtaggaatgggcgaggccgcagccatcttcatgaccgctactccacctggcacagcggaagcctttccccagtcaaacgcaccaatacaggacgaggagcgagacattccggaaagaagttggaatagcgggaacgagtggatcaccgatttcgtgggaaagacagtttggtttgtgccttctattaaagctggtaatgacatcgccaactgtttacgcaagaacggcaagaaagtcatacaactgtccaggaagactttcgatacggaataccagaaaacccgtcttaatgactgggattttgtggttacaactgacatttcagagatgggggcaaacttcaaggccgatcgggtgatcgaccccagaaggtgcctgaaaccagtcatcctcaccgatggacccgagcgcgtgattttggctggccctatgccagtaacagccgcgagtgcagcccagcgaagaggtcgggtggggaggaatccccagaaggaaaacgaccaatacatcttcaccggccagcctctgaataacgatgaggaccatgctcactggactgaagccaagatgctcctggacaatattaacacgccggagggaataatcccagctctttttgaacccgagcgcgagaaaagcgcagccattgatggcgaatatcgtctaaagggggagtccagaaaaaccttcgttgaactgatgcggaggggagacttgcctgtctggttagctcacaaggtggcctctgagggtatcaaatacacagatcgcaagtggtgctttgacggcgaacgaaataaccagatcctggaggagaatatggatgtggaaatttggactaaagagggggaaagaaagaagctccggcccaggtggctggacgcacgcacctattcggatccacttgcgctgaaagagttcaaggactttgccgctggaagaaaaagcatagccctcgatttggtcacagaaatcggcagggttccttcacatctggcacaccggacccgtaacgctctagacaatctggtgatgctccatacttccgagcacggtgggcgcgcctaccgacacgcagtagaggaacttcccgagacaatggaaacgctgttattgctgggcctcatgattctgcttaccggaggcgccatgctgttcctcatcagtgggaagggaattggtaaaacttctatcggcttgatatgtgtgatcgtcagctccgggatgctgtggatggctgatgtgccattacagtggattgcgtcagccatcgttctagagtttttcatgatggtgctgctcattcctgagccggaaaagcaaagaacaccccaggacaaccagcttgcatatgtcgtaatcggaatactgaccttggctgccattgtggccgcaaatgagatgggcctgctcgaaaccacaaagagggatctgggtatgtctaaagagccaggggttgtgagccctacaagttaccttgacgtcgacctccatcccgcttccgcctggacgctgtatgcggtggctaccacagtcatcactccaatgttgcggcacaccattgaaaacagcacagccaatgtgtctctggcagccatcgctaaccaagcagttgtgttaatgggcctagataagggatggcctatatcaaaaatggacctgggcgtacccctccttgccctggggtgctactcccaggtgaacccgttgaccctgactgcggctgtcctcctgcttgttacgcattacgccatcattggaccaggcttacaggcaaaggccacacgcgaggctcagaaaagaaccgccgcaggtatcatgaagaatcctactgtggatgggattatgaccatcgacctggatcccgtcatatatgacagtaagtttgagaaacaactcggacaggtgatgttgctggtactatgtgctgtgcagctgctccttatgaggacaagctgggccctgtgcgaagcgttgactctggccaccggcccaattacaacgctctgggagggttcgcccggcaagttctggaacaccactatcgcagtttctatggctaatatctttcgggggtcctacctggccggagcaggcttagctttcagcattatgaaatcagtgggggccggacgaagaggcacaggtagtcagggggaaacccttggagagaagtggaaaaagaagctgaaccaactctctcgcaaagaatttgatctatataagaaatccggcatcactgaggtcgacaggacagaggccaaggaaggtctgaaacggggcgagaccacgcaccatgcggtgagccgtgggtcagctaagttgcagtggttcgtcgaaagaaatatggtgatacctgagggaagggttattgatctgggctgtgggcgcggaggctggagttactattgcgcaggtctcaaaaaggtaaccgaagtgcgggggtacacaaagggaggcccgggccacgaggagcccgtcccaatgagcacttatgggtggaacatcgtgaaacttatgtccggaaaggacgttttctacctgcctcccgaaaaatgtgataccttgctgtgcgacattggtgagtctagcccttccccaacagtggaagagtcacgaactatcagagtcctcaagatggtggagccctggttaaggaataaccagttttgtataaaagtactgaatccttacatgccaaccgtgatcgaacaccttgagcgcctgcagcggaagtatggcgggatgctagttagaaaccccctctctcgtaatagtacacatgaaatgtactggatttcgaacggaaccggcaatatcgtcagctccgtgaacatggtgtctaggctgttgctgaatcggttcactatgacgcaccgccgaccgacaattgagaaggatgtcgacctcggtgccgggaccagacatgttaacgctgaacctgagactccaaacatggacgtgatcggagagaggattaaacggatcaaggaagaacactcaagcacctggcactatgatgacgaaaatccctacaaaacatgggcctatcatggctcctacgaggtaaaggcaacgggcagtgcctctagcatgataaacggggtggtcaaacttctgaccaagccttgggatgtggttccaatggtgactcaaatggctatgacagacaccactccctttggacagcagcgcgtcttcaaggaaaaagtggatacaagaaccccgaggcctatgcccggtacacgaaaggtaatggagattactgcggagtggttatggcggaccctgggccgtaataaaaagccaagattgtgcacgcgcgaagagtttaccaaaaaggttaggacaaacgccgcaatgggggctgtgttcactgaagagaatcaatgggactcagcccgggcagccgtcgaagatgaggagttttggaagctcgtggacagagaacgcgagctgcacaaactaggaaagtgtggctcctgcgtgtataacatgatgggtaaaagggaaaagaaacttggggagttcggaaaggctaaaggcagtcgagccatctggtacatgtggctgggcgcgcggtacctcgagtttgaagcactggggttcttgaatgaggatcattggtttagcagagaaaactcttattccggagtcgagggtgaaggcctgcacaagctcgggtacatccttagggacatttcaaagatacctggaggcgccatgtatgctgatgacaccgccggttgggacacacgcatcactgaggatgacctgcataatgaggagaaaattacccagcagatggatcccgagcaccgtcagttagcaaacgctatcttcaagctgacgtaccaaaataaagttgtgaaggtacagcggccaacacccaaagggaccgtgatggacattatcagcagaaaggatcagaggggatcgggccaggtcggcacttatgggttgaacacatttaccaatatggaagcccaactcgtgcgccagatggagggagaaggtgttctgtctaaggctgacctagagaaccctcaccttctggagaaaaagataactcagtggctcgaaaccaaaggcgtggagcgactgaagcggatggccatcagtggggatgactgcgtcgtgaaaccaattgatgacagattcgcaaatgcgttgttagccctgaacgatatgggaaaggtaaggaaggacatcccgcagtggcaaccctccaaaggctggcatgattggcagcaggttcctttctgtagccaccattttcacgaactcattatgaaggacggtcgcaaacttgtggtcccatgcagaccccaggacgagctgatcgggcgggctaggatatcacaaggagccggctggtccctaaaggaaacagcatgtctgggcaaggcttacgcccagatgtggtctctcatgtatttccaccgtcgagatttgcgcctggcaagcaacgccatttgcagtgcggtgcctgttcattggatcccaacgtccagaaccacttggagcatccacgctcatcaccagtggatgacaaccgaggacatgcttactgtgtggaatcgggtctggattgaggataacccctggatggaagacaagacacctgtgaccacgtgggaggatgtaccgtacctggggaagagggaagaccaatggtgtggatctctcataggtttaacatcacgcgccacctgggcacagaatatcctgactgccattcaacaggtgagaagtttgatcggcgatgaggagtttctggactacatgccatccatgaaacggttcaggaaggaagaggaaagcgagggggctatttggtga

SEQ ID NO: 15218 - RNA, 9873 nt, synthetic construct
  misc_feature 1..9873: note = derived and/or modified CDS sequence (opt3) from DENV-3__GU131943__SS-prME
  source 1..9873: mol_type = other RNA
accagcctgtgcctcatgatgatgcttcccgccacactggctttccacttgacttccagagacggagaacctaggatgatcgtggggaagaacgaacggggaaaatctttactgtttaagacggcgtcaggtattaatatgtgtaccctaatagccatggatctcggcgaaatgtgcgacgatacagtcacttacaaatgtccactgatcgcggaagttgagccggaagacattgattgctggtgtaaccttaccagtacatgggtgacctatgggacttgcaatcaggctggagagcaccgccgagacaagcgtagcgtcgccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaatctggaacaggaaagaactgttggtgacgtttaagaatgcccatgccaagaagcaagaggtcgtggtcctcggctcacaggaaggagctatgcacaccgccctgactggcgctacagagatccagaacagtgggggaaccagcattttcgccggtcacttaaagtgtcggctgaaaatggataagctagaactcaaaggcatgtcttacgcaatgtgcctgaatacatttgtgcttaagaaagaggtttccgagactcagcatgggaccatattgatcaaggtggaatacaagggagaggacgccccctgtaaaattcctttctcaacggaagatggccaaggtaaggctcacaacgggcgtctgatcaccgcgaacccagtagtcactaaaaaggaggagcccgtgaatatagaagcagagccgcctttcggcgaaagcaacattgttatcggaatcggcgacaaagccctcaagattaattggtataagaaagggagttctatcggaaagatgtttgaggctactgcccgcggtgcaagaaggatggccattctgggcgataccgcttgggacttcgggtccgtgggaggcgtccttaacagcctgggtaaaatggtgcatcagatatttgggtcggcctacacagcattgttctctggcgtatcctggatcatgaagattggaatcggcgtgctcctgacttggatcgggttaaattcaaagaacaccagtatgagcttttcctgcattgttataggaatcattacgctgtatctaggcgcggtcgtgcaggctgatatgggttgtgccatcaattggaaggggaaggaactcaaatgcggatctggcattttcgtgacaaacgaggtccacacctggactgagcagtacaagtttcaagcagacagccccaaacggctggccacagctatcgccggtgcatgggaaaatggcgtttgtgggatacgatcaaccactcgcatggagaaccttttgtggaagcagatcgctaatgaactgaactatattctctgggagaataacatcaaactgaccgtggtggtaggagatattatcggcgtcttagaacaggggaagagaacactgacgccacagcctatggagcttaaatacagttggaagacctggggaaaggccaaaatagtgactgcggagacacaaaattccagcttcattatcgacggccccaacaccccagaatgcccctctgcctcaagggcttggaacgtttgggaggtggaagactatggttttggggtcttcacaactaatatttggttgaagctccgggaggtgtacacccagagttgtgatcatcgcctgatgagcgcagccatcaaagacgaaagagctgttcacgccgatatgggatactggatagagtcccagaagaacggctcttggaaactagagaaggcatcgtttatcgaagtgaagacgtgcacatggcctaaaagccacaccctgtggtccaatggtgtactcgagtcagacatgattatcccaaagagtctggcgggcccgatttctcagcataaccacaggcccgggtatcatactcaaaccgccggaccttggcaccttggcaaattggaactggatttcaattactgcgaggggacaactgtcgtgatcaccgagaactgtggaacacgtggccccagcttacggacgaccactgtgtccggtaagctcatacacgaatggtgctgtcgatcatgcacactgccccctcttagatatatgggggaggacggatgttggtacggcatggaaattaggccaatcaatgagaaagaagagaacatggtcaagagcctggtttctgctggttccggcaaggtggataattttaccatgggggtattgtgcctcgccatcctgttcgaggaagtgatgcgcggaaaattcggcaagaaacatatgattgcaggggtcctatttactttcgtgctgctcctgagtggacagatcacatggcgggacatggctcacacccttattatgataggcagcaacgcctctgatagaatgggtatgggggttacgtatttggcactgatcgccacttttaagattcagcccttcttagctctcggatttttcctgaggaaacttacctcccgcgagaatctgctactcggcgtgggcctggcgatggccacaaccttgcaactgccggaagacatcgagcagatggcaaacgggattgctttaggactcatgactctgaaacttatcacacagtttgaaacctaccagctgtgggccgccttggtctcactcacatgtagtaatactatattcaccctgacggtggcttggcgaacagcaaccctaatcctggccggtgttagccttctccctctgtgccaatcgtcctctatgcggaagactgattggttgccaatgaccgtggcggctatgggcgtaccacctctgcccttatttattttcagcctcaaagacacaccaaagcgtagatcatggcctctgaacgagggggtaatggccgtgggacttgttagtatcctggcatcctctttgctcaggaatgatgtgcccatggccggcccactggtcgctggtgggctactgattgcatgttatgtgatcactggaaccagcgccgaccttacggtagagaaagcggctgacgtgacatgggaagaggaagccgagcagaccggcgtctcccataacctcatgataactgttgatgacgatggcacaatgcgcattaaggacgatgaaaccgagaacatcctgactgtgttgttaaaaacagcactgctcatcgtgtcagggatttttccgtacagcatacctgccaccctgcttgtctggcacacgtggcagaagcagactcaacggagtggagtgctgtgggacgttccctctccacccgagacccagaaagctgaattggaggaaggtgtatacagaatcaagcagcagggcattttcgggaagacacaagtgggagtcggcgtgcagaaagagggtgtttttcataccatgtggcacgtgacacgaggggcagtcctaactcacaatggaaagaggctggagcctaactgggcatccgtgaaaaaggatctcatcagctatggcggcgggtggcgcctgaatgctcagtggcaaaaaggagaagaggtacaggtcattgccgtggaaccaggtaagaaccccaagaatttccagaccatgcctggcatcttccagacgacaactggggagataggagcgatcgcccttgactttaaaccgggcacctcgggttcaccaattatcaaccgggaagggaaggttgtgggattatacggcaatggcgtcgtgaccaaaaacgggggatatgtttctggtattgcacaaaccaatgctgagcccgatggccctactccagagctggaagaggaaatgttcaagaaaagaaacctcaccatcatggacttgcatcccgggagtggaaagacaaggaagtacctgcctgccatagtgcgtgaggctattaaacgccggctcagaacgctgatccttgcaccgactagggtcgtggccgccgaaatggaggaggctctgaagggcttgcccatccgatatcagaccacagcgaccaaatccgaacacactggtcgggagattgtagatctaatgtgccatgcaacatttaccatgcgcctgctcagcccagtgagagttcctaattacaacttagtcatcatggacgaagcccacttcacggatcccgcttctatagccgcaagggggtatattagcactcgggtgggaatgggcgaggccgctgcgatctttatgacagccaccccacctggcaccgcagaggctttcccccagtccaatgccccaattcaggacgaggagcgagacatcccggaaagatcatggaacagtgggaatgagtggataactgattttgtgggaaagacagtctggttcgtacctagcattaaagcaggtaacgacatcgccaactgtctgcgcaagaatggcaagaaagtgatccaactttctaggaagacctttgatacagaataccagaaaactcgtctgaacgactgggatttcgttgtgacgaccgacatttccgagatgggggctaattttaaggccgatcgggtcatcgaccccagaaggtgcctcaaaccagtgattttgacagatggacccgagcgcgttatactggcgggccctatgccagtgactgcagcctcagctgcccagcgaagaggtcgggtcgggaggaacccccagaaggaaaatgaccaatacatcttcaccggccagcctctcaacaatgatgaggaccatgctcactggacagaagcaaagatgctgcttgacaacattaataccccggagggaatcatcccagccctattcgaacccgagcgcgagaaaagtgctgccattgatggcgaatatcgtctgaagggggagagcagaaaaacttttgtggaattgatgcggaggggagacttacctgtatggctggcacacaaggtggcgtccgagggtataaaatacacggatcgcaagtggtgcttcgacggcgaacgaaacaatcagatcctcgaggagaacatggatgttgaaatttggaccaaagagggggaaagaaagaagctgcggcccaggtggcttgacgcccgcacatattctgatccactggctctcaaagagtttaaggacttcgccgcaggaagaaaatcgatcgctttggatctggtcactgaaattggcagggtgcctagccatctagcccaccggacccgtaatgcactggacaacctcgtgatgcttcatacatcagagcacggtgggcgcgcctaccgacacgctgtcgaggaactgcccgagaccatggaaactttattgctgctcggcctgatgatccttctgacaggaggcgcgatgctctttttgatatccgggaagggaatcggtaaaacgagtattggcctgatctgtgttattgtgtctagcgggatgttatggatggccgatgtaccactacagtggatcgcatccgctatagtgctggagttctttatgatggtcctccttattcctgagccggaaaagcaaagaacaccccaggacaatcagctggcctatgtggttatcggaattttgactctggccgcaatcgtggctgccaacgagatgggcctcctggaaacaaccaagagggatcttggtatgtcaaaagagccaggggtcgtatctcctaccagctacctcgacgtggacctgcatcccgcgagtgcttggacattgtatgccgttgcaactacggtgataaccccaatgctgcggcacacaatcgaaaattccactgccaacgtcagcttagctgcaattgccaaccaagcggtggtcctaatgggcctggataagggatggcctatctctaaaatggacctcggcgtgccccttctggctttggggtgctactcacaggttaatccgctgaccctcacagccgcagtgctgcttttagtaacccattacgccattatcggaccaggcctgcaggctaaggccactcgcgaggcacagaaaagaacggctgccggtataatgaagaaccctacagtggatgggattatgaccatcgacctcgatcccgtcatctatgactccaagttcgagaaacaattgggacaggttatgctgctagtgctgtgtgcggtccagctccttctgatgaggacaagttgggccttgtgcgaagcactgaccctcgctacaggcccaattactaccctgtgggagggtagccccggcaagttttggaatacaacgatcgccgtgtcgatggcaaacatattccgggggtcttacttagctggagccggccttgccttttccattatgaaaagcgtagggaccggacgaagaggcactggttcacagggggaaacactgggagagaagtggaaaaagaagctcaatcaactaagtcgcaaagagttcgatctgtataagaaatctggcatcaccgaggtggacaggactgaggcgaaggaaggtttgaaacggggcgagacaacccaccatgctgtttcccgtgggagcgcaaagctgcagtggtttgtggaaagaaacatggtcattcctgagggaagggtgatcgatctcggctgtgggcgcggaggctggtcatactattgcgccggtcttaaaaaggtcacggaagtgcgggggtacaccaagggaggcccgggccacgaggagcccgttccaatgagtacatatgggtggaatatagtaaaactgatgagcggaaaggacgtgttctacttgcctcccgaaaaatgtgatactctgctctgcgacatcggtgagtcctctcctagcccaaccgtcgaagagtcccgaacaattagagtgttaaagatggttgagccctggctgaggaacaatcagttctgtatcaaagtgcttaacccttacatgccaactgtcattgaacacctggagcgcctacagcggaagtatggcgggatgctcgtgagaaatcccctgtcacgtaactctacccatgaaatgtactggatcagtaatggaacaggcaacattgtatcgagcgtgaatatggtttccaggttgctgctcaaccggtttaccatgactcaccgccgaccgacgatcgagaaggatgtcgaccttggtgctgggacaagacatgtgaacgccgaacctgagaccccaaatatggacgtgataggagagaggattaaacggatcaaggaagaacactcttcaacttggcactatgatgacgaaaacccctacaaaacctgggcatatcatggcagctacgaggtcaaggccacaggctccgctagttctatgatcaatggggttgtgaaactgttaacgaagccttgggatgtagtgccaatggtcacccaaatggcgatgactgacacaacccccttcggacagcagcgcgtgtttaaggaaaaagttgatactagaacaccgaggcctatgcccggtacccgaaaggtgatggagattacagccgagtggctgtggcggactttgggccgtaacaaaaagccaagactctgcacccgcgaagagttcacgaaaaaggtcaggaccaatgcagctatgggggccgtgtttacagaagagaaccaatgggacagcgcacgggccgctgtagaagatgaggagttctggaagctggttgacagagaacgcgagctacacaaacttggaaagtgtggctcatgcgtgtataatatgatgggtaaaagggaaaagaaactgggggagtttggaaaggccaaaggctcccgagcgatatggtacatgtggctcggcgcacggtacctggagttcgaagccttggggtttctgaacgaggatcattggttcagtagagaaaatagctattctggagtcgagggtgaaggcctccacaaacttgggtacatcctgagggacatttccaagatccctggaggcgctatgtatgccgatgacactgcaggttgggacacccgcattacagaggatgacttacataacgaggagaaaatcactcagcagatggatcccgagcaccgtcagctggctaatgccatatttaagttgacctaccaaaacaaagtggtgaaggtccagcggccaacgcccaaagggacagttatggacatcatttcaagaaaggatcagaggggaagcggccaggtgggcacctatgggctcaatactttcacaaacatggaagctcaactggtacgccagatggagggagaaggtgtgctatcgaaggccgaccttgagaatcctcatctgctcgagaaaaagatcacccagtggctggaaactaaaggcgtcgagcgattgaagcggatggcaatttctggggatgactgcgtggttaaaccaatcgatgacagatttgcgaacgccttactggctctcaacgatatgggaaaggtgaggaaggacataccgcagtggcaacccagtaaaggctggcatgattggcagcaggtccctttctgttcccaccatttccacgaacttattatgaaggacggtcgcaaactggtggtaccatgcagaccccaggacgagctaatcgggcgggccaggatcagccaaggagcaggctggtcactgaaggaaaccgcttgtctcggcaaagcctacgcacagatgtggtccttgatgtattttcaccgtcgagatctgcgccttgcctctaatgcgatttgcagcgctgttcctgtgcattggataccaacaagtagaacgacctggtccatccacgcccatcaccagtggatgactacagaggacatgctgaccgtctggaaccgggtgtggattgaggataatccctggatggaagacaagactcctgttacaacctgggaggatgtgccgtacctcgggaagagggaagaccaatggtgtggcagcttaatcggtctgacgtctcgcgcaacatgggcccagaacattttgaccgctatccagcaggtcagatcactgataggcgatgaggagttcctcgactacatgccaagtatgaaacggtttaggaaggaagaggaatccgagggggccatctggtga

SEQ ID NO: 15219 - RNA, 9873 nt, synthetic construct
  misc_feature 1..9873: note = derived and/or modified CDS sequence (opt3) from DENV-3__GU131945__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagtctatcgagggaaaagtagtgcagtatgaaaacctcaagtacactgtcataattaccgtgcacacaggtgaccagcatcaggttggcaatgacacccaaggggtgactgtcgagatcacgccccaggcaagcacagtggaagctgtacttcctgagtatggaaccctgggcttggaatgctccccacgaactggtctagatttcaacgagatgattctgctcaccatgaaaaataaggcctggatggttcacagacagtggtttttcgacctgccgcttccctggacatcaggggcgaccactgagacacctacgtggaacaggaaagaactgttggtgacctttaagaatgcccatgcaaaaaagcaagaggtcgtggtcctcggcagtcaggaaggagctatgcacactgccctgacaggcgctaccgagatccagaacagcgggggaacatctatcttcgccggtcacttaaagtgtcggctgaaaatggataagctagaactcaaaggcatgtcctacgcaatgtgcctgaatacttttgtgcttaagaaagaggtttcagagacccagcatgggacgattttgataaaggtggaatacaagggagaggacgccccatgtaaaatccccttcagcaccgaagatggccaaggtaaggctcacaacgggcgtctgattacagcgaaccctgtagtcactaaaaaggaggagccagtgaatatcgaagcagagcccccgttcggcgaaagtaacatagttattggaatcggcgacaaagccctcaagatcaattggtataagaaagggtcttccattggaaagatgtttgaggctaccgcccgcggtgcaagaaggatggccatcctgggcgatacagcttgggacttcgggagcgtgggaggcgtccttaactcgctgggtaaaatggtgcatcagatttttgggtctgcctacactgcattgttctccggcgtatcatggataatgaagatcggaattggcgtgctcctgacctggatcgggttaaatagtaaaaacacgagcatgtccttttcttgcatcgttattggaataatcacactgtatctaggcgcggtcgtgcaggctgatatgggttgtgtgattaattggaaggggaaggaactcaaatgcggaaacggcatcttcgtcaccaatgaggttcacacttggacagagcagtacaagtttcaagccgacagccctaaacggctggcaaccgccattgctggtgcctgggaaaacggcgtgtgtgggatccgatcaactacccgcatggagaatcttttgtggaagcagatagcaaacgaactgaattatatcctctgggagaacaatattaaactgacagtggtagtcggagatatcattggcgtgttagaacaggggaagagagctctgacgccccagccaatggagcttaaatacagttggaagacctggggaaaggccaaaatcgttactgcggagacacaaaactccagcttcataattgacggccctaacacccccgaatgcccatctgcctcaagggcttggaatgtgtgggaggtcgaagactatggttttggggtgttcacaactaacatctggttgaagctccgggaggtttacacccagagttgtgatcatcgcctgatgagcgcagccattaaagacgaaagagctgtgcacgccgatatgggatactggatcgagtcccagaagaatggctcttggaaactagagaaggcatcgtttatagaagtaaagacgtgcacatggcccaaaagccacaccctgtggtccaacggtgtcctcgagtcagacatgatcattcctaagagtctggcgggcccaatctctcagcataatcacaggccggggtatcatactcaaaccgccggaccctggcaccttggcaaattggaactggatttcaactactgcgaggggacaactgtggtgattgctgagaattgtggaacccgtggccctagcttacggacaacgaccgtctccggtaagctcatccacgaatggtgctgtcgatcatgcactctgccaccccttagatatatgggggaggacggatgttggtacggcatggaaataaggcctattaacgagaaagaagagaatatggttaagagcctggtgtctgccggttccggcaaggtagataactttacaatgggggtgttgtgcctcgcaatcctgttcgaggaagtcatgcgcggaaaattcggcaagaaacatatgatcgctggggtgctatttaccttcgttctgctcctgagtggacagattacttggcgggacatggcccacacacttatcatgattggcagcaatgcatctgatagaatgggtatgggggtgacctatttggccctgatagctacgtttaagatccagccattcttagcgctcggatttttcctgaggaaacttacttcccgcgagaacctgctactcggcgtcggcctggccatggcaaccacattgcaactgcccgaagacattgagcagatggctaatgggatcgccttaggactcatgaccctgaagcttattactcagtttgaaacataccagctgtggaccgccttggtgtcactcacatgtagtaacactatcttcaccctgacggttgcttggcgaacagcaaccctaatactggccggtgtgagccttctcccgctgtgccaatcgtcctctatgcggaagactgattggttgcctatgaccgtcgcggctatgggcgtaccacccctgcctttatttatcttcagcctcaaagacacacccaagcgtagatcatggccactgaatgagggggtgatggccgttggacttgtgagtattctggcatcctctttgctcaggaacgatgtccctatggccggccccctggtggctggtgggctactgatcgcatgttatgtaattactggaaccagcgccgaccttacggtggagaaagcggctgacgtcacatgggaagaggaagccgagcagaccggcgtttcccataacctcatgatcactgtggatgacgatggcacaatgaagataaaagacgatgaaaccgagaatattctgactgtgttgttaaagacagcactgctcatcgtctcagggatctttccatacagcattccggccaccctgcttgtgtggcacacgtggcagaaacagactcaacgcagtggagttctgtgggacgtaccttctcccccagagacccagaaggctgaattggaggaaggtgtgtaccggataaagcagcagggcatcttcgggaaaacacaagtcggagtgggcgttcagaaggagggtgtgtttcataccatgtggcacgtcacaagaggggccgtgctaactcacaacggaaaaaggctggagcccaattgggcatccgtaaagaaagatctcattagctatggcggcgggtggcgactgtcggctcagtggcaaaagggagaagaggtccaggtgatcgccgttgaacctggtaagaacccaaaaaatttccagaccatgcccggcattttccagacgacaactggggagatcggagcgatagcccttgactttaagcctggcacctcaggttctccgatcattaaccgcgaagggaaagtggtcggattatacggcaatggcgtggttacaaagaacgggggatatgtgagtggtatcgcacaaaccaatgctgagccagatggccccactcctgagctggaagaggaaatgttcaaaaagcggaacctcaccattatggacttgcatccagggtccggaaagacaagaaaatacctgcccgccatcgtcagggaggctataaagcgtcgcctccggacgctgattcttgcacctactagagtggtagccgccgaaatggaggaggctctgaaaggcttgccgatcaggtatcagaccacagcgaccaagagcgaacacactggtcgagagatcgtggatctaatgtgccatgcaacatttaccatgcggctgctctctcccgttcgcgtcccaaattacaacttagtgattatggacgaagcccacttcacggatcctgctagcatcgccgcaagagggtatatatccactagggtgggaatgggcgaggccgctgcgatttttatgacagccacccccccaggcaccgcagaagctttccctcagtcaaatgcccccatccaggacgaggagcgggacattccagaacgaagttggaacagcgggaatgagtggatcactgattttgtcggaaaaacagtatggttcgtgccgtctataaaggcaggtaacgacattgccaactgtctgagaaagaatggcaaaaaggttatccaactttcccgcaaaacctttgatacagaataccagaagactaggctgaacgactgggatttcgtggtcacgaccgacatctcagagatgggggctaattttaaagccgatcgtgtgattgaccctcggagatgcctcaagcccgttatcttgacagatggaccagagagggtgattctggcgggccccatgcctgtcactgcagccagtgctgcccagcgccgaggtagagtggggcggaacccacagaaggaaaatgaccaatacatattcatgggccagcccctcaacaatgatgaggaccatgctcactggaccgaagcaaaaatgctgcttgacaacatcaatacacctgagggaattatcccggccctattcgaaccagagagggagaagagcgctgccatcgatggcgaatatcgcctgaaaggggagtcccgtaagacctttgtagaattgatgagacggggagacttacccgtgtggctggcacacaaagttgcgtctgagggtattaagtacactgataggaaatggtgcttcgacggcgaacgcaacaatcagatactcgaggagaacatggatgtcgaaatctggacgaaggagggggaacgaaagaaactgagacctcggtggcttgacgccaggacctattcggatcccctggctctcaaggagtttaaagacttcgccgcaggacgcaagagcattgctttggatctggtgacagaaatcggcagagtgccatcacatctagcccacaggactcggaatgcactggacaacctcgtcatgcttcatacctccgagcacggtgggcgtgcctaccgccacgctgttgaggaactgcctgagacaatggaaaccttattgctgctcggcctgatgattcttctgactggaggcgcgatgctctttttgatcagtgggaaaggaataggtaagacatctatcggcctgatttgtgtgatcgtaagctccgggatgttatggatggccgatgtgcccctacagtggattgcatcagctatcgtcctggagttctttatgatggtgctccttataccagagcctgaaaagcaacgaacgccgcaggacaatcagctggcctatgttgtgattggaatcttgaccctggccgcaattgtcgctgccaacgagatgggcctcctggaaactacaaaaagagatcttggtatgtctaaggagcccggggtagtgagcccaaccagttacctcgacgttgacctgcatcctgcgtccgcttggaccttgtatgccgtggcaacaactgtcatcacgcccatgctgaggcacaccatagaaaatagcacagccaacgtgtctttagctgcaatcgccaaccaagcggtcgtgctaatgggcctggataaaggatggccaatttcaaagatggacctcggcgttcctcttctggctttggggtgctactcccaggtgaatcccctgactctcaccgccgcagtactgcttttagtgacacattacgccatcattggaccgggcctgcaggctaaagccacccgggaggcacagaagcgcactgctgccggtatcatgaagaacccaacggtcgatgggataatgacaattgacctcgatcctgttatctatgacagtaaattcgagaagcaattgggacaggtgatgctgctagtcctgtgtgcggtgcagctccttctgatgagaaccagctgggccttgtgcgaagcactgactctcgctaccggccccatcacaactctgtgggagggttcgccaggcaaattttggaataccacaattgccgtatctatggcaaacatcttcagggggtcctacttagctggagccggccttgcctttagcataatgaagtcagtggggacgggacggcgaggcaccggtagtcagggggaaactctgggagagaaatggaagaagaaactcaatcaactatctagaaaggaattcgatctgtataaaaagtccggcattacagaggttgaccgcaccgaggcgaaagaaggtttgaagaggggcgagactacacaccatgctgtgagccgggggtcagcaaaactgcagtggtttgtcgaacgtaacatggtgatccccgagggaagagtcattgatctcggctgtgggaggggaggctggagttactattgcgccggtcttaagaaggtgaccgaagttcgcgggtacacgaaaggaggccctggccacgaggagccggtacccatgagcacctatgggtggaatatcgtgaagctgatgtccggaaaagacgtcttctacttgccacctgaaaagtgtgatacactgctctgcgacataggtgagtctagcccctcccctactgtggaagagtcacggaccatccgagttttaaaaatggtggagccatggctgagatctaaccagttctgtattaaggtccttaatccctacatgcctacagtgatcgaatatctggagaggctacagcgcaagtacggcgggatgctcgtacggaacccactgagtagaaattcgactcacgaaatgtattggattagcaacggaaccggcaatatcgtgtcctctgttaacatggtctcacgtttgctgctcaataggtttacaatgacccatcggcgccccactattgagaaagatgtggaccttggtgctgggacgcgacacgtgaacgccgaaccggagacacctaacatggacgtcatcggagagagaataaagaggattaaagaagagcatagctccacctggcactacgatgacgaaaatccatataagacttgggcataccacggcagttatgaggttaaagccaccggctctgctagctcaatgatcaacggggtggtaaagctgttaacaaagccctgggatgtggtccctatggtgacgcaaatggcgatgaccgacactacaccattcggacagcagcgggtttttaaagaaaaggtggatacccgcactcccagaccgatgcctggtacaaggaaagtcatggagatcaccgccgagtggctgtggcgaacattgggccggaataagaaaccccgtctctgcactagagaagagttcaccaagaaggtgcgcacgaacgcagctatgggggccgtatttaccgaagagaatcaatgggactccgcaagggccgctgttgaagatgaggagttctggaaactggtggacaaggaacgggagctacataaacttggaaagtgtggcagttgcgtctacaacatgatgggtaaaagagaaaagaaactgggggagtttggaaaggccaagggcagccgcgcgatttggtacatgtggctcggcgcaaggtatctggagttcgaagccttggggtttctgaatgaggatcactggttctctcgagaaaactcctactcaggagtggagggtgaaggcctccataaacttgggtatatactgcgggacatcagcaagattccaggaggcgctatgtacgccgatgacacagcaggttgggacactagaatcaccgaggatgacttacacaatgaggaaaaaattacacagcagatggatcctgagcataggcagctggctaacgccatctttaagttgacttatcaaaataaagtggtcaaggttcagcgccccaccccaaaggggacggtgatggacataatctcgcgtaaagatcagcggggatctggccaggtaggcacatacgggctcaacaccttcactaatatggaagctcaactggtgagacagatggagggagaaggtgtcctaagtaaggccgaccttgagaacccccacctgctcgagaaaaagattacacagtggctggaaaccaaaggcgtggagaggttgaagcgcatggcaatctccggggatgactgcgttgtgaagcctattgatgaccgatttgcgaatgccttactggctctcaacgatatgggaaaagtccggaaggacatcccacagtggcaaccgagcaaaggctggcacgattggcagcaggtgcccttctgttcacatcacttccatgaacttataatgaaggacggtagaaaactggtagttccttgcaggccacaggacgagctaattgggcgcgccagaatctcccaaggagcaggctggtctctgaaggaaactgcttgtctcggcaaggcctatgcacagatgtggagcttgatgtactttcaccggagggatctgcgtcttgccagtaacgcgatctgctccgctgtgcccgtccactggattcctaccagccgaacaacgtggtctatacatgcccaccatcagtggatgaccactgaggacatgctgacagtgtggaatcgcgtttggatcgaggataacccatggatggaagacaaaacccccgtgactacatgggaggatgtcccttacctcgggaagagagaagaccaatggtgtggatcattaattggtctgaccagtcgggcaacgtgggcccagaatatcttgacagctattcagcaggtgaggtccctgatcggcgatgaggagttcctcgactatatgccgagcatgaaacgctttagaaaggaagaggaaaccgagggggccatatggtga

SEQ ID NO: 15220 - RNA, 9873 nt, synthetic construct
  misc_feature 1..9873: note = derived and/or modified CDS sequence (opt3) from DENV-3__GU131946__SS-prME
  source 1..9873: mol_type = other RNA
accagcctgtgcctcatgatgatgcttcccgcaactctggctttccacttgacttccagggacggagagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaagctggagagcatcgccgagacaagcgtagcgtcgccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcattcttaacagcctgggtaaaatggtccatcagatatttgggtcggcctacactgcattgttctctggcgtgtcctggatcatgaagattggaatcggcgtactcctgacctggatcgggttaaatagtaaaaacacgtcaatgagcttttcctgcattgtgataggaatcattacactgtatctaggcgcggttgtccaggctgatatgggttgtgtgatcaattggaaggggaaggaactcaaatgcggatctggcattttcgtgaccaacgaggtccacacttggacagagcagtacaagtttcaagccgacagccccaaacggctggcaaccgccatcgctggtgcctgggaaaatggcgtttgtgggatacgatcaactacccgcatggagaaccttttgtggaagcagatcgcaaatgaactgaactatattctctgggagaataacatcaaactgacagtggtggtaggagatattatcggcgtcttagaacaggggaagagaacgctgaccccacagcctatggagcttaaatacagttggaagacttggggaaaggctaggatagtgacagccgagacccaaaattccagcttcattatcgacggccccaacacaccagaatgcccctctgcgtcacgggcctggaacgtttgggaggtggaagactatggttttggggtcttcactaccaatatttggttgaaactccgcgaggtgtacacgcagagttgtgatcatagactgatgagcgctgcaatcaaggacgaaagggccgttcacgctgatatgggatactggatagagtcccagaaaaacggctcttggaagctagagaaagcctcgtttatcgaagtgaagacatgcacctggcctaagagccacactctgtggtccaatggtgtactcgagtcagacatgattatcccaaaaagtctggcaggcccgatttctcagcataaccaccgtcccgggtatcatacccaaacagcgggaccttggcaccttggcaagttggaactggatttcaattactgcgaggggactaccgtcgtgatcacagagaactgtggaacgcggggccccagcttacgaaccactacagtgtccggtaaactcatacacgaatggtgctgtagatcatgcaccctgccccctcttaggtatatgggggaggacggatgttggtacggcatggaaattcgcccaatcaatgagaaggaagagaacatggtcaaaagcctggtttctgccggttccggcaaggtggataattttactatgggggtattgtgcctcgctatcctgttcgaggaagtgatgcggggaaagttcggcaaaaagcatatgattgccggggtcctatttacattcgtgctgctcctgagtggacagatcacctggagagacatggcacacacgcttattatgataggcagcaacgcttctgataggatgggtatgggggttacttatttggccctgatcgcaacctttaaaattcagcccttcttagccctcggatttttcctgcgcaaacttacatcccgagagaatctgctactcggcgtgggcctggctatggcgaccactttgcaactgccggaagacatcgagcagatggccaacgggattgcattaggactcatgacactgaaacttatcacccagtttgaaacataccagctgtggactgctttggtctcactcacctgtagtaatacgatattcacactgaccgtggcctggcggactgccaccctaatcctggctggtgttagccttctccctctgtgccaatcgtcctctatgcgtaagacagattggttgccaatgactgtggcagccatgggcgtaccacctctgcccttatttattttcagcctcaaggacaccccaaaaagaaggtcatggcctctgaacgagggggtaatggcggtgggacttgttagtatcctggcttcctctttgctccgcaatgatgtgcccatggccggcccactggtcgcgggtgggctactgattgcctgttatgtgatcacgggaacaagcgctgaccttaccgtagagaaggcagccgacgtgacttgggaagaggaagcggagcagacaggcgtctcccataacctcatgataaccgttgatgacgatggcactatgcggattaaagacgatgaaacagagaacatcctgaccgtgttgttaaagacggctctgctcatcgtgtcagggatttttccgtacagcatacctgccactctgcttgtctggcacacctggcagaaacagacacaaagaagtggagtgctgtgggacgttccctctccacccgagacccagaaggcagaattggaggaaggtgtatacaggatcaaacagcagggcattttcgggaagacacaagtgggagtcggcgtgcagaaggagggtgtttttcatactatgtggcacgtgacccgaggggccgtcctaacgcacaatggaaaacgcctggagcctaactgggcttccgtgaagaaagatctcatcagctatggcggcgggtggcggctgtcggcccagtggcaaaagggagaagaggtacaggtcattgcagtggaaccaggtaaaaatcccaagaacttccagacaatgcctggcatcttccagactaccacaggggagataggagctatcgcccttgactttaagccgggcacctcaggttctccaattatcaatagagaagggaaagttgtgggattatacggcaacggcgtcgtgactaagaatgggggatatgttagtggtattgcgcaaaccaacgccgagcccgatggccctacaccagagctggaagaggaaatgttcaaaaagaggaatctcacgatcatggacttgcatcccgggtccggaaaaactcgtaagtacctgcctgcaatagtgcgcgaggctattaagcggagactcaggaccctgatccttgccccgacacgagtcgtggctgcagaaatggaggaggccctgaaaggcttgcccatccggtatcagaccactgccacaaagagcgaacacaccggtcgcgagattgtagatctaatgtgccatgctacgtttactatgagactgctctctccagtgagggttcctaactacaatttagtcatcatggacgaagcgcacttcacagatcccgcaagcatagccgctcgggggtatatttccacccgagtgggaatgggcgaggccgcagccatctttatgaccgctactccacctggcacagcggaagccttcccccagtcaaacgcaccaattcaggacgaggagagagacatcccggaacgcagttggaatagcgggaacgagtggataaccgattttgtgggaaaaacagtctggttcgtaccttctattaaggctggtaatgacatcgccaactgtctgaggaaaaacggcaagaaggtgatccaactttcccgtaaaacttttgatacggaataccagaagacccggctgaatgactgggatttcgttgtgacaactgacatttcagagatgggggcaaactttaaagccgatagagtcatcgaccccaggcgctgcctcaagccagtgattttgaccgatggacccgagcgagttatactggctggccctatgccagtgacagccgcgagtgcagcccagagacggggtagggtcgggcgcaatccccagaaagaaaacgaccaatacatcttcaccggccagcctctcaataacgatgaggaccatgctcactggactgaagccaagatgctgcttgacaatattaacacgccggagggaatcatcccagctctattcgaacccgagcgtgaaaagagcgcagccattgatggcgaatatagactgaaaggggagtcccggaagacctttttggaattaatgaggcgcggagacctgcctgtgtggctcgctcacaaagtagcctctgagggtataaagtacacagatcgaaaatggtgcttcgacggcgaaagaaataaccagatcctggaggagaatatggatgtggaaatttggactaaggagggggaacggaagaaacttaggccccgctggctggacgcaagaacctattcggatccactcgcgttgaaagagtttaaagacttcgccgctggaagaaagagcatcgccctggatctagttacagaaattggccgggtcccttcacatctggcacaccgtacccgctccgctctcgacaaccttgtgatgctgcatacaagtgagcacggtgggcgagcctacagacacgcagtggaggaattacccgagacaatggaaacgttgctgctcctgggccttatgatcctgctcaccggaggcgccatgttgtttctgatatctgggaaaggaatcggtaagactagcattggcttaatctgtgtcattgtttcctcagggatgctatggatggctgatgtgccactgcagtggatcgcgtctgccatagtactcgagttctttatgatggtgcttctgattcctgagccggaaaaacaaaggacaccccaggacaatcagttggcatatgtcgtgatcggcattctgaccctcgctgccatcgttgccgcaaacgagatgggcctgcttgaaaccacaaagcgggatctcggtatgagcaaggagccaggggtggtcagtcctacttcctacctggacgtagacttgcatcccgctagcgcctggacgctgtatgcggtggctaccacagttataactccaatgttacgccacaccatcgaaaattctacagccaacgtgtcactagcagccattgctaatcaagcagtcgtgctgatgggcctcgataaaggatggcctatctccaagatggaccttggcgtccccctgttggccctggggtgctacagtcaggtgaacccgctcaccctgactgcggctgttcttttactggtgacgcattacgccattatcggaccaggcctccaggcaaaagccacaagagaggctcagaagaggaccgccgcaggtataatgaaaaaccctactgtagatgggattatgaccatcgacttggatcccgtgatctatgacagcaagttcgagaagcaactgggacaggtcatgctactggttctctgtgctgtgcagcttctgttgatgcggacatcgtgggccctgtgcgaagcgctcactctggccaccggcccaattacaacgttatgggagggttctcccggcaaattttggaataccactatcgcagtctccatggctaacatattccgagggagctaccttgccggagcaggcctggctttttcaattatgaagagtgtggggacaggaagacgcggcaccggttctcagggggaaactctcggagagaaatggaagaaaaagctaaatcaactgtccaggaaggagttcgatttgtataaaaagagcggcatcacagaggtagaccggaccgaggccaaagaaggtctgaagcgtggcgagacgacccaccatgccgtgtcaagagggagtgcgaaactccagtggtttgttgaaaggaacatggtgattcctgagggacgcgtcatcgatcttggctgtgggcggggaggctggagctactattgcgctggtctgaagaaagtgacagaagtccgagggtacactaagggaggcccgggccacgaggagcccgtgccaatgtccacctatgggtggaatatagttaagttgatgtctggaaaagacgtattctacctgcctcccgaaaagtgtgatacactcttatgcgacatcggtgagagctccccttcaccaactgtggaagagtctagaaccattagggtcctgaaaatggtggagccctggcttcgcaacaatcagttctgtatcaaggttctgaacccttacatgccaacagtgattgaacacctagagcggctccagagaaaatatggcgggatgctggtccgtaatcccttgagtaggaactcgacccatgaaatgtactggatcagcaatggaactggcaacattgtgtcctctgtaaatatggtgtcacggctgctccttaaccgctttacgatgacacaccgaagaccgaccatcgagaaggatgttgacctgggtgcagggactaggcatgtcaatgccgaacctgagaccccaaacatggacgtgataggagagcggattaagcgcatcaaagaagaacacagctccacatggcactatgatgacgaaaacccctacaagacgtgggcttatcatggcagttacgaggtgaaagccaccggctctgcaagctcaatgatcaatggggtcgttaagttactgactaaaccttgggatgtggtaccaatggtgacacaaatggccatgaccgacactacacccttcggacagcagagagtctttaaggaaaaggtggataccaggacaccgcgacctatgcccggtactcggaaagttatggagattaccgctgagtggttgtggcgtacgctcggcagaaacaagaaaccacgcctgtgcaccagggaagagttcacaaagaaagtgcggactaatgcggccatgggggcagtctttaccgaagagaaccaatgggacaatgctagagccgcagtggaagatgaggagttctggaagctagtagaccgcgaaagggagcttcacaagctgggaaaatgtggctcctgcatatataacatgatgggtaagcgagagaagaagctcggggagtttggaaaagccaagggcagtcgggctatctggtacatgtggctgggcgccagatacttggagttcgaagcgctggggtttctcaatgaggatcattggttcagcagggaaaactcttattccggagttgagggtgaaggccttcacaaactggggtacattttacgcgacatctcaaagattcctggaggcgcaatgtatgccgatgacacagctggttgggacactcgtatcaccgaggatgacctgcataatgaggaaaagataacgcagcagatggatcccgagcaccggcagttggccaacgcaatctttaaactcacataccaaaataaggtggtcaaagtgcagagaccaacccccaaggggactgtgatggacattatcagcaggaaagatcagcgcggatcgggccaggtcggcacatatgggctgaacaccttcactaatatggaagctcagctagttcgacagatggagggagaaggtgtgctttctaaggccgacctggagaaccctcacctcctggagaagaaaattacccagtggttggaaacaaagggcgtagatcggttaaaaagaatggctatcagtggggacgattgcgtggtcaagccaatagacgataggtttgccaatgcactgctcgcgcttaacgacatgggaaaagtgcgcaaggatattccgcagtggcaaccctccaagggctggcatgactggcagcaggttcctttctgtagccaccatttccacgagctgatcatgaaagacggtagaaagctagtggtcccatgccggccccaggatgaactgatcgggagggcccgtatttcacaaggagctggctggtccctcaaagagacggcctgtttgggcaaggcatacgctcagatgtggtctctgatgtattttcaccgacgcgaccttagactggccagcaacgcaatatgcagtgccgtgcctgtacattggatcccaacctcccggactacatggagcattcacgcgcatcaccagtggatgaccactgaagatatgctcacagtttggaatagggtgtggatcgaggacaacccctggatggaggataaaacccctgtcacgacatgggaagacgtgccgtacttagggaagcgcgaggatcaatggtgtggatctctgattggtttgacctcaagagctacttgggcccagaatatcctgaccgcaatacagcaggttcggagtctcatcggcgacgaagagttccttgattacatgccatccatgaagaggtttcgaaaagaggaagagagcgaaggggccatttggtga

SEQ ID NO: 15221 - RNA, 9873 nt, synthetic construct
  misc_feature 1..9873: note = derived and/or modified CDS sequence (opt3) from DENV-3__FJ639712__SS-prME
  source 1..9873: mol_type = other RNA
accagcctgtgcctcatgatgatgttccccgcaacacttgcttttcacctgacttccagagacggagaacctaggatgatcgtggggaagaacgaacggggaaaatctttgttattcaagacggcatcaggtattaatatgtgtaccctgatagccatggatctcggcgaaatgtgcgacgatacagtcacttacaaatgtccactcatcgcggaagttgagccggaagacattgattgctggtgtaacctgaccagtacatgggtgacctatgggacttgcaatcaggctggagagcatcgccgagacaagcgtagcgtagcccttgcaccccacgtgggcatgggtctggatacaagaacccaaacgtggatgtccgccgagggggcttggaggcaggtcgaaaaagtggagacttgggcattgcggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaaaagcaaacccacactggacatcgagctccagaagaccgaagcaactcaactggccacacttaggaaactgtgtattgagggaaagatcaccaatattacgaccgatagtcggtgccctacacagggcgaagctactttgccagaggaacaggaccagaactatgtctgtaaacacacctacgttgatcgcggttgggggaatggatgcggcctctttggcaaggggtccctggtgacatgcgccaagttccaatgtttagagcccatcgagggaaaagtagtgcagtatgaaaacctgaagtacactgtcataattaccgtgcacacaggtgaccagcatcaggttggcaatgacacccaaggggtgactgtcgagatcacgcctcaggcatctacagtggaagctgtactcccagagtatggaacccttggcctggaatgcagcccgcgaactggtttggattttaacgagatgattctactgaccatgaaaaataaggcctggatggttcacagacagtggttctttgacctccccctgccttggacatccggggcgaccactgagacaccaacgtggaacaggaaagaacttctggtgaccttcaagaatgcccatgccaaaaagcaagaggtcgtggtcttgggctcacaggaaggagctatgcacactgccctcacaggcgctaccgagatccagaacagtgggggaacaagcatctttgccggtcacctgaagtgtcggttaaaaatggataagctggaactaaaaggcatgtcttacgcaatgtgcctcaatactttcgtgctgaagaaagaggtttccgagacccagcatgggacgattcttataaaggtggaatacaagggagaggacgccccctgtaaaatccctttctcaaccgaagatggccaaggtaaggctcacagcgggcgtttgattacagcgaacccagtagtcactaaaaaggaggagcccgtgaacatcgaagcagagccgccttttggcgaaagtaatatagttattggaatcggcgacaaagccctgaagatcaactggtataagaaagggtcttccattggaaagatgttcgaggctaccgcccgcggtgcaagaaggatggccatcctcggcgatacagcttgggactttgggagcgtgggaggcgtcctaaattcgcttggtaaaatggtgcatcagattttcgggtctgcctacactgcactgttttccggcgtatcatgggtgatgaagataggaatcggcgttttgctcacctggattgggctgaacagtaaaaatacgagcatgtccttctcttgcatcgtcatcggaattataacattatatctgggcgcggtggtgcaggctgatatgggttgtgtcatcaactggaaggggaaggaactaaaatgcggaagcggcatttttgttaccaatgaggtgcacacttggacagagcagtacaagttccaagccgactcacccaaacggctcgcaaccgccatcgctggtgcctgggaaaacggcgtgtgtgggattcgaagtactacccgcatggagaatctgctttggaagcagatcgcaaacgaattgaattatatactgtgggagaacaatatcaaactcacagtagtcgtgggagatattatcggcgttctggaacaggggaagagaacgttaaccccacagcctatggagctgaaatactcctggaagacttggggaaaggctaaaattgtgacagccgagacccaaaacagctcttttatcatagacggccccaatacaccagaatgcccctcagcgagtagggcctggaacgtctgggaggtggaagactatggtttcggggtttttactaccaacatttggcttaagttgcgggaggtgtacacgcagagctgtgatcatcgcctcatgtccgctgcaatcaaagacgaaagagccgtacacgctgatatgggatactggattgagtctcagaagaatggctcgtggaaactggagaaggccagcttcatcgaagtcaagacatgcacctggcctaaatcccacactctatggtcaaacggtgtgctggagagtgacatgataatcccaaagtctctcgcaggcccgattagccagcataatcacaggcccgggtatcatacccaaacagcgggaccttggcacctgggcaaacttgaattggattttaactactgcgaggggactaccgtggtcatcacagagaattgtggaacgcgtggcccatccctgcggaccactacagtttcaggtaagttaattcacgaatggtgctgtcgaagctgcaccctaccccctctgagatatatgggggaggacggatgttggtacggcatggaaatcaggccaataaacgagaaagaagagaatatggtgaagtctcttgtatccgccggtagtggcaaggtggataacttcactatgggggtcctgtgcttggctattctcttcgaggaagtgatgcgcggaaaatttggcaagaaacatatgatcgccggggttctgttcacatttgtgctactgctcagcggacagatcacctggcgggacatggcacacacgctgattatgatcggctctaatgcttccgatagaatgggtatgggggtcacttatcttgccttgattgcaaccttcaagatacagccctttctggccttaggattctttctcaggaaactgacatcacgcgagaaccttctgctaggcgtgggcctcgctatggcgaccactctgcaattgccggaagacatcgagcagatggccaatgggattgcactgggattaatgacactcaagctgatcacccagttcgaaacataccagctttggactgctctggttagtttgacctgtagcaacacgatttttacactcaccgtggcctggcgaactgccaccctgatcctagctggtgtctcgctgcttcctctctgccaatcctctagcatgcggaagacagattggctgccaatgactgtagcagccatgggcgtgccccctttgcccctgttcatattttcattaaaagacaccccaaagcgtagaagttggcctctcaatgagggggttatggcggtgggactggtctccatccttgcttctagcctgttgaggaacgatgtgcccatggccggcccactcgtagccggtgggctgctaattgcctgttatgtgatcacgggaacatccgctgacctgaccgtcgagaaagcagccgacgttacttgggaagaggaagcggagcagacaggcgtgtcacataatcttatgattaccgtggatgacgatggcactatgcgcatcaaggacgatgaaacagagaacatactcaccgtcctgttgaaaacggctttactgattgtgagcgggatcttcccgtacagtatccctgccactctcctggtttggcacacctggcagaagcagacacaacggtctggagtactttgggacgtgccctccccacccgagacccagaaagcagaactggaggaaggtgtctacagaattaagcagcagggcatatttgggaagacacaagtgggagttggcgtgcagaaagagggtgtcttccatactatgtggcacgtgacccgaggggcagtattgacgcacaacggaaagaggctagagcctaattgggctagcgtcaaaaaggatctgatctcgtatggcggcgggtggcgcctcaacgcccagtggcaaaaaggagaagaggtgcaggttattgcagtggaaccaggtaagaatcccaagaacttccagacaatgcctggcatctttcagactaccacaggggagattggagctatcgccctggacttcaaaccgggcacctcaggttctccaataatcaatcgggaagggaaggtcgtgggactttacggcaacggcgttgtgactaaaaatgggggatatgtcagtggtattgcgcaaaccaacgccgagcccgatggccctacaccagagttagaagaggaaatgtttaagaaaagaaatctgacgatcatggacctccatcccgggtccggaaagactaggaagtacttgcctgcaattgtgcgtgaggctatcaaacgccggctgagaaccctcatactggccccgacaagggtagtggctgcagaaatggaggaggcccttaagggcctgcccattcgatatcagaccactgccacaaaaagcgaacacaccggtcgggagatcgttgatttgatgtgccatgctacgttcactatgcgcctactgtctccagtcagagtgcctaactacaatctcgtgatcatggacgaagcgcactttacagatcccgcaagcattgccgctagggggtatatctccacccgggtcggaatgggcgaggccgcagccatattcatgaccgctactccacctggcacagcggaagcctttccccagtcaaacgcaccaattcaggacgaggagcgagacatcccggaaagaagttggaatagcgggaacgagtggattaccgatttcgtaggaaagacagtgtggtttgttccttctatcaaagctggtaatgacatagccaactgtttacgcaagaacggcaagaaagtgattcaactgtccaggaagactttcgatacggaataccagaaaacccgtcttaatgagtgggactttgtcgtgacaactgatatctcagagatgggggcaaacttcaaggccgaccgggttatcgatcccagaaggtgcctgaaaccagtgattctcaccgacggacccgaacgcgtcatcttggctggccctatgccagtgacagccgcgagtgcagcccagcgaagaggtcgggtagggaggaatccccagaaggagaacgatcaatacattttcaccggccagcctctgaataacgacgaagatcatgctcactggactgaggccaagatgctcctggacaatataaacacgccggaaggaatcattccagctctttttgagcccgagcgcgagaaaagcgcagccatcgacggcgagtatcgtctaaagggggaatccagaaaaaccttcgtggagctgatgcggaggggagatttgcctgtttggttagctcacaaggtcgcctctgaaggtatcaaatacgcagaccgcaagtggtgctttgatggcgagcgaaataaccagattctggaggaaaatatggacgtggagatatggacaaaagaaggggagagaaagaagctccggcccaggtggctggatgcgcgcacttattcggacccacttgccctgaaagagttcaaggattttgctgccggaagaaaaagcatcgcactcgacttggtgaccgagattggcagggtcccttcacatctggctcaccggacacgtaacgccctagataatctggttatgctccatacctccgagcacggtgggcgcgcataccgacacgccgtggaagaacttcccgaaactatggagacactgttattgctgggcctcatgatcctgcttacgggaggcgctatgctgttcctcattagtgggaagggaatcggtaaaacctctataggcttgatctgtgtaattgtgagctccgggatgctgtggatggcggacgtcccattacagtggatcgcctcagcaattgtgctagagtttttcatgatggttctgctcatccctgaaccggagaagcaaagaactccccaggataaccagcttgcttatgtggtcataggcattctgacattggccgccatcgtagcagctaatgaaatgggcctgctcgagaccaccaagagggacctgggtatgtctaaagaaccaggggtggttagccctacaagttaccttgatgtggacctccatcccgcctccgcgtggactctgtatgctgtcgccacgaccgtgattacaccaatgttgcggcacactatcgagaacagcaccgcaaatgtctctctggccgctatagcaaaccaagccgtggttttaatgggcctagacaagggatggcctatctcaaaaatggatctgggcgtgcccctccttgcgctggggtgctactcccaggtaaacccgttgacactgaccgctgccgtgctcctgcttgtcactcattacgcaattatcggaccaggcttacaggccaaggctacgcgcgaggcccagaaaagaacagcagctggtattatgaagaatcctaccgttgacgggatcatgactatagatctggaccccgtgatttatgatagtaagtttgaaaaacaactcggacaggtcatgttgctggtgctatgtgccgtacagctgctccttatgaggaccagctgggcgctgtgcgaggccttgacactggcaactggcccaatcaccacactctgggaaggttcgcccggcaagttctggaacacgaccatcgctgtgtctatggccaatatttttcgggggtcctacctggcaggagctggcttagccttcagcatcatgaaatcagttgggactggacgaagaggcacaggtagtcagggggagacccttggagaaaagtggaaaaagaagctgaaccaactctctcgcaaagagtttgacctatataagaaatccggcataactgaggtggataggacagaagccaaggagggtctgaaacggggcgaaaccacgcaccatgcggtcagccgtgggtcagctaagttgcagtggttcgtggagagaaatatggtcattcctgaaggaagggtgatcgacctgggctgtgggcgcggaggctggagttactattgcgcaggtctcaaaaaggttaccgaggtacgggggtacacaaagggaggcccgggccacgaggaacccgtgccaatgagcacttatgggtggaacattgtcaaacttatgtccggaaaggatgtgttctacctgcctcccgagaaatgtgacaccttgctgtgcgatatcggtgaatctagcccttccccaacagttgaggagtcacgaactataagagtgctcaagatggtcgaaccctggttaaggaataaccagttttgtatcaaagtgctgaatccttacatgccaaccgtaattgagcaccttgaacgcctgcagcggaagtatggcgggatgctagtgagaaaccccctctctcgtaatagtacacatgagatgtactggatctcgaacggaaccggcaatattgttagctccgtcaacatggtgtctaggctgttgctgaatcggttcactatgacgcaccgccgaccgacaatcgaaaaggacgtggatctcggtgccgggaccagacatgtcaacgctgagcctgagactccaaacatggacgttattggagaaaggatcaaacggataaaggaggaacactcaagcacctggcactatgacgatgagaatccctacaaaacatgggcctatcatggctcctacgaagtgaaggcaacgggcagtgcctctagcatgattaacggggtagtgaaacttctgaccaagccttgggacgtcgtgccaatggttactcaaatggctatgacagataccactccctttggacagcagcgcgtgttcaaggagaaagtcgacacaagaaccccgaggcctatgcccggtacacgaaaggtgatggagatcactgcggaatggttatggcggaccctgggccgtaataaaaagccaagattgtgcacgcgcgaggaatttaccaaaaaggtaaggacaaacgccgcaatgggggctgttttcactgaggaaaatcaatgggattcagcccgggcagccgtggaggacgaggaattttggaagctcgtcgatagagagcgcgaactgcacaaactaggaaagtgtggctcctgcgtgtataacatgatgggtaaaagggagaagaaacttggggagttcggaaaggctaaaggcagtcgagccatctggtacatgtggctgggcgcgcggtacctcgaatttgaggcactggggttcttgaatgaagaccattggtttagcagagagaactcttattccggagtggaaggtgagggcctgcacaagctcgggtacattcttagggatatatcaaagatccctggaggcgccatgtatgctgacgataccgccggttgggacacacgcattactgaggacgatctgcataatgaagagaaaatcacccagcagatggaccccgaacaccgtcagttagcaaacgctattttcaagctgacgtaccaaaataaagtcgttaaggtgcagcggccaacacccaaagggaccgtaatggatatcataagcagaaaggaccagaggggatcgggccaggtgggcacttatgggttgaacacatttaccaatatggaggcccaactcgtccgccagatggaaggagagggtgtgctgtctaaggctgatctagagaaccctcaccttctggagaaaaagatcactcagtggctcgagaccaaaggcgttgaacgactgaagcggatggccattagtggggacgattgcgtggtcaaaccaatcgacgatagattcgcaaatgcgttgttagccctgaacgacatgggaaaggtgaggaaggatattccgcagtggcaaccctccaaaggctggcatgactggcagcaggtacctttctgtagccaccattttcacgagctcatcatgaaggatggtcgcaaacttgttgtgccatgcagaccccaggacgaactgatagggcgggctaggatttcacaaggagccggctggtccctaaaggagacagcatgtctgggcaaggcttacgcccagatgtggtctctcatgtatttccaccgtcgagacttgcgcctggcaagcaacgccatctgcagtgcggtccctgtgcattggatcccaacgtccagaaccacttggagcattcacgctcatcaccagtggatgacaaccgaggatatgcttactgtttggaatcgggtgtggatagaagacaacccctggatggaggataagacacctgtcaccacgtgggaagacgtgccgtacctggggaagagggaggatcaatggtgtggatctctcatcggtttaacatcacgcgccacctgggcacagaatattctgactgccatccagcaggtaagaagtttgattggcgacgaggaatttctggattacatgccatccatgaaacggttcaggaaggaggaagagagcgaaggggctatctggtga

SEQ ID NO: 15222 - RNA, 9873 nt, synthetic construct
  misc_feature 1..9873: note = derived and/or modified CDS sequence (opt3) from DENV-3__FJ639713__SS-prME
  source 1..9873: mol_type = other RNA
accagcctgtgcctcatgatgatgcttcccgcaacactggctttccacttgacttccagggacggcgaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcagcttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaatagtaaaaacacgtcaatgagcttttcctgcatcgttattggaataatcacactgtatctaggcgcggtcgtgcaggctgatatgggttgtgtgattaattggaaggggaaggaactcaaatgcggaaacggcatcttcgtcaccaatgaggttcacacttggacagagcagtacaagtttcaagccgactctcccaaacggctggcaaccgccattgctggtgcctgggaaaacggcgtgtgtgggatccgaagcactacccgcatggagaatcttttgtggaagcagatagcaaacgaactgaattatatcctctgggagaacaatattaaactgacagtggtagtcggagatatcattggcgtgttagaacaggggaagagaacgctgaccccacagcctatggagcttaaatactcatggaagacttggggaaaggctaaaatcgttacagccgagacccaaaacagttccttcataattgacggccccaacacaccagaatgccccagcgcgtctagggcctggaatgtgtgggaggtcgaagactatggttttggggtgttcactaccaacatctggttgaagctccgggaggtttacacgcagtcatgtgatcatcgcctgatgagtgctgcaattaaagacgaaagagccgtgcacgctgatatgggatactggatcgagagccagaagaatggctcctggaaactagagaaggcctcttttatagaagtaaagacatgcacctggcctaaatcgcacactctgtggagcaacggtgtcctcgagtccgacatgatcattccaaagtcactggcaggcccgatcagtcagcataatcacaggcccgggtatcatacccaaacagcgggaccttggcaccttggcaaattggaactggatttcaactactgcgaggggactaccgtggtgattgccgagaattgtggaacacgtggcccatctttacggacgaccactgtcagcggtaagctcatccacgaatggtgctgtcgatcctgcacactgccccctcttagatatatgggggaggacggatgttggtacggcatggaaataaggccaattaacgagaaagaagagaatatggttaagtcactggtgagcgctggttctggcaaggtagataactttaccatgggggtgttgtgcctcgccatcctgttcgaggaagtcatgcgcggaaaattcggcaagaaacatatgatcgcaggggtgctatttactttcgttctgctcctgtccggacagattacatggcgggacatggctcacacccttatcatgattggcagtaatgccagcgatagaatgggtatgggggtgacgtatttggcactgatagccacttttaagatccagcccttcttagctctcggatttttcctgaggaaacttacctctcgcgagaacctgctactcggcgtcggcctggcgatggccacaaccttgcaactgccggaagacattgagcagatggcaaatgggatcgctttaggactcatgactctgaaacttattacacagtttgaaacctaccagctgtggacagccttggtgtccctcacttgttcaaacaccatcttcacgctgacagttgcctggcgaaccgctactctaatactggcgggtgtgagtcttctccctctgtgccaaagctcgtccatgcggaagaccgattggttgccaatgacagtcgccgcgatgggcgtaccccctctgcccttatttatcttctctctcaaagacactccaaagcgtagaagctggcctctgaatgagggggtgatggctgttggacttgtgtcaattctggccagttccttgctcaggaacgatgtccccatggcaggcccactggtggccggtgggctactgatcgcttgttatgtaattaccggaacgtctgcagaccttacagtggagaaagccgcggacgtcacctgggaagaggaagctgagcagactggcgttagccataacctcatgatcacagtggatgacgatggcaccatgcgcataaaggacgatgaaactgagaatattctgacagtgttgttaaaaaccgccctgctcatcgtctccgggatctttccgtactcaattcctgcaacgctgcttgtgtggcacacttggcagaagcagacccaacggagcggagttctgtgggacgtacccagtccacccgagacacagaaagccgaattggaggaaggtgtgtacagaataaagcagcagggcatcttcgggaagacccaagtcggagtgggcgttcagaaagagggtgtgtttcatacaatgtggcacgtcactagaggggctgtgctaacccacaacggaaagcgactggagcctaattgggcctctgtcaagaaggatctcatttcctatggcggcgggtggcgcctgagcgcacagtggcaaaaaggagaagaggtccaggtgatcgctgttgaaccaggtaagaaccccaagaatttccagacgatgcctggcattttccagacaactaccggggagatcggagccatagcgcttgactttaaaccgggcacatcgggttcaccaatcattaaccgggaagggaaggtggtcggattatacggcaatggcgtggttaccaaaaacgggggatatgtgtctggtatcgcccaaactaatgcagagcccgatggccctaccccagagctggaagaggaaatgttcaagaaaagaaacctcacaattatggacttgcatcccgggagtggaaagacgaggaagtacctgcctgctatcgtccgtgaggccataaaacgccggctcagaactctgattcttgctccgaccagggtggtagcagccgaaatggaggaggccctgaagggcttgcccatccgatatcagacaaccgctactaaatccgaacacacaggtcgggagatcgtggatctaatgtgccatgcgacctttacgatgcgcctgctcagcccagttagagtccctaattacaacttagtgattatggacgaagcacacttcactgatcccgcctctatcgctgccagggggtatataagcacacgggtgggaatgggcgaggcagccgctatttttatgaccgcgaccccacctggcactgccgaagcattcccccagtccaatgctccaatccaggacgaggagcgagacattccggaaagatcatggaacagtgggaatgagtggatcacagattttgtcggaaagaccgtatggttcgtgcctagcataaaagccggtaacgacattgcaaactgtctgcgcaagaatggcaagaaagttatccaactttctaggaagacatttgatactgaataccagaaaacgcgtctgaacgactgggatttcgtggtcaccacagacatctccgagatgggggccaattttaaggctgatcgggtgattgaccccagaaggtgcctcaaaccagttatcttgactgatggacccgagcgcgtgattctggccggccctatgccagtcaccgcggcatcagccgctcagcgaagaggtcgggtggggaggaacccccagaaggaaaatgaccaatacatattcacaggccagcctctcaacaatgatgaggaccatgcccactggaccgaagctaagatgctgcttgacaacatcaatactccggagggaattatcccagcactattcgaacccgagcgcgagaaaagtgccgctatcgatggcgaatatcgtctgaagggggagagcagaaaaacgtttgtagaattgatgcggaggggagacttacctgtgtggctggcccacaaggttgcatccgagggtattaaatacaccgatcgcaagtggtgcttcgacggcgaacgaaacaatcagatactcgaggagaacatggatgtcgaaatctggacaaaagagggggaaagaaagaagctgcggcccaggtggcttgacgcgcgcacttattctgatccactggccctcaaagagtttaaggacttcgctgccggaagaaaatcgattgcattggatctggtgaccgaaatcggcagggtgcctagccatctagctcaccggacacgtaatgccctggacaacctcgtcatgcttcatacctcagagcacggtgggcgcgcataccgacacgccgttgaggaactgcccgagactatggaaacattattgctgctcggcctgatgattcttctgacgggaggcgctatgctctttttgatctccgggaagggaataggtaaaaccagtatcggcctgatttgtgtgatcgtatctagcgggatgttatggatggcggatgtgccactacagtggattgcctccgcaatcgtcctggagttctttatgatggtgctccttatacctgagccggaaaagcaaagaactccccaggacaatcagctggcttatgttgtgattggaatcttgacactggccgccattgtcgcagctaacgagatgggcctcctggaaaccaccaagagggatcttggtatgtcaaaagagccaggggtagtgtctcctacaagctacctcgacgttgacctgcatcccgccagtgcgtggactttgtatgctgtggccacgaccgtcatcacaccaatgctgcggcacactatagaaaattccaccgcaaacgtgagcttagccgctatcgcaaaccaagccgtcgtgctaatgggcctggataagggatggcctatttctaaaatggacctcggcgttccccttctggcgttggggtgctactcacaggtgaatccgctgacactcaccgctgccgtactgcttttagtgactcattacgcaatcattggaccaggcctgcaggccaaggctacgcgcgaggcccagaaaagaacagcagctggtatcatgaagaaccctaccgtcgatgggataatgactattgacctcgatcccgttatctatgactccaagttcgagaaacaattgggacaggtgatgctgctagtcctgtgtgccgtgcagctccttctgatgaggaccagttgggcgttgtgcgaagccctgacactcgcaactggcccaatcaccacactgtgggagggtagccccggcaagttttggaatacgaccattgctgtatcgatggccaacatcttccgggggtcttacttagcaggagctggccttgccttttccataatgaaaagcgtggggactggacgaagaggcacaggttcacagggggaaaccctgggagagaagtggaaaaagaagctcaatcaactaagtcgcaaagagttcgatctgtataagaaatctggcattactgaggttgacaggtccgaggccaaggaaggtttgaaacggggcgagacaacccaccatgcggtgagccgtgggtcagctaagctgcagtggtttgtcgaaagaaacatggtgatccctgagggaagggtcattgatctcggctgtgggcgcggaggctggagttactattgcgcaggtcttaaaaaggtgacggaagttcgggggtacaccaagggaggcccgggccacgaggagcccgtaccaatgagcacatatgggtggaatatcgtgaaactgatgtccggaaaggacgtcttctacttgcctcccgaaaaatgtgatactctgctctgcgacataggtgagtctagcccttccccaaccgtggaagagtcacgaacaatcagagttttaaagatggtggagccctggctgaggaacaatcagttctgtattaaagtccttaacccttacatgccaactgtgatcgaacacctggagcgcctacagcggaagcatggcgggatgctcgtaagaaatcccctgtctcgtaacagtacccacgaaatgtattggatttcgaatggaacaggcaacatcgtgagctccgttaatatggtctctaggttgctgctcaaccggtttaccatgactcatcgccgaccgacgattgagaaggatgtggaccttggtgccgggacaagacacgtgaacgctgaacctgagaccccaaatatggacgtcatcggagagaggataaaacggattaaggaagaacactcaagcacttggcattacgatgacgaaaacccctataaaacctgggcctaccacggctcctatgaggttaaggcaacaggcagtgcctctagcatgatcaatggggtggtaaaactgttaacgaagccttgggatgtggtcccaatggtgacccaaatggctatgactgacacaacccccttcggacagcagcgcgtttttaaggaaaaagtggatactagaacaccgaggcctatgcccggtacccgaaaggtcatggagatcacagcggagtggctgtggcggactttgggccgtaacaaaaagccaagactctgcacccgcgaagagttcacgaaaaaggtgaggaccaatgccgcaatgggggctgtatttacagaagagaaccaatgggactcagcccgggcagccgttgaagatgaggagttctggaagctggtggacaaagaaagagagctacataaacttggaaaatgtggctcctgcgtctacaatatgatgggtaagcgcgagaagaagctgggggagtttggaaaagctaagggcagtagggccatttggtatatgtggctcggcgcgcgatacctggagttcgaagcattggggtttctgaacgaggatcactggttcagccgggaaaattcttactccggagtggagggtgaaggcctccataaacttgggtatatactgagagacatctcaaaaattcctggaggcgccatgtacgctgatgacactgccggttgggacaccaggatcacagaggatgacttacacaacgaggaaaagattactcagcagatggatcccgagcaccgccagctggcaaatgctatctttaaattgacctatcaaaacaaggtggtcaaagttcagcgtccaacgcccaaggggacagtgatggacataatcagccggaaggatcagagaggatcgggccaggtaggcacctacgggctcaatactttcacaaacatggaagcccaactggtgaggcagatggagggagaaggtgtcctatctaaagctgaccttgagaatcctcatctgctcgagaagaaaattatccagtggctggaaaccaagggcgtggagcgcttgaaacgaatggccattagtggggatgactgcgttgtgaagccaatcgatgaccggtttgcaaacgcgttactggccctcaacgatatgggaaaggtcagaaaagacataccgcagtggcaaccctccaagggctggcacgattggcaacaggtgcctttctgtagccatcacttccacgaacttattatgaaagacggtaggaagctggtagttccatgccgcccccaggacgagctaatcgggagagctcggatctcacaaggagccggctggtccctgaaagaaactgcatgtctcggcaaggcttatgcccagatgtggtctttgatgtactttcataggcgtgatctgcgacttgcaagcaatgccatttgcagtgcggtgcctgtccactggataccaacctcccgcacaacgtggagcatccatgctcaccatcagtggatgaccactgaggacatgctgtctgtgtggaacagagtttggattgaggataatccctggatggaagacaagacacctgtgaccacttgggaggatgtcccgtatctcgggaaacgggaagaccaatggtgtggatcattaatcggtctgacaagtagggccacctgggcacagaacattttgacggccatccaacaggtgcgctccctgataggcgatgaggagttcctcgactacatgccaagcatgaagagatttcggaaagaagaggaatctgagggggctatctggtga

SEQ ID NO: 15223 - RNA, 9873 nt, synthetic construct
  misc_feature 1..9873: note = derived and/or modified CDS sequence (opt3) from DENV-3__FJ639714__SS-prME
  source 1..9873: mol_type = other RNA
accagcctgtgcctcatgatgatgcttccagcaacactggctttccacttgacttccagagacggcgaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaattcaaagaacacgagtatgagcttttcctgcatcgttattggaataatcacactgtatctaggcgcggtcgtgcaggctgatatgggttgtgtgattaattggaaggggaaggaactcaaatgcggaaacggcatcttcgtcaccaatgaggttcacacttggacagagcagtacaagtttcaagccgactctcccaaacggctggcaaccgccattgctggtgcctgggaaagcggcgtgtgtgggatccgatcaactacccgcatggagaaccttttgtggaagcagatagcaaatgaactgaactatatcctctgggagaataacattaaactgacagtggtagtcggagatatcattggcgtgttagaacaggggaagagaacgctgaccccacagcctatggagcttaaatacagttggaagacttggggaaaggctaaaatcgttacagccgagacccaaaattccagcttcataattgacggccccaacacaccagaatgcccctctgcgtcaagggcctggaacgtgtgggaggtcgaagactatggttttggggtgttcactaccaatatctggttgaagctccgggaggtttacacgcagagttgtgatcatcgcctgatgagcgctgcaattaaagacgaaagagccgtgcacgctgatatgggatactggatcgagtcccagaagaacggctcttggaaactagagaaggcctcgtttatagaagtaaagacatgcacctggcctaaaagccacactctgtggtccaatggtgtcctcgagtcagacatgatcattccaaagagtctggcaggcccgatctctcagcataaccacaggcccgggtatcatacccaaacagcgggaccttggcaccttggcaaattggaactggatttcaattactgcgaggggactaccgtggtgattgccgagaactgtggaacacgtggccccagcttacggacgaccactgtctccggtaagctcatccacgaatggtgctgtcgatcatgcacactgccccctcttagatatatgggggaggacggatgttggtacggcatggaaataaggccaattaatgagaaagaagagaacatggttaagagcctggtgtctgctggttccggcaaggtagataattttaccatgggggtgttgtgcctcgccatcctgttcgaggaagtcatgcgcggaaaattcggcaagaaacatatgatcgcaggggtgctatttactttcgttctgctcctgagtggacagattacatggcgggacatggctcacacccttatcatgattggcagcaacgcctctgatagaatgggtatgggggtgacgtatttggcactgatagccacttttaagatccagcccttcttagctctcggatttttcctgaggaaacttacctcccgcgagaatctgctactcggcgtcggcctggcgatggccacaaccttgcaactgccggaagacattgagcagatggcaaacgggatcgctttaggactcatgactctgaaacttattacacagtttgaaacctaccagctgtggacagccttggtgtcactcacttgtagtaataccatcttcacgctgacagttgcctggcgaaccgctactctaatactggcgggtgtgagccttctccctctgtgccaatcgtcctctatgcggaagaccgattggttgccaatgacagtcgccgcgatgggcgtaccccctctgcccttatttatcttcagcctcaaagacactccaaagcgtagatcatggcctctgaacgagggggtgatggctgttggacttgtgagtattctggcctcctctttgctcaggaatgatgtccccatggcaggcccactggtggccggtgggctactgatcgcttgttatgtaattaccggaacgagcgcagaccttacagtggagaaagccgcggacgtcacctgggaagaggaagctgagcagactggcgtttcccataacctcatgatcacagtggatgacgatggcaccatgcgcataaaggacgatgaaactgagaacattctgacagtgttgttaaaaaccgccctgctcatcgtctcagggatctttccgtacagcattcctgcaacgctgcttgtgtggcacacttggcagaagcagacccaacggagtggagttctgtgggacgtaccctctccacccgagacacagaaagccgaattggaggaaggtgtgtacagaataaagcagcagggcatcttcgggaagacccaagtcggagtgggcgttcagaaagagggtgtgtttcatacaatgtggcacgtcactagaggggctgtgctaacccacaatggaaagcgactggagcctaactgggcctccgtcaagaaggatctcattagctatggcggcgggtggcgcctgtcggcacagtggcaaaaaggagaagaggtccaggtgatcgctgttgaaccaggtaagaatcccaagaacttccagacgatgcctggcattttccagacaactaccggggagatcggagccatagcgcttgactttaaaccgggcacatcaggttctccaatcattaatcgggaagggaaggtggtcggattatacggcaacggcgtggttaccaaaaatgggggatatgtgagtggtatcgcccaaactaacgcagagcccgatggccctaccccagagctggaagaggaaatgttcaagaaaagaaatctcacaattatggacttgcatcccgggtccggaaagacgaggaagtacctgcctgctatcgtccgtgaggccataaaacgccggctcagaactctgattcttgctccgaccagggtggtagcagccgaaatggaggaggccctgaagggcttgcccatccgatatcagacaaccgctactaaaagcgaacacacaggtcgggagatcgtggatctaatgtgccatgcgacctttacgatgcgcctgctctctccagttagagtccctaactacaatttagtgattatggacgaagcacacttcactgatcccgccagcatcgctgccagggggtatatatccacacgggtgggaatgggcgaggcagccgctatttttatgaccgcgaccccacctggcactgccgaagcattcccccagtcaaacgctccaatccaggacgaggagcgagacattccggaaagaagttggaatagcgggaacgagtggatcacagattttgtcggaaagaccgtatggttcgtgccttctataaaagccggtaatgacattgcaaactgtctgcgcaagaacggcaagaaagttatccaactttccaggaagacatttgatactgaataccagaaaacgcgtctgaatgactgggatttcgtggtcaccacagacatctcagagatgggggccaactttaaggctgatcgggtgattgaccccagaaggtgcctcaaaccagttatcttgactgatggacccgagcgcgtgattctggccggccctatgccagtcaccgcggcaagtgccgctcagcgaagaggtcgggtggggaggaatccccagaaggaaaacgaccaatacatattcacaggccagcctctcaataacgatgaggaccatgcccactggaccgaagctaagatgctgcttgacaatatcaacactccggagggaattatcccagcactattcgaacccgagcgcgagaaaagcgccgctatcgatggcgaatatcgtctgaagggggagtccagaaaaacgtttgtagaattgatgcggaggggagacttacctgtgtggctggcccacaaggttgcatctgagggtattaaatacaccgatcgcaagtggtgcttcgacggcgaacgaaataaccagatactcgaggagaatatggatgtcgaaatctggacaaaagagggggaaagaaagaagctgcggcccaggtggcttgacgcgcgcacttattcggatccactggccctcaaagagtttaaggacttcgctgccggaagaaaaagcattgcattggatctggtgaccgaaatcggcagggtgccttcacatctagctcaccggacacgtaacgccctggacaatctcgtcatgcttcatacctccgagcacggtgggcgcgcataccgacacgccgttgaggaactgcccgagactatggaaacattattgctgctcggcctgatgattcttctgacgggaggcgctatgctctttttgatcagtgggaagggaataggtaaaacctctatcggcctgatttgtgtgatcgtaagctccgggatgttatggatggcggatgtgccactacagtggattgcctcagcaatcgtcctggagttctttatgatggtgctccttatacctgagccggaaaagcaaagaactccccaggacaaccagctggcttatgttgtgattggaatcttgacactggccgccattgtcgcagctaatgagatgggcctcctggaaaccaccaagagggatcttggtatgtctaaagagccaggggtagtgagccctacaagttacctcgacgttgacctgcatcccgcctccgcgtggactttgtatgctgtggccacgaccatcataacaccaatgctgcggcacactatcgaaaacagcaccgcaaatgtctctttagccgctattgcaaaccaagccgtggtcctaatgggcctggataagggatggcctatctcaaaaatggacctcggcgtgccccttctggcgttggggtgctactcccaggttaacccgctgacactcaccgctgccgtgctgcttttagtaactcattacgcaattatcggaccaggcctgcaggccaaggctacgcgcgaggcccagaaaagaacagcagctggtataatgaagaatcctaccgtggatgggattatgactatcgacctcgatcccgtcatctatgacagtaagttcgagaaacaattgggacaggttatgctgctagtgctgtgtgccgtccagctccttctgatgaggaccagctgggcgttgtgcgaagccctgacactcgcaactggcccaattaccacactgtgggagggttcgcccggcaagttttggaacacgaccatcgctgtgtctatggccaatatattccgggggtcctacttagcaggagctggccttgcctttagcattatgaaatcagtagggactggacgaagaggcacaggtagtcagggggaaaccctgggagagaagtggaaaaagaagctcaaccaactatctcgcaaagagttcgatctgtataagaaatccggcatcactgaggtggacaggacagaggccaaggaaggtttgaaacggggcgagaccacgcaccatgcggttagccgtgggtcagctaagctgcagtggtttgtggaaagaaatatggtcattcctgagggaagggtgatcgatctcggctgtgggcgcggaggctggagttactattgcgcaggtcttaaaaaggtcaccgaagtgcgggggtacacaaagggaggcccgggccacgaggagcccgttccaatgagcacttatgggtggaacatagtaaaactgatgtccggaaaggacgtgttctacttgcctcccgaaaaatgtgataccctgctctgcgacatcggtgagtctagcccttccccaacagtcgaagagtcacgaactattagagtgttaaagatggttgagccctggctgaggaataaccagttctgtatcaaagtgcttaatccttacatgccaaccgtcattgaacacctggagcgcctacagcggaagtatggcgggatgctcgtgagaaaccccctgtctcgtaatagtacacatgaaatgtactggatctcgaacggaaccggcaatattgtaagctccgtgaacatggtttctaggttgctgctcaatcggtttactatgacgcaccgccgaccgacaatcgagaaggatgtcgaccttggtgccgggaccagacatgtgaacgctgaacctgagactccaaacatggacgtgataggagagaggattaaacggatcaaggaagaacactcaagcacctggcactatgatgacgaaaatccctacaaaacatgggcctatcatggctcctacgaggtcaaggcaacgggcagtgcctctagcatgatcaacggggttgtgaaactgttaaccaagccttgggatgtagtgccaatggtcactcaaatggctatgacagacaccactcccttcggacagcagcgcgtgtttaaggaaaaagttgatacaagaaccccgaggcctatgcccggtacacgaaaggtgatggagattactgcggagtggctgtggcggaccttgggccgtaataaaaagccaagactctgcacgcgcgaagagttcaccaaaaaggtcaggacaaacgccgcaatgggggctgtgtttactgaagagaatcaatgggactcagcccgggcagccgtagaagatgaggagttctggaagctggttgacaaagaaagagagctacacaaacttggaaaatgtggctcctgcgtgtataacatgatgggtaagcgcgagaaaaagctgggggagtttggaaaagctaagggcagtagggccatatggtacatgtggctcggcgcgcgatacctggagttcgaagcattggggtttctgaatgaggatcattggttcagccgggaaaactcttattccggagtcgagggtgaaggcctccacaaacttgggtacatcctgagagacatttcaaaaatccctggaggcgccatgtatgctgatgacaccgccggttgggacacaaggattactgaggatgacttacataatgaggaaaagatcacccagcagatggatcccgggcaccgccagctggcaaacgctatatttaaattgacgtaccaaaataaggtggtgaaagtccagcgtccaacacccaagggaaccgttatggacatcattagccggaaggatcagagaggctcgggccaggtggggacttatggactcaacacattcaccaatatggaggcccaactggtaaggcagatggaaggtgagggcgtgctatctaaagctgaccttgaaaaccctcatctgctcgagaagaaaatcactcagtggctggagaccaagggggtcgaacgcttgaaacgaatggccattagtggagatgactgcgtggttaagccaatcgatgaccggtttgcaaatgcgttactggccctcaacgatatgggcaaggtgagaaaagacataccgcagtggcaaccctccaagggttggcatgattggcagcaggtccctttctgtagccaccatttccacgagcttattatgaaagacgggaggaagctggtggtaccatgccgcccccaggacgaactaatcggaagggctcggatctcacaaggcgccggctggtccctgaaagagacagcatgtctcgggaaggcttacgcccagatgtggtctttgatgtattttcacaggcgtgatctgcgacttgcaagcaacgccatttgcagtgcggttcctgtgcattggataccaacgtcccgcaccacttggagcatccacgctcatcaccagtggatgacaaccgaagacatgctgactgtctggaatagagtgtggattgaggataacccctggatggaggacaagacacctgttaccacgtgggaagatgtgccgtacctcggaaaacgggaggaccaatggtgtggttctttaatcggcctgacatcaagggccacctgggcacagaatattttgactgccatccagcaggtccgcagtctgataggggatgaagagttcctcgactacatgccatccatgaagagatttcggaaagaggaagagaccgaaggagctatctggtga

SEQ ID NO: 15224 - RNA, 9873 nt, synthetic construct
  misc_feature 1..9873: note = derived and/or modified CDS sequence (opt3) from DENV-3__FJ639715__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgcaaaaaagcaagaggtcgtggtcctcggctcacaggaaggagctatgcacactgccctgacaggcgctaccgagatccagaacagtgggggaacaaatatcttcgccggtcacttaaagtgtcggctgaaaatggataagctagaactcaaaggcatgagctacgcaatgtgcctgaacacttttgtgcttaagaaagaggtttctgagacccagcatgggacgattttgataaaggtggaatacaagggagaggacgccccctgtaaaatccctttctccaccgaagatggccaaggtaaggctcacaacgggcgtctgattacagcgaatccagtagtcactaaaaaggaggagcccatcaacatagaagcagagccgcctttcggcgaatcaaatattgtgatcggaatcggcgacaaagccctcaagattaactggtataagaaagggagcagtatcggaaagatgtttgaggctaccgcccgcggtgcaagaaggatggccattctgggcgatacagcttgggacttcgggtctgttggaggcgtgcttaattccctgggtaaaatggtccatcagatatttgggagcgcctacactgcattgttctcgggcgtgtcttggatcatgaagattggaatcggcgtactcctgacctggatcgggttaaactccaaaaatacgtcaatgagttttagctgcattgtgataggaatcattacactgtatctaggcgcggttgtccaggctgatatgggttgtgtgatcaactggaaggggaaggaactcaaatgcggaaatggcattttcgtgaccaacgaggtccacacttggacagagcagtacaagtttcaagccgactcccccaaacggctggcaaccgccatcgctggtgcctgggaaaatggcgtttgtgggatacgatctactacccgcatggagaaccttttgtggaagcagatcgcaaatgaactgaactatattctctgggagaataacatcaaactgacagtggtggtaggagatattatcggcgtcttagaacaggggaagagaacgctgaccccacagcctatggagcttaaatacagctggaagacttggggaaaggctaaaatagtgacagccgagacccaaaactcaagtttcattatcgacggccccaatacaccagaatgcccctccgcgagcagggcctggaacgtttgggaggtggaagactatggttttggggtcttcactaccaatatttggttgaagctccgggaggtgtacacgcagtcttgtgatcatcgcctgatgtcagctgcaatcaaagacgaaagagccgttcacgctgatatgggatactggatagagagtcagaagaacggcagctggaaactagagaaggcctcctttatcgaagtgaagacatgcacctggcctaaatctcacactctgtggtcgaatggtgtactcgagagcgacatgattatcccaaagtccctggcaggcccgatttcacagcataaccacaggcccgggtatcatacccaaacagcgggaccttggcaccttggcaaattggaactggatttcaattactgcgaggggactaccgtcgtgatcgccgagaactgtggaacacgtggcccaagtttacggacgaccactgtgtctggtaagctcatacacgaatggtgctgtcgaagctgcacactgccccctcttagatatatgggggaggacggatgttggtacggcatggaaattaggccaatcaatgagaaagaagagaacatggtcaagtccctggtttcagctggtagcggcaaggtggataattttaccatgggggtattgtgcctcgccatcctgttcgaggaagtgatgcgcggaaaattcggcaagaaacatatgattgcaggggtcctatttactttcgtgctgctcctgtctggacagatcacatggcgggacatggctcacacccttattatgataggctccaacgccagtgatagaatgggtatgggggttacgtatttggcactgatcgccacttttaagattcagcccttcttagctctcggatttttcctgaggaaacttaccagccgcgagaatctgctactcggcgtgggcctggcgatggccacaaccttgcaactgccggaagacatcgagcagatggcaaacgggattgctttaggactcatgactctgaagcttatcacacagtttgaaacctaccagctgtggacagccttggtctctctcacttgttccaataccatattcacgctgacagtggcctggcgaaccgctactctaatcctggcaggtgtttcacttctccctctgtgccaaagtagctcgatgcggaagaccgattggttgccaatgacagtggccgcgatgggcgtcccccctctgcccttatttattttctccctcaaagacactccaaagcgtaaatcttggcctctgaacgagggggtaatggctgtgggacttgttagcatcctggcctcaagtttgctcagaaacgatgtgcccatggcaggcccactggtcgccggtgggctactgattgcttgttatgtgatcaccggaacgtccgcagaccttacagtagagaaggccgcggacgtgacctgggaagaggaagctgagcagactggcgtctctcataatctcatgataacagttgatgacgatggcaccatgaggattaaagacgatgaaactgagaacatcctgacagtgttgttaaagaccgccctgctcatcgtgagcgggatttttccgtactccatacctgcaacgctgcttgtctggcacacttggcagaaacagacccaacgctcaggagtgctgtgggacgttcccagcccacccgagacacagaaggccgaattggaggaaggtgtataccggatcaagcagcagggcattttcgggaaaacccaagtgggagtcggcgtgcagaaggagggtgtttttcatacaatgtggcacgtgactagaggggctgtcctaacccacaatggaaaaaggctggagcctaactgggccagtgtgaagaaagatctcatctcttatggcggcgggtggcgactgtccgcacagtggcaaaagggagaagaggtacaggtcattgctgtggaaccaggtaagaatcccaaaaacttccagacgatgcctggcatcttccagacaactaccggggagataggagccatcgcgcttgactttaagccgggcacaagcggttcgccaattatcaatcgcgaagggaaagttgtgggattatacggcaacggcgtcgtgaccaagaatgggggatatgtttcaggtattgcccaaactaacgcagagcccgatggccctaccccagagctggaagaggaaatgttcaaaaagcggaatctcacaatcatggacttgcatcccgggtctggaaagacgagaaaatacctgcctgctatagtgagggaggccattaagcgtcgcctccggactctgatccttgctccgaccagagtcgtggcagccgaaatggaggaggccctgaaaggcttgcccatcaggtatcagacaaccgctactaagagtgaacacacaggtcgagagattgtagatctaatgtgccatgcgacctttacgatgcggctgctctccccagtgcgcgttcctaactacaatttaatcataatggacgaagcacacttcactgatcccgccagcattgctgccagagggtatatctctacaagggtcggaatgggcgaggcagccgctatttttatgaccgcgaccccacctggcactgccgaagcattcccccagagcaacgctccaatccaggacgaggagcgggacataccggaacgatcctggaattcagggaacgagtggattacagattttgtgggaaaaaccgtgtggttcgtccctagtatcaaggccggtaacgacatcgcaaattgtctgagaaagaacggcaaaaaggtaattcaacttagccgcaaaacatttgatactgaataccagaagacgaggctgaatgactgggatttcgtggttaccacagacatctctgagatgggggccaactttaaagctgatcgtgtgattgacccccggagatgcctcaagccagtcatattgactgatggacccgagagggtgatcctggccggccctatgccagttaccgcggcatccgccgctcagcgccgaggtagagtggggcggaatccccagaaggaaaacgaccaatacattttcacaggccagcctctcaataacgatgaggaccatgcccactggaccgaagctaaaatgctgcttgacaatatcaacactccggagggaatcattccagcactattcgaacccgagagggagaagtcagccgctatagatggcgaatatcgcctgaaaggggagagtcgtaagacgtttgtcgaattgatgagacggggagacttacctgtgtggctggcccacaaagtagcaagcgagggtatcaagtacaccgataggaaatggtgcttcgacggcgaacgcaataaccagattctcgaggagaatatggatgtggaaatctggacaaaggagggggaacgaaagaaactgagaccccggtggcttgacgcgaggacttattccgatccactggccctcaaggagtttaaagacttcgctgccggacgcaagtctattgcattggatctggttaccgaaatcggcagagtcccttcgcatctagctcacaggacacggaacgccctggacaatctcgtgatgcttcataccagcgagcacggtgggcgtgcataccgccacgccgtggaggaactgcccgagactatggaaacattattgctgctcggcctgatgatacttctgacgggaggcgctatgctctttttgatctcagggaaaggaattggtaagacctccatcggcctgatttgtgtcatcgttagttctgggatgttatggatggcggatgtgccactacagtggatagccagcgcaattgtactggagttctttatgatggtgctccttatccctgagccggaaaagcaacgaactccccaggacaaccagctggcttatgtcgtgattggaatcttgacactggccgccatagttgcagctaatgagatgggcctcctggaaaccaccaaaagagatcttggtatgtccaaggagccaggggtggtctcacctacatcttacctcgacgtagacctgcatcccgccagcgcgtggactttgtatgctgtggccacgaccgttatcacaccaatgctgaggcacactattgaaaacagtaccgcaaacgtgtccttagccgctatcgcaaatcaagccgtcgtgctaatgggcctggataaaggatggcctattagcaagatggacctcggcgtcccccttctggcgttggggtgctactctcaggtgaacccgctgacactcaccgctgccgttctgcttttagtgactcattacgcaatcataggaccaggcctgcaggccaaagctacgcgggaggcccagaagcgcacagcagctggtattatgaagaatcctaccgtagatgggatcatgactatcgacctcgatcccgtgatttatgactcaaaattcgagaagcaattgggacaggtcatgctgctagttctgtgtgccgtgcagctccttctgatgagaacctcctgggcgttgtgcgaagccctgacactcgcaactggcccaatcaccacactgtgggagggtagtcccggcaaattttggaacacgaccatagctgtcagcatggccaatattttcagggggtcgtacttagcaggagctggccttgccttttctatcatgaagtccgtggggactggacggcgaggcacaggtagccagggggaaaccctgggagagaaatggaagaagaaactcaaccaactatcaagaaaggaattcgatctgtataaaaagagtggcattactgaggtagaccgcacagaggccaaagaaggtttgaagaggggcgagaccacgcaccatgcggtgtctcgggggtccgctaaactgcagtggtttgttgaacgtaatatggtgatccctgagggaagagtcatagatctcggctgtgggaggggaggctggagctactattgcgcaggtcttaagaaggtgaccgaagtccgcgggtacacaaaaggaggcccgggccacgaggagcccgtgccaatgtcaacttatgggtggaacatcgttaagctgatgagtggaaaagacgtattctacttgcctcccgaaaagtgtgataccctgctctgcgacattggtgagagctccccttctccaacagtggaagagagccggactatccgagtcttaaaaatggtggagccctggctgagaaataaccagttctgtattaaggttcttaatccttacatgccaaacgtgatcgaacacctggagaggctacagcgcaagtatggcgggatgctcgtccggaatcccctgtccagaaactcaacccatgaaatgtactggatttctaatggaacaggcaacatcgtgagttcggtaaacatggtgagccgtttgctgctcaataggtttaccatgactcaccggcgcccgacgatagagaaagatgttgaccttggtgccgggacacgacatgtcaacgctgaacctgagaccccaaatatggacgtgattggagagagaatcaagaggatcaaagaagagcactcctctacttggcactatgatgacgaaaacccctacaagacctgggcctatcatggctcatacgaggtgaaagcaacaggcagcgcctccagtatgattaatggggtcgttaagctgttaacgaagccttgggatgtggtaccaatggtgacccaaatggctatgactgacacaacccccttcggacagcagcgggtctttaaagaaaaggtggatactcgcacaccgagacctatgcccggtaccaggaaagttatggagataacagcggagtggctgtggcgaactttgggccggaacaagaaaccacgtctctgcaccagagaagagttcacgaagaaggtgcgcaccaatgccgcaatgggggctgtctttacagaagagaaccaatgggactctgccagggcagccgtggaagatgaggagttctggaaactggtagacaaggaacgggagctacacaaacttggaaagtgtggcagctgcgtttataatatgatgggtaaaagagaaaagaaactgggggagtttggaaaggctaagggctcacgcgccatctggtacatgtggctcggcgcgaggtacctggagttcgaagcattggggtttctgaacgaggatcattggttctcccgagaaaatagttatagcggagtggagggtgaaggcctccacaaacttgggtacattctgcgggacatctctaagattcctggaggcgccatgtatgctgatgacactgccggttgggacaccagaatcacagaggatgacttacataacgaggaaaaaataactcagcagatggatcccgagcacaggcagctggcaaatgctatctttaagttgacctaccaaaacaaagtcgtgaaggtgcagcgcccaacgcccaaggggacagtcatggacattatctcccgtaaagatcagcggggatcaggccaggttggcacctatgggctcaatactttcacaaacatggaagcccaactggtgagacagatggagggagaaggtgtactaagcgaggctgaccttgagaaccctcacctgctcgaaaagaaaattacccagtggctggagactaagggcgtggaaaggttgaaacgcatggccatctcgggggatgactgcgtcgtgaagccaatagatgaccgatttgcaaatgcgttactggccctcaacgatatgggaaaggttcggaaagacattccgcagtggcaaccctctaagggctggcatgattggcagcaggtgcctttctgtagtcaccatttccacgagcttatcatgaaagacggtagaaagctggtcgtgccatgcaggccccaggacgaactaatcgggcgcgctagaatttcccaaggagccggctggagcctgaaagagaccgcatgtctcggcaaggcttacgcccagatgtggtcattgatgtattttcaccggagggatctgcgtcttgcatccaatgccatatgctctgcggtacctgttcattggatcccaacaagccgaacgacctggagtattcacgctcatcaccagtggatgactacagaggacatgctgaccgtgtggaaccgcgtctggatcgaagataatccctggatggaggacaagactcctgtgacaacctgggaagatgttccgtacctcgggaaaagagaggaccaatggtgtggatccttaattggtctgacgagccgggccacatgggcacagaacatcttgaccgccatacagcaggtgaggtctctgatcggcgatgaggaattcctcgactacatgccatcaatgaagcgctttagaaaagaggaagagagtgaaggggctatttggtga

SEQ ID NO: 15225 - RNA, 9873 nt, synthetic construct
  misc_feature 1..9873: note = derived and/or modified CDS sequence (opt3) from DENV-3__KF955461__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctactctcccagaggaacaggaccagaattatgtctgtaaacacacctacgttgatcgcggttgggggaacggatgcggcctgttcggcaaggggagtttagtgacatgcgccaagtttcaatgtctggagcccatcgagggaaaagtagtgcagtatgaaaatctcaagtacactgtcataattaccgtgcacacaggtgaccagcatcaggttggcaacgacacccaaggggtgactgtcgagatcacgcctcaggcatccacagtggaagctgtacttccagagtatggaaccctgggcttggaatgctctccgcgaactggtctagatttcaatgagatgattctgctcaccatgaaaaacaaggcctggatggttcacagacagtggtttttcgacctgccccttccttggacaagcggggcgaccactgagacaccaacgtggaataggaaagaactgttggtgacctttaagaacgcccatgcaaaaaagcaagaggtcgtggtcctcggctcccaggaaggagctatgcacactgccctgacaggcgctaccgagatccagaattcagggggaacaagtatcttcgccggtcacttaaagtgtcggctgaaaatggataagctagaactcaaaggcatgagctacgcaatgtgcctgaacacttttgtgcttaagaaagaggtttctgagacccagcatgggacgattttgataaaggtggaatacaagggagaggacgccccctgtaaaatccctttctccaccgaagatggccaaggtaaggctcacaacgggcgtctgattacagcgaatccagtagtcactaaaaaggaggagcccgtgaacatcgaagcagagccgcctttcggcgaatcaaatatagttattggaatcggcgacaaagccctcaagatcaactggtataagaaagggagcagtattggaaagatgtttgaggctaccgcccgcggtgcaagaaggatggccatcctgggcgatacagcttgggacttcgggtctgtgggaggcgtccttaattccctgggtaaaatggtgcatcaggtatttgggagcgcctacactgcattgttctcgggcgtgtcttggattatgaagataggaatcggcgttctcctgacctggattgggttaaactccaaaaatacgtcaatgagttttagctgcatcgtcatcggaattataacactgtatctaggcgcggtggtgcaggctgatatgggttgtgtcatcaactggaaggggaaggaactcaaatgcggatccggcattttcgttaccaatgaggtgcacacttggacagagcagtacaagtttcaagccgactctcccaaacggctggcaaccgccatcgctggtgcctgggaaaacggcgtgtgtgggattcgaagcactacccgcatggagaatcttttgtggaagcagatcgcaaacgaactgaattatatactctgggagaacaatatcaaactgacagtagtcgtgggagatattatcggcgttttagaacaggggaagagaacgctgaccccacagcctatggagcttaaatactcatggaagacttggggaaaggctaaaattgtgacagccgagacccaaaacagttccttcatcatagacggccccaacacaccagaatgccccagcgcgtctagggcctggaatgtctgggaggtggaagactatggttttggggttttcactaccaacatttggttgaagctccgggaggtgtacacgcagtcatgtgatcatcgcctgatgagtgctgcaatcaaagacgaaagagccgtacacgctgatatgggatactggattgagagccagaagaatggctcctggaaactagagaaggcctcttttatcgaagtcaagacatgcacctggcctaaatcgcacactctgtggagcaacggtgtgctcgagtccgacatgataatcccaaagtcactggcaggcccgattagtcagcataatcacaggcccgggtatcatacccaaacagcgggaccttggcaccttggcaaattggaactggatttcaactactgcgaggggactaccgtggccatcacagagaattgtggaacgcgtggcccatctttacggaccactacagtcagcggtaagctcattcacgaatggtgctgtcgatcctgcaccctgccccctcttagatatatgggggaggacggatgttggtacggcatggaaatcaggccaataaacgagaaagaagagaatatggttaagtcactggtgagcgctggttctggcaaggtagataactttactatgggggtgttgtgcctcgccattctgttcgaggaagtcatgcgcggaaaattcggcaagaaacatatgatcgcaggggtgctatttacattcgttctgctcctgtccggacagatcacctggcgggacatggctcacacgcttattatgatcggcagtaatgccagcgatagaatgggtatgggggtgacttatttggcactgattgccacctttaagatacagcccttcttagctctcggatttttcctgaggaaacttacatctcgcgagaacctgctactcggcgtcggcctggcgatggccaccactttgcaactgccggaagacatcgagcagatggcaaatgggattgctttaggactcatgacactgaagcttatcacccagtttgaaacataccagctgtggactgccttggtgtccctcacctgttcaaacacgattttcacactgaccgttgcctggcgaactgctaccctaatcctggcaggtgtgagtcttctccctctgtgccaaagctcgtccatgcggaagacagattggttgccaatgactgtcgccgcgatgggcgtaccccctctgcccttatttatattctctctcaaagacaccccaaagcgtagaagctggcctctgaatgagggggtgatggctgttggacttgtgtcaatcctggccagttccttgctcaggaacgatgtccccatggcaggcccactggtggccggtgggctactgattgcttgttatgtaatcacgggaacatctgcagaccttaccgtggagaaagccgcggacgtcacttgggaagaggaagctgagcagacaggcgttagccataacctcatgattaccgtggatgacgatggcactatgcgcatcaaggacgatgaaacagagaatatactgaccgtgttgttaaaaacggccctgctcattgtctccgggatctttccgtactcaatccctgcaactctgcttgtgtggcacacctggcagaagcagacacaacggagcggagttctgtgggacgtacccagtccacccgagacccagaaagccgaattggaggaaggtgtgtacagaattaagcagcagggcatattcgggaagacacaagtcggagtgggcgttcagaaagagggtgtgtttcatactatgtggcacgtcaccaggggggctgtgctaacgcacaacggaaagcgactggagcctaattgggcctctgtaaaaaaggatctcatctcctatggcggcgggtggcgcctgagcgcacagtggcaaaaaggagaagaggtccaggtgattgctgttgaaccaggtaagaaccccaagaatttccagacaatgcctggcatcttccagactaccacaggggagattggagccatcgcgcttgactttaaaccgggcacctcgggttcaccaataatcaaccgggaagggaaggtggtcggattatacggcaatggcgtggttactaaaaacgggggatatgtgtctggtattgcccaaaccaatgcagagcccgatggccctacaccagagctggaagaggaaatgttcaagaaaagaaacctcacgatcatggacttgcatcccgggagtggaaagactaggaagtacctgcctgctattgtccgtgaggccatcaaacgccggctcagaaccctgatacttgctccgacaagggtggtagcagccgaaatggaggaggccctgaagggcttgcccattcgatatcagaccactgctacaaaatccgaacacaccggtcgggagatcgtggatctaatgtgccatgcgacgtttactatgcgcctgctcagcccagttagagtccctaattacaacttagtgatcatggacgaagcacacttcacagatcccgcctctattgctgccagggggtatatcagcacccgggtgggaatgggcgaggcagccgctatatttatgaccgcgactccacctggcacagccgaagcattcccccagtccaatgctccaattcaggacgaggagcgagacatcccggaaagatcatggaacagtgggaatgagtggattaccgattttgtcggaaagacagtatggttcgtgcctagcatcaaagccggtaacgacatagcaaactgtctgcgcaagaatggcaagaaagttattcaactttctaggaagacttttgatacggaataccagaaaacccgtctgaacgactgggatttcgtggtcacaactgacatctccgagatgggggccaattttaaggctgatcgggtgatcgaccccagaaggtgcctcaaaccagttattttgaccgatggacccgagcgcgtgatcctggccggccctatgccagtcacagcggcatcagccgctcagcgaagaggtcgggtggggaggaacccccagaaggaaaatgaccaatacattttcaccggccagcctctcaacaatgatgaggaccatgcccactggactgaagctaagatgctgcttgacaacataaatacgccggagggaatcattccagcactattcgaacccgagcgcgagaaaagtgccgctatcgatggcgaatatcgtctgaagggggagagcagaaaaacctttgtagaattgatgcggaggggagacttacctgtgtggctggcccacaaggttgcatccgagggtatcaaatacacagatcgcaagtggtgcttcgacggcgaacgaaacaatcagattctcgaggagaacatggatgtcgaaatatggactaaagagggggaaagaaagaagctgcggcccaggtggcttgacgcgcgcacctattctgatccactggccctcaaagagtttaaggacttcgctgccggaagaaaatcgatcgcattggatctggtgacagaaattggcagggtgcctagccatctagctcaccggacccgtaatgccctggacaacctcgtcatgcttcatacttcagagcacggtgggcgcgcataccgacacgccgttgaggaactgcccgagacaatggaaacgttattgctgctcggcctgatgatccttctgaccggaggcgctatgctctttttgatttccgggaagggaatcggtaaaactagtataggcctgatctgtgtgattgtatctagcgggatgttatggatggcggatgtgccactacagtggatcgcctccgcaattgtcctggagttctttatgatggtgctccttatccctgagccggaaaagcaaagaacaccccaggacaatcagctggcttatgttgtgataggaattttgaccctggccgccatcgtcgcagctaacgagatgggcctcctggaaaccacaaagagggatcttggtatgtcaaaagagccaggggtagtgtctcctactagctacctcgacgttgacctgcatcccgccagtgcgtggacgttgtatgctgtggccaccacagtcattactccaatgctgcggcacaccatcgaaaattccacagcaaacgtgagcttagccgctatagcaaaccaagccgtcgtgctaatgggcctggataagggatggcctatctctaaaatggacctcggcgttccccttctggcgttggggtgctactcacaggtgaatccgctgaccctcactgctgccgtactgcttttagtgacgcattacgcaattatcggaccaggcctgcaggccaaggctacacgcgaggcccagaaaagaaccgcagctggtattatgaagaaccctactgtcgatgggatcatgaccatagacctcgatcccgttatttatgactccaagttcgagaaacaattgggacaggtgatgctgctagtcctgtgtgccgtgcagctccttctgatgaggacaagttgggcgttgtgcgaagccctgactctcgcaaccggcccaatcacaacgctgtgggagggtagccccggcaagttttggaataccactatcgctgtatcgatggccaacattttccgggggtcttacttagcaggagctggccttgccttttccatcatgaaaagcgtggggacaggacgaagaggcaccggttcacagggggaaactctgggagagaagtggaaaaagaagctcaatcaactaagtcgcaaagaattcgatctgtataagaaatctggcataacagaggttgacaggaccgaggccaaggaaggtttgaaacggggcgagacgacccaccatgcggtgtcccgtgggagcgctaagctgcagtggtttgtcgaaagaaacatggtgattcctgagggaagggtcatcgatctcggctgtgggcgcggaggctggtcatactattgcgcaggtcttaaaaaggtgacagaagttcgggggtacactaagggaggcccgggccacgaggagcccgtaccaatgagtacctatgggtggaatattgtgaaactgatgagcggaaaggacgtcttctacttgcctcccgaaaaatgtgatacactgctctgcgacatcggtgagtcctctcctagcccaactgtggaagagtcccgaaccataagagttttaaagatggtggagccctggctgaaaaacaatcagttctgtatcaaggtccttaacccttacatgccaacagtgattgaacacctggagaggctacagcgcaagtatggcgggatgctcgtacggaatcccctgtcaagaaactctacccatgaaatgtactggatcagtaatggaactggcaacattgtgtcgagcgttaatatggtctcccgtttgctgctcaacaggtttacgatgacacaccggcgcccgaccatcgagaaagatgtggaccttggtgccgggactcgacatgtgaacgctgaacctgagaccccaaatatggacgtcattggagagagaatcaagaggataaaagaagagcactcttcaacatggcactatgatgacgaaaacccctacaagacgtgggcctatcatggcagctacgaggttaaagcaaccggctccgccagttctatgattaatggggtggtaaagctgttaactaagccttgggatgtggtcccaatggtgacacaaatggctatgaccgacactacacccttcggacagcagcgggtttttaaagaaaaggtggatacccgcacaccgagacctatgcccggtactaggaaagtcatggagatcaccgcggagtggctgtggcgaacgttgggccggaacaagaaaccacgtctctgcaccagagaagagttcacaaagaaggtgcgcactaatgccgcaatgggggctgtatttaccgaagagaaccaatgggacagcgccagggcagccgttgaagatgaggagttctggaaactggtggaccgggaaagagagctacacaagcttggaaaatgtggctcatgcgtctataatatgatgggtaagcgcgaaaaaaagctgggggagtttggaaaagctaagggctccagggccatctggtacatgtggctcggcgcgcgatacctggagttcgaagcattggggtttctgaacgaggatcattggttcagtcgggaaaatagctattctggagtggagggtgaaggcctccacaagcttgggtacattctgagagacatatccaaaatccctggaggcgccatgtatgctgatgacacagccggttgggacactaggattaccgaggatgacttacataacgaggaaaagatcacgcagcagatggatcccgagcaccgccagctggcaaatgctatttttaaattgacataccaaaacaaggtggtcaaagttcagcgtccaacccccaaggggactgtgatggacatcatatcacggaaggatcagagaggaagcggccaggtaggcacatatgggctcaataccttcactaacatggaagcccaactggtgaggcagatggagggagaaggtgtcctatcgaaagctgaccttgagaatcctcaccagctggagaagaaaatcacccagtggctcgaaacaaagggcgtggagcgcctgaaacgaatggccatttctggggatgactgcgttgtgaagccaatcgatgaccggtttgcaaacgcgttgttagccctgaacgatatgggaaaggtcagaaaagacattccgcaatggcagcccagtaagggctggcatgattggcagcaggtgcctttctgttcccaccatttccacgaactcatcatgaaagacggtaggaagcttgtagttccatgccgcccccaagacgagctgatagggagagctcggattagccagggagccggctggtcactaaaagaaacggcatgtctgggcaaggcttacgcccagatgtggtccctcatgtattttcacaggcgtgatttgcgactggcatctaatgccatctgcagcgcggtgcctgtccattggatcccaaccagtcgcactacatggtccattcacgctcatcaccaatggatgaccactgaggacatgcttacagtgtggaacagagtttggatagaggataatccctggatggaagacaagacccctgtgacgacatgggaggatgtcccgtacctggggaaacgggaagaccagtggtgtggaagcctcatcggtttaacctctagggccacttgggcacagaacattctgaccgccatccagcaagtgcgctcattgattggcgatgaggagttcctggactacatgccaagtatgaagagatttcggaaagaagaggaatccgagggggctatctggtga

SEQ ID NO: 15226 - RNA, 9873 nt, synthetic construct
  misc_feature 1..9873: note = derived and/or modified CDS sequence (opt3) from DENV-3__FJ639719__SS-prME
  source 1..9873: mol_type = other RNA
accagcctgtgcctcatgatgatgcttcccgcaacactggctttccacttgacttccagagacggcgaacctaggatgatcgtggggaagaacgaacggggaaaatctttactgtttaagacggcaaccggtattaatatgtgtacactaatagccatggatctcggcgagatgtgcgacgatactgtaacctacaaatgtccactgatcgcggaagttgagccggaagacattgattgctggtgtaaccttacatcaacctgggtgacttatgggacatgcaatcaggctggagagcatcgccgagacaagcgtagtgtagccctggcaccccacgtgggcatgggtttggataccagaacgcagacttggatgagcgccgagggggcttggaggcaggtcgaaaaagtggagacctgggcactccggcatcctggattcacaatcctggccctgtttctcgctcactacattggcacttccttaatccagaaggttgtgatattcatcctgcttatgttggtcaccccatctatgacaatgcgctgtgtgggcgtagggaacagagactttgttgaaggactgtcgggtgccacctgggtggatgtcgtgctagagcatggcgggtgcgtgacgactatggcgaagaataaacccacactcgacattgagctgcagaagaccgaagcaactcagcttgccacactgaggaaattgtgtatcgagggaaagattaccaacatcacgaccgattcacggtgccctacacagggcgaagctatactcccagaggaacaggaccagaattatgtctgtaaacacacttacgttgatcgcggttgggggaacggatgcggcctgttcggcaaggggagcttagtgacctgcgccaagtttcaatgtctggagcccattgagggaaaagtagtgcagtatgaaaatctcaagtacacagtcatcattactgtgcacaccggtgaccagcatcaggttggcaacgacacacaaggggtgaccgtcgagatcactcctcaggcaagtacggtggaagctgtacttccagagtatggaacactgggcttggaatgctccccgcgaaccggtctagatttcaatgagatgatcctgctcactatgaaaaacaaggcctggatggttcacagacagtggtttttcgacctgccccttccttggacctctggggcgacaaccgagactccaacatggaataggaaagaactgttggtgacgtttaagaacgcccatgccaagaagcaagaggtcgtggtcctcggcagccaggaaggagctatgcacaccgccctgactggcgctacagagattcaaaattccgggggaacctcaatattcgccggtcacttaaagtgtcggctgaaaatggataagctagaactcaaaggcatgagttacgcaatgtgcctgaacacatttgtgcttaagaaagaggttagcgagactcagcatgggaccatcttgattaaggtggaatacaagggagaggacgccccctgtaaaatccctttctctacggaagatggccaaggtaaggctcacaacgggcgtctgataaccgcgaatccagtagtcaccaagaaggaggagcccgtgaacattgaagcagagccgcctttcggcgaatccaatatcgttatcggaattggcgacaaagccctcaagatcaactggtataagaaagggtcaagcattggaaagatgtttgaggctactgcccgcggtgcaagaaggatggccatactgggcgataccgcttgggacttcgggagtgtgggaggcgtccttaattctctgggtaaaatggtgcatcagatctttgggtccgcctacacagcattgttcagcggcgtatcgtggattatgaagatcggaatcggcgtgctcctgacttggattgggttaaactctaaaaatacctccatgtcatttagttgcatagttatcggaattatcacgctgtatctaggcgcggtcgtgcaggctgatatgggttgtgtgattaactggaaggggaaggaactcaaatgcggaagcggcatcttcgtcacaaatgaggttcacacctggactgagcagtacaagtttcaagccgactcccccaaacggctggcaacagccatagctggtgcctgggaaaacggcgtgtgtgggatccgatctaccactcgcatggagaatcttttgtggaagcagattgcaaacgaactgaattatatcctctgggagaacaatattaaactgaccgtggtagtcggagatatcataggcgtgttagaacaggggaagagaacactgacgccacagcctatggagcttaaatacagctggaagacctggggaaaggctaaaattgttactgccgagacacaaaactcaagtttcatcattgacggccccaacaccccagaatgcccctccgcgagcagggcctggaatgtgtgggaggtcgaagactatggttttggggtgttcacaactaacatctggttgaagctccgggaggtttacacccagtcttgtgatcatcgcctgatgtcagctgcaataaaagacgaaagagccgtgcacgctgatatgggatactggatcgagagtcagaagaatggcagctggaaactagagaaggcctcctttattgaagtaaagacgtgcacatggcctaaatctcacaccctgtggtcgaacggtgtcctcgagagcgacatgatcattccaaagtccctggcaggcccgatctcacagcataatcacaggcccgggtatcatactcaaaccgcgggaccttggcaccttggcaaattggaactggatttcaactactgcgaggggacaactgtggtgataaccgagaattgtggaacacgtggcccaagtttacggacgaccactgtctctggtaagctcattcacgaatggtgctgtcgaagctgcacactgccccctcttagatatatgggggaggacggatgttggtacggcatggaaatcaggccaatcaacgagaaagaagagaatatggttaagtccctggtgtcagccggtagcggcaaggtagataactttaccatgggggtgttgtgcctcgctattctgttcgaggaagtcatgcgcggaaaattcggcaagaaacatatgatcgccggggtgctatttactttcgttctgctcctgtctggacagattacatggcgggacatggcacacacccttataatgatcggctccaatgctagtgatagaatgggtatgggggtgacgcatttggccctgattgcaacttttaagatccagcccttcttagccctcggatttttcctgaggaaacttaccagccgcgagaacctgctactcggcgtcggcctggctatggcgacaaccttgcaactgccggaagacattgagcagatggccaatgggatcgcattaggactcatgactctgaaacttataacacagtttgaaacctatcagctgtggacagctttggtgtctctcacttgttccaacaccatcttcacgctgacagttgcctggcgaaccgccactctaattctggctggtgtgtcacttctccctctgtgccaaagtagctcgatgcggaagaccgattggttgccaatgacagtcgcagccatgggcgtaccccctctgcccttatttatcttctccctcaaagacactccaaagcgtagatcttggcctctgaatgagggggtgatggcggttggacttgtgagcattctggcttcaagtttgctcaggaacgatgtccccatggccggcccactggtggccggtgggctactgatcgcctgttacgtaataaccggaacgtccgctgaccttacagtggagaaagcagccgacgtcacctgggaagaggaagcggagcagactggcgtttctcacaacctcatgattacagtggatgacgatggcaccatgcgcatcaaggacgatgaaactgagaatatcctgacagtgttgttaaaaaccgctctgctcattgtcagcgggatatttccgtattccatccctgccacgctgcttgtgtggcatacttggcagaagcagacccaacggtcaggagttctgtgggacgtacccagcccacccgagacacagaaagcagaattggaggaaggtgtgtacagaattaagcagcagggcatcttcgggaagacccaagtcggagtgggcgttcagaaagagggtgtgtttcacacaatgtggcacgtcactcgaggggcagtgctaacccataacggaaagaggctggagcctaattgggctagtgtcaagaaggatctcatttcttacggcggcgggtggcgcctgtccacgcagtggcaaaaaggagaagaggtccaggtgatcgccgttgaaccaggtaagaaccccaagaatttccagacaatgcctggcatattccagactaccacaggggagatcggagcaattgctcttgactttaaaccgggcaccagcggttcgccaatcattaaccgggaagggaaggtggtcggattatatggcaatggcgtggttactaaaaacgggggatacgtgtcaggtatcgcccaaaccaatgcggagcccgatggccctacaccagagctggaagaggaaatgttcaagaaaagaaacctcacgataatggacttgcaccccgggtctggaaagactaggaagtatctgcctgccattgtccgtgaggcaatcaaacgccggctcagaaccctgatccttgctccgacaagggtggtagccgctgaaatggaggaggcactgaagggcttgcccattcgataccagaccactgccacaaaaagtgaacataccggtcgggagatcgtggatctaatgtgccacgccacgtttactatgcgcctgctctccccagttagagtccctaattataacttaataattatggacgaagctcatttcacagatcccgcgagcatcgcagccagggggtacatttctacccgggtgggaatgggcgaggctgccgcaatctttatgaccgccactccacctggcacagctgaagcgttcccccagagcaatgccccaatacaggacgaggagcgagacattccggaaagatcctggaactcagggaatgagtggatcaccgattttgtgggaaagacagtctggttcgtacctagtatcaaagcaggtaacgacattgctaactgtctgcgcaagaatggcaagaaagtgatccaacttagcaggaagacttttgatacggaatatcagaaaacccgtctgaacgactgggatttcgttgtgacaactgacatttctgagatgggggccaattttaaggcagatcgggtcatagaccccagaaggtgcctcaaaccagtgatcttgaccgatggacccgagcgcgttattctggccggccctatgccagtgacagctgcctccgcggcacagcgaagaggtcgggtcgggaggaacccccagaaggaaaatgaccaatacatcttcaccggccagcctctcaacaatgatgaggaccacgcccactggactgaagctaagatgctgcttgacaacatcaatacgccggagggaattataccagccctattcgaacccgagcgcgagaaatcagctgcaatcgatggcgaataccgtctgaagggggagagtagaaaaacctttgtggaattgatgcggaggggagacttacctgtatggctggcccataaggtggctagcgagggtattaaatatacagatcgcaagtggtgcttcgacggcgaacgaaacaatcagatcctcgaggagaacatggatgttgaaatttggactaaagagggggaaagaaagaagctgcggcccaggtggcttgacgcccgcacctactccgatccactggcactcaaagagtttaaggacttcgcggccggaagaaaatctatcgctttggatctggtcacagaaataggcagggtgccttcgcacctagcccatcggacccgtaatgcactggacaacctcgtgatgcttcacactagcgagcacggtgggcgcgcttatcgacatgccgtcgaggaactgcccgagacaatggaaacgttattgctgctcggcctgatgatccttctgaccggaggcgcaatgctctttttggtttcagggaagggaattggtaaaactacaatcggcctgatttgtgtgatcgtatccagtgggatgttatggatggccgatataccactacagtggattgcttctgcgatcgtgctggagttctttatgatggtcctccttattcctgagccggaaaagcaaagaacaccccaggacaatcagctggcctacgtggttatcggaatattgaccctggcagctatcgtggccgccaacgagatgggcctcctggaaacaactaagagggatcttggtatgagcaaagagccaggggtcgtatcccctacgtcatatctcgacgtggacctgcaccccgcatctgcttggaccttgtacgccgttgcgacaactgtgattaccccaatgctgcggcatacaatcgaaaatagcaccgctaacgtcagtttagccgcaattgccaaccaagctgtggtcctaatgggcctggataagggatggcctatctccaaaatggacctcggcgtgccccttctggcattggggtgctatagccaggttaatccgctgactctcacggccgcggtgctgcttttagtaacacactacgctataattggaccaggcctgcaggccaaggcaacccgcgaggcccagaaaagaactgctgccggtatcatgaagaaccctaccgtggatgggatcatgacaattgacctcgatcccgtcatctacgactctaagttcgagaaacaattgggacaggttatgctgctagtgctgtgtgcagtccagctccttctgatgaggacttcatgggctttgtgcgaagccctgaccctcgcgacaggcccaataacgaccctgtgggagggttcccccggcaagttttggaatactacaattgccgtgagtatggcaaacatcttccgggggagctatttagctggagccggccttgcattttcgattatgaaatctgtagggaccggacgaagaggcactggttcccagggggaaacactgggagagaagtggaaaaagaagctcaatcaactaagccgcaaagagttcgatctgtacaagaaatcaggcatcaccgaggtggacaggacggaggctaaggaaggtttgaaacggggcgagaccacacatcacgccgttagtcgtgggtctgccaagctgcagtggtttgtggaaagaaacatggtcatacctgagggaagggtgatcgatctcggctgtgggcgcggaggctggtcctattactgcgcgggtcttaaaaaggtcactgaagtgcgggggtataccaagggaggcccgggccacgaggagcccgttccaatgagcacatacgggtggaatattgtaaaactgatgtcaggaaaggacgtgttctatttgcctcccgaaaaatgtgatactctgctctgcgacatcggtgagagtagcccttccccaaccgtcgaagagtctcgaacaattagagtgttaaagatggttgagccctggctgaaaaacaatcagttctgtatcaaggtgcttaacccttacatgccaaccgtcattgaacatctggagaggctacagcgcaagtacggcgggatgctcgtgcggaatcccctgagcagaaactccactcacgaaatgtattggatctcaaatggaacgggcaacatagtatctagtgtgaatatggtttcgcgtttgctgctcaacaggtttacaatgacccatcggcgcccgactattgagaaagatgtcgaccttggtgctgggacccgacacgtgaacgcagaacctgagacaccaaatatggacgtgatcggagagagaatcaagaggattaaagaagaacacagctccacgtggcattacgatgacgaaaacccctataagacctgggcctaccacggctcttatgaggtcaaagctactggctcagccagctccatgataaatggggttgtgaagctgttaacaaagccttgggatgtagtgccaatggtcacccaaatggcaatgactgacacaacccccttcggacagcagcgggtgtttaaagaaaaggttgatacacgcactccgagacctatgcccggtaccaggaaagtgatggagatcacggccgagtggctgtggcgaaccttgggccggaacaagaaaccacgtctctgcacaagagaagagttcactaagaaggtccgcaccaatgctgcgatgggggccgtgtttacagaagagaaccaatgggacagtgcaagggctgccgtagaagatgaggagttctggaaactggttgaccgggaaagagagctacataaacttggaaaatgtggctcttgcgtgtacaatatgatgggtaagcgcgagaaaaagctgggggagtttggaaaagcaaagggcagcagggccatttggtatatgtggctcggcgctcgattcctggagtttgaagccttggggttcctgaacgaggatcactggttttcacgggaaaattcctacagtggagtcgagggtgaaggcctccataaacttgggtacatcctgagagacattagcaaaatccctggaggcgcgatgtatgcagatgacactgccggttgggacaccaggataacggaggatgacttacacaacgaggaaaagatcacacagcagatggatcccgagcaccgccagctggctaatgccattttcaaattgacctaccaaaacaaggtggtgaaagtccagcgtccaactcccaaggggacagttatggacatcatttctcggaaggatcagagaggatccggccaggtgggcacctatgggctcaatacttttaccaacatggaagcacaactggtaaggcagatggagggagaaggtgtgctatcaaaagctgaccttgagaatcctcatctgctcgagaagaaaatcacacagtggctggaaaacaagggcgtcgagcgcttgaaacgaatggccataagcggggatgactgcgtggttaagccaattgatgaccggttcgctaacgccttactggcactcaatgatatgggaaaggtgagaaaagacatcccgcagtggcaaccctcgaagggctggcacgattggcagcaggtccctttctgttctcatcactttcacgaacttatcatgaaagacggtaggaagctggtggtaccatgccgcccccaggacgagctaattgggagagcgcggataagtcaaggagccggctggtccctgaaagaaacggcttgtctcggcaaggcctacgcacagatgtggagcttgatgtatttccataggcgtgatctgcgacttgcttcaaacgccatctgctccgcagttcctgtgcactgggtcccaacctctcgcactacatggagcattcatgcccaccatcagtggatgaccactgaggacatgctgacagtgtggaatagagtttggatcgaggataacccctggatggaagacaagacccctgtgacgacatgggaggatgtcccgtacctcgggaaacgggaagaccaatggtgtggaagtttaattggtctgacctccagggcgacttgggctcagaatatcttgaccgccatacaacaggtgcgcagcctgatcggcgatgaggagtttctcgactatatgccatctatgaagagattccggaaagaagaggaatcagagggggcaatttggtga

SEQ ID NO: 15227 - RNA, 9873 nt, synthetic construct
  misc_feature 1..9873: note = derived and/or modified CDS sequence (opt3) from DENV-3__KF955332__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcaaccggtattaatatgtgtacactaatagccatggatctcggcgagatgtgcgacgatactgtcacctacaaatgtccactgatcgcggaagttgagccggaagacattgattgctggtgtaaccttacatcaacctgggtgacttatgggacatgcaatcaggctggagagcatcgccgagacaagcgtagtgtagccctggcaccccacgtgggcatgggtttggataccagaacgcaaacttggatgagcgccgagggggcttggaggcaggtcgaaaaagtggagacctgggcactccggcatcctggattcacaatcctggccctgtttctcgctcactacattggcacttccttaatccagaaggttgtgatattcatcctgcttatgttggtcaccccatctatgacaatgcgctgtgtgggcgtagggaacagagactttgttgaaggactgtcgggtgccacctgggtggatgtcgtgctagagcatggcgggtgcgtgacgactatggcgaagaataaacccacactcgacattgagctgcagaagaccgaagcaactcaacttgccacactgaggaaattgtgtatcgagggaaagattaccaacatcacgaccgattcacggtgccctacacagggcgaagctatactcccagaggaacaggaccagaattatgtctgtaaacacacttacgttgatcgcggttgggggaacggatgcggcctgttcggcaaggggagcttagtgacctgcgccaagtttcaatgtctggagcccattgagggaaaagtagtgcagtatgaaaatctcaagtacacagtcatcattactgtgcacaccggtgaccagcatcaggttggcaacgacacacaaggggtgaccgtcgagatcactcctcaggcaagtacggtggaagctgtacttccagagtatggaacactgggcttggaatgctccccgcgaaccggtctagatttcaatgagatgatcctgctcactatgaaaaacaaggcctggatggttcacagacagtggtttttcgacctgccccttccttggacctctggggcgacaaccgagactccaacatggaataggaaagaactgttggtgacgtttaagaacgcccatgcaaaaaagcaagaggtcgtggtcctcggcagccaggaaggagctatgcacaccgccctgactggcgctacagagattcagaattccgggggaacctcaatattcgccggtcacttaaagtgtcggctgaaaatggataagctagaactcaaaggcatgagttacgcaatgtgcctgaacacatttgtgcttaagaaagaggttagcgagactcagcatgggaccatcttgattaaggtggaatacaagggagaggacgccccctgtaaaatccctttctctacggaagatggccaaggtaaggctcacaacgggcgtctgataaccgcgaatccagtagtcacaaaaaaggaggagcccgtgaacattgaagcagagccgcctttcggcgaatccaatatcgttatcggaattggcgacaaagccctcaagatcaactggtataagaaagggtcaagcattggaaagatgtttgaggctactgcccgcggtgcaagaaggatggccatactgggcgataccgcttgggacttcgggagtgtgggaggcgtccttaattctctgggtaaaatggtgcatcagatctttgggtccgcctacacagcattgttcagcggcgtatcgtggattatgaagatcggaatcggcgtgctcctgacttggattgggttaaactctaaaaatacctccatgtcatttagttgcatagttatcggaattatcacgctgtatctaggcgcggtcgtgcaggctgatatgggttgtgtgattaactggaaggggaaggaactcaaatgcggaagcggcatcttcgtcacaaatgaggttcacacctggactgagcagtacaagtttcaagccgactcccccaaacggctggcaacagccatagctggtgcctgggaaaacggcgtgtgtgggatccgatctaccactcgcatggagaatcttttgtggaagcagattgcaaacgaactgaattatatcctctgggagaacaatattaaactgaccgtggtagtcggagatatcataggcgtgttagaacaggggaagagaacactgacgccacagcctatggagcttaaatacagctggaagacctggggaaaggctaaaattgttactgccgagacacaaaactcaagtttcatcattgacggccccaacaccccagaatgcccctccgcgagcagggcctggaatgtgtgggaggtcgaagactatggttttggggtgttcacaactaacatctggttgaagctccgggaggtttacacccagtcttgtgatcatcgcctgatgtcagctgcaataaaagacgaaagagccgtgcacgctgatatgggatactggatcgagagtcagaagaatggcagctggaaactagagaaggcctcctttattgaagtaaagacgtgcacatggcctaaatctcacaccctgtggtcgaacggtgtcctcgagagcgacatgatcattccaaagtccctggcaggcccgatctcacagcataatcacaggcccgggtatcatactcaaaccgcgggaccttggcaccttggcaaattggaactggatttcaactactgcgaggggacaactgtggtgataaccgagaattgtggaacacgtggcccaagtttacggacgaccactgtctctggtaagctcattcacgaatggtgctgtcgaagctgcacactgccccctcttagatatatgggggaggacggatgttggtacggcatggaaatcaggccaatcaacgagaaagaagagaatatggttaagtccctggtgtcagccggtagcggcaaggtagataactttaccatgggggtgttgtgcctcgctattctgttcgaggaagtcatgcgcggaaaattcggcaagaaacatatgatcgccggggtgctatttactttcgttctgctcctgtctggacagattacatggcgggacatggcacacacccttataatgatcggctccaatgctagtgatagaatgggtatgggggtgacgtatttggccctgattgcaacttttaagatccagcccttcttagccctcggatttttcctgaggaaacttaccagccgcgagaacctgctactcggcgtcggcctggctatggcgacaaccttgcaactgccggaagacattgagcagatggccaatgggatcgcattaggactcatgactctgaagcttataacacagtttgaaacctaccagctgtggacagctttggtgtctctcacttgttccaacaccatcttcacgctgacagttgcctggcgaaccgccactctaattctggctggtgtgtcacttctccctctgtgccaaagtagctcgatgcggaagaccgattggttgccaatgacagtcgcagccatgggcgtaccccctctgcccttatttatcttctccctcaaagacgcgccaaagcgtagatcttggcctctgaatgagggggtgatggctgttggacttgtgagcattctggcctcaagtttgctcaggaacgatgtccccatggcaggcccactggtggccggtgggctactgatcgcttgttatgtaataactggaacctccgcagaccttacggtggagaaagccgcggacgtcacatgggaagaggaagctgagcagaccggcgtttctcataacctcatgattactgtggatgacgatggcacaatgcgcatcaaggacgatgaaaccgagaatatcctgactgtgttgttaaaaacagccctgctcattgtcagcgggatatttccgtactccatccctgcaaccctgcttgtgtggcacacgtggcagaagcagactcaacggtcaggagttctgtgggacgtacccagcccacccgagacccagaaagccgaattggaggaaggtgtgtacagaattaagcagcagggcatcttcgggaagacacaagtcggagtgggcgttcagaaagagggtgtgtttcataccatgtggcacgtcacaaggggggctgtgctaactcacaacggaaagcgactggagcctaattgggccagtgtaaaaaaggatctcatttcttatggcggcgggtggcgcctgtccacccagtggcaaaaaggagaagaggtccaggtgatcgcagttgaaccaggtaagaaccccaagaatttccagacgatgcctggcatattccagacaactaccggggagatcggagctattgcccttgactttaaaccgggcacaagcggttcgccaatcattaaccgggaagggaaggtggtcggattatacggcaatggcgtggttaccaaaaacgggggatatgtgtcaggtatcgcgcaaactaatgccgagcccgatggccctaccccagagctggaagaggaaatgttcaagaaaagaaacctcacaataatggacttgcatcccgggtctggaaagacgaggaagtacctgcctgcaattgtccgtgaggctatcaaacgccggctcagaactctgatccttgccccgaccagggtggtagctgcagaaatggaggaggccctgaagggcttgcccattcgatatcagacaaccgccactaaaagtgaacacacaggtcgggagatcgtggatctaatgtgccatgctacctttacgatgcgcctgctctccccagttagagtccctaattacaacttaataattatggacgaagcgcacttcactgatcccgcaagcatcgccgctagggggtatatttctacacgggtgggaatgggcgaggccgcagccatctttatgaccgctaccccacctggcactgcggaagccttcccccagagcaatgcaccaatacaggacgaggagcgagacattccggaaagatcctggaactcagggaatgagtggatcacagattttgtgggaaagaccgtctggttcgtacctagtatcaaagctggtaacgacattgccaactgtctgcgcaagaatggcaagaaagtgatccaacttagcaggaagacatttgatactgaataccagaaaacgcgtctgaacgactgggatttcgttgtgaccacagacatttctgagatgggggcaaattttaaggccgatcgggtcatagaccccagaaggtgcctcaaaccagtgatcttgactgatggacccgagcgcgttattctggctggccctatgccagtgaccgccgcgtccgcagcccagcgaagaggtcgggtcgggaggaacccccagaaggaaaatgaccaatacatcttcacaggccagcctctcaacaatgatgaggaccatgctcactggaccgaagccaagatgctgcttgacaacatcaatactccggagggaattataccagctctattcgaacccgagcgcgagaaatcagcagccatcgatggcgaatatcgtctgaagggggagagtagaaaaacgtttgtggaattgatgcggaggggagacttacctgtatggctggctcacaaggtggccagcgagggtattaaatacaccgatcgcaagtggtgcttcgacggcgaacgaaacaatcagatcctcgaggagaacatggatgttgaaatttggacaaaagagggggaaagaaagaagctgcggcccaggtggcttgacgcacgcacttattccgatccactggcgctcaaagagtttaaggacttcgccgctggaagaaaatctatcgccttggatctggtcaccgaaataggcagggtgccttcgcatctagcacaccggacacgtaatgctctggacaacctcgtgatgcttcataccagcgagcacggtgggcgcgcctaccgacacgcagtcgaggaactgcccgagactatggaaacattattgctgctcggcctgatgatccttctgacgggaggcgccatgctctttttggtttcagggaagggaattggtaaaaccactatcggcctgatttgtgtgatcgtatccagtgggatgttatggatggctgatataccactacagtggattgcgtctgccatcgtgctggagttctttatgatggtcctccttattcctgagccggaaaagcaaagaacaccccaggacaatcagctggcatatgtggttatcggaatattgaccctggctgccatcgtggccgcaaacgagatgggcctcctggaaaccacaaagagggatcttggtatgagcaaagagccaggggtcgtatcccctacttcatacctcgacgtggacctgcatcccgcttctgcctggacgttgtatgcggttgctaccacagtgattactccaatgctgcggcacaccatcgaaaatagcacagccaacgtcagtttagcagccattgctaaccaagcagtggtcctaatgggcctggataagggatggcctatctccaaaatggacctcggcgtgccccttctggccttggggtgctacagccaggttaatccgctgaccctcactgcggctgtgctgcttttagtaacgcattacgccataattggaccaggcctgcaggcaaaggccacacgcgaggctcagaaaagaaccgccgcaggtatcatgaagaaccctactgtggatgggatcatgaccattgacctcgatcccgtcatctatgactctaagttcgagaaacaattgggacaggttatgctgctagtgctgtgtgctgtccagctccttctgatgaggacatcatgggccttgtgcgaagcgctgactctcgccaccggcccaataacaacgctgtgggagggttcccccggcaagttttggaataccactattgcagtgagtatggctaacatcttccgggggagctacttagccggagcaggccttgctttttcgattatgaaatctgtagggacaggacgaagaggcaccggttcccagggggaaactctgggagagaagtggaaaaagaagctcaatcaactaagccgcaaagaattcgatctgtataagaaatcaggcatcacagaggtggacaggaccgaggccaaggaaggtttgaaacggggcgagacgacccaccatgccgttagtcgtgggtctgcgaagctgcagtggtttgtggaaagaaacatggtcatacctgagggaagggtgatcgatctcggctgtgggcgcggaggctggtcctactattgcgctggtcttaaaaaggtcacagaagtgcgggggtacactaagggaggcccgggccacgaggagcccgttccaatgagcacctatgggtggaatattgtaaaactgatgtcaggaaaggacgtgttctacttgcctcccgaaaaatgtgatacactgctctgcgacatcggtgagagtagcccttccccaactgtcgaagagtctcgaaccattagagtgttaaagatggttgagccctggctgaaaaacaatcagttctgtatcaaggtgcttaacccttacatgccaacagtcattgaacacctggagaggctacagcgcaagtatggcgggatgctcgtgcggaatcccctgagcagaaactccacccatgaaatgtactggatctcaaatggaactggcaacatagtatctagtgtgaatatggtttcgcgtttgctgctcaacaggtttacgatgacacaccggcgcccgaccattgagaaagatgtcgaccttggtgcagggactcgacatgtgaacgccgaacctgagaccccaaatatggacgtgatcggagagagaatcaagaggattaaagaagagcacagctccacatggcactatgatgacgaaaacccctacaagacgtgggcttatcatggctcttacgaggtcaaagccaccggctcagcaagctccatgataaatggggttgtgaagctgttaactaagccttgggatgtagtgccaatggtcacacaaatggccatgaccgacactacacccttcggacagcagcgggtgtttaaagaaaaggttgatacccgcacaccgagacctatgcccggtactaggaaagtgatggagatcaccgctgagtggctgtggcgaacgttgggccggaacaagaaaccacgtctctgcaccagagaagagttcacaaagaaggtccgcactaatgcggccatgggggcagtgtttaccgaagagaaccaatgggacagtgctagggccgcagtagaagatgaggagttctggaaactggttgaccgggaaagagagctacacaagcttggaaaatgtggctcttgcgtgtataatatgatgggtaagcgcgaaaaaaagctgggggagtttggaaaagccaagggcagcagggctatttggtacatgtggctcggcgcccgattcctggagtttgaagcgttggggttcctgaacgaggatcattggttttcacgggaaaattcctacagtggagtcgagggtgaaggcctccacaagcttgggtatatcctgagagacattagcaaaatccctggaggcgcaatgtacgccgatgacacagctggttgggacactaggataaccgaggatgacttacataacgaggaaaagatcacgcagcagatggatcccgagcaccgccagctggccaatgcaattttcaaattgacatatcaaaacaaggtggtgaaagtccagcgtccaacccccaaggggactgttatggacatcatttctcggaaggatcagagaggatccggccaggtgggcacatacgggctcaatacctttactaacatggaagctcaactggtaaggcagatggagggagaaggtgtgctatcaaaaaccgaccttgagaatcctcacctgctcgagaagaaaatcacacagtggctggaaaacaagggcgtcgagcgcttgaaacgaatggccataagcggggatgactgcgtggttaagccaattgatgaccggttcgctaacgccttactggcactcaatgatatgggaaaggtgagaaaagacatcccgcagtggcaaccctcgaagggctggcatgattggcagcaggtccctttctgttctcaccattttcacgaacttatcatgaaagacggtaggaagctggtggtaccatgccgcccccaggacgagctaattgggagagcgcggataagtcaaggagccggctggtccctgaaagaaacggcttgtctcggcaaggcctatgcacagatgtggagcttgatgtacttccacaggcgtgatctgcgacttgcttcaaacgccatctgctccgcagttcctgtgcattgggtcccaacctctcgcactacatggagcattcacgcccatcaccagtggatgaccactgaggacatgctgacagtgtggaatagagtttggatcgaggataacccctggatggaagacaagacccctgtgacgacatgggaggatgtcccgtatctcgggaaacgggaagaccaatggtgtggaagtttaattggtctgacctccagggcgacttgggctcagaatatcttgaccgccatacagcaggtgcgcagcctgatcggcgatgaggagtttctcgactacatgccatctatgaagagattccggaaagaagaggaatcagagggggcaatttggtga

SEQ ID NO: 15228 - RNA, 9873 nt, synthetic construct
  misc_feature 1..9873: note = derived and/or modified CDS sequence (opt3) from DENV-3__FJ639720__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcaaccggtattaatatgtgtacactaatagccatggatctcggcgagatgtgcgacgatactgtcacctacaaatgtccactgatcgcggaagttgagccggaagacattgattgctggtgtaaccttacatcaacctgggtgacttatgggacatgcaatcaggctggagagcatcgccgagacaagcgtagtgtagccctggcaccccacgtgggcatgggtttggataccagaacgcaaacttggatgagcgccgagggggcttggaggcaggtcgaaaaagtggagacctgggcactccggcatcctggattcacaatcctggccctgtttctcgctcactacattggcacttccttaatccagaaggttgtgatattcatcctgcttatgttggtcaccccatctatgacaatgcgctgtgtgggcgtagggaacagagactttgttgaaggactgtcgggtgccacctgggtggatgtcgtgctagagcatggcgggtgcgtgacgactatggcgaagaataaacccacactcgacattgagctgcagaagaccgaagcaactcaacttgccacactgaggaaattgtgtatcgagggaaagattaccaacatcacgaccgattcacggtgccctacacagggcgaagctatactcccagaggaacaggaccagaattatgtctgtaaacacacttacgttgatcgcggttgggggaacggatgcggcctgttcggcaaggggagcttagtgacctgcgccaagtttcaatgtctggagcccattgagggaaaagtagtgcagtatgaaaatctcaagtacacagtcatcattactgtgcacaccggtgaccagcatcaggttggcaacgacacacaaggggtgaccgtcgagatcactcctcaggcaagtacggtggaagctgtacttccagagtatggaacactgggcttggaatgctccccgcgaaccggtctagatttcaatgagatgatcctgctcactatgaaaaacaaggcctggatggttcacagacagtggtttttcgacctgccccttccttggacctctggggcgacaaccgagactccaacatggaataggaaagaactgttggtgacgtttaagaacgcccatgcaaaaaagcaagaggtcgtggtcctcggcagccaggaaggagctatgcacaccgccctgactggcgctacagagattcagaattccgggggaacctcaatattcgccggtcacttaaagtgtcggctgaaaatggataagctagaactcaaaggcatgagttacgcaatgtgcctgaacacatttgtgcttaagaaagaggttagcgagactcagcatgggaccatcttgattaaggtggaatacaagggagaggacgccccctgtaaaatccctttctctacggaagatggccaaggtaaggctcacaacgggcgtctgataaccgcgaatccagtagtcacaaaaaaggaggagcccgtgaacattgaagcagagccgcctttcggcgaatccaatatcgttatcggaattggcgacaaagccctccgcatcaactggtataagaaggggtcaagcattggaaaaatgtttgaggctactgccagaggtgcaaggcggatggccatactgggcgataccgcttgggacttcgggagtgtgggaggcgtccttaattctctgggtaagatggtgcatcagatctttgggtccgcctacacagcattgttcagcggcgtatcgtggattatgaaaatcggaatcggcgtgctcctgacttggattgggttaaactctaagaatacctccatgtcatttagttgcatagttatcggaattatcacgctgtatctaggcgcggtcgtgcaggctgatatgggttgtgtgattaactggaaagggaaggaactcaagtgcggaagcggcatcttcgtcacaaatgaggttcacacctggactgagcagtacaaatttcaagccgactcccccaagcgactggcaacagccatagctggtgcctgggaaaacggcgtgtgtgggatccgctctaccactagaatggagaatcttttgtggaaacagattgcaaacgaactgaattatatcctctgggagaacaatattaagctgaccgtggtagtcggagatatcataggcgtgttagaacaggggaaaaggacactgacgccacagcctatggagcttaagtacagctggaaaacctggggaaaggctaagattgttactgccgagacacaaaactcaagtttcatcattgacggccccaacaccccagaatgcccctccgcgagccgggcctggaatgtgtgggaggtcgaagactatggttttggggtgttcacaactaacatctggttgaaactccgcgaggtttacacccagtcttgtgatcatagactgatgtcagctgcaataaaggacgaaagggccgtgcacgctgatatgggatactggatcgagagtcagaaaaatggcagctggaagctagagaaagcctcctttattgaagtaaagacgtgcacatggcctaagtctcacaccctgtggtcgaacggtgtcctcgagagcgacatgatcattccaaaatccctggcaggcccgatctcacagcataatcaccgtcccgggtatcatactcaaaccgcgggaccttggcaccttggcaagttggaactggatttcaactactgcgaggggacaactgtggtgataaccgagaattgtggaacacggggcccaagtttacgaacgaccactgtctctggtaaactcattcacgaatggtgctgtagaagctgcacactgccccctcttaggtatatgggggaggacggatgttggtacggcatggaaatccgcccaatcaacgagaaggaagagaatatggttaaatccctggtgtcagccggtagcggcaaggtagataactttaccatgggggtgttgtgcctcgctattctgttcgaggaagtcatgcggggaaagttcggcaaaaagcatatgatcgccggggtgctatttactttcgttctgctcctgtctggacagattacatggagagacatggcacacacccttataatgatcggctccaatgctagtgataggatgggtatgggggtgacgtatttggccctgattgcaacttttaaaatccagcccttcttagccctcggatttttcctgcgcaagcttaccagccgagagaacctgctactcggcgtcggcctggctatggcgacaaccttgcaactgccggaagacattgagcagatggccaatgggatcgcattaggactcatgactctgaaacttataacacagtttgaaacctaccagctgtggacagctttggtgtctctcacttgttccaacaccatcttcacgctgacagttgcctggcggaccgccactctaattctggctggtgtgtcacttctccctctgtgccaaagtagctcgatgcgtaagaccgattggttgccaatgacagtcgcagccatgggcgtaccccctctgcccttatttatcttctccctcaaggacactccaaaaagaaggtcttggcctctgaatgagggggtgatggcggttggacttgtgagcattctggcttcaagtttgctccgcaacgatgtccccatggccggcccactggtggcaggtgggctactgatcgcctgttatgtaataaccggaacgtccgctgaccttacagtggagaaggcagccgacgtcacctgggaagaggaagcggagcagactggcgtttctcataacctcatgattacagtggatgacgatggcaccatgcggatcaaagacgatgaaactgagaatatcctgacagtgttgttaaagaccgctctgctcattgtcagcgggatatttccgtactccatccctgccacgctgcttgtgtggcacacttggcagaaacagacccaaagatcaggagttctgtgggacgtacccagcccacccgagacacagaaggcagaattggaggaaggtgtgtacaggattaaacagcagggcatcttcgggaagacccaagtcggagtgggcgttcagaaggagggtgtgtttcatacaatgtggcacgtcactcgaggggccgtgctaacccacaacggaaaacgcctggagcctaattgggctagtgtaaagaaagatctcatttcttatggcggcgggtggcggctgtccacgcagtggcaaaagggagaagaggtccaggtgatcgccgttgaaccaggtaaaaaccccaagaatttccagacaatgcctggcatattccagactaccacaggggagatcggagcaattgctcttgactttaagccgggcaccagcggttcgccaatcattaacagagaagggaaagtggtcggattatacggcaatggcgtggttactaagaacgggggatatgtgtcaggtatcgcccaaaccaatgcggagcccgatggccctacaccagagctggaagaggaaatgttcaaaaagaggaacctcacgataatggacttgcatcccgggtctggaaaaactcgtaagtacctgcctgccattgtccgcgaggcaatcaagcggagactcaggaccctgatccttgctccgacacgagtggtagccgctgaaatggaggaggcactgaaaggcttgcccattcggtatcagaccactgccacaaagagtgaacacaccggtcgcgagatcgtggatctaatgtgccatgccacgtttactatgagactgctctccccagttagggtccctaattacaacttaataattatggacgaagctcacttcacagatcccgcgagcatcgcagcccgggggtatatttctacccgagtgggaatgggcgaggctgccgcaatctttatgaccgccactccacctggcacagctgaagcgttcccccagagcaatgccccaatacaggacgaggagagagacattccggaacgctcctggaactcagggaatgagtggatcaccgattttgtgggaaaaacagtctggttcgtacctagtatcaaggcaggtaacgacattgctaactgtctgaggaaaaatggcaagaaggtgatccaacttagccgtaaaacttttgatacggaataccagaagacccggctgaacgactgggatttcgttgtgacaactgacatttctgagatgggggccaattttaaagcagatagagtcatagaccccaggcgctgcctcaagccagtgatcttgaccgatggacccgagcgagttattctggccggccctatgccagtgacagctgcctccgcggcacagagacggggtagggtcgggcgcaacccccagaaagaaaatgaccaatacatcttcaccggccagcctctcaacaatgatgaggaccatgcccactggactgaagctaagatgctgcttgacaacatcaatacgccggagggaattataccagccctattcgaacccgagcgtgagaagtcagctgcaatcgatggcgaatatagactgaaaggggagagtcggaagacctttgtggaattgatgaggcgcggagacttacctgtatggctggcccacaaagtggctagcgagggtattaagtacacagatcgaaaatggtgcttcgacggcgaaagaaacaatcagatcctcgaggagaacatggatgttgaaatttggactaaggagggggaacggaaaaagctgaggccccgctggcttgacgccagaacctattccgatccactggcactcaaggagtttaaagacttcgcggccggaaggaagtctatcgctatagatttggtcacagaaatcggccgggtgccttcgcatctggcccaccgtacccgcaatgcactagacaacctggtgatgctccatactagcgagcacggtgggcgagcttacagacacgccgtcgaggaacttcccgagacaatggaaacgctgttattgctgggcctcatgattctgcttaccggaggcgcaatgctgtttctcgtttcagggaaaggaatcggtaagactacaattggcttgatctgtgtgatagtatccagtgggatgctgtggatggccgatattccattacagtggatcgcttctgcgattgtgctagagttctttatgatggtcctgctcatccctgagccggaaaaacaaaggaccccccaggacaatcagcttgcctatgtggttataggaatcctgaccttggcagctattgtggccgccaacgagatgggcctgctcgaaacaactaagcgggatctgggtatgagcaaggagccaggggtcgtatcccctacgtcataccttgacgtggacctccatcccgcatctgcttggaccctgtatgccgttgcgacaactgtgatcaccccaatgttgcgccacacaattgaaaatagcaccgctaacgtcagtctggccgcaatcgccaaccaagctgtggtcttaatgggcctagataaaggatggcctatatccaagatggacctgggcgtgcccctccttgcactggggtgctacagccaggttaatccgttgactctgacggccgcggtgctcctgcttgtaacacattacgctattatcggaccaggcttacaggccaaagcaaccagagaggcccagaagaggactgctgccggtatcatgaaaaaccctaccgtggatgggattatgacaatcgacctggatcccgtcatatatgactctaagttcgagaagcaactcggacaggttatgttgctggtgctatgtgcagtccagctgctccttatgcggacttcatgggctctgtgcgaagccttgaccctggcgacaggcccaattacgaccctctgggagggttcccccggcaaattttggaatactacaatcgccgtgagtatggcaaacattttccgagggagctacctggctggagccggcttagcattttcgatcatgaagtctgtagggaccggaagacgcggcactggttcccagggggaaacacttggagagaaatggaagaaaaagctgaatcaactcagcaggaaggaattcgatctatataaaaagtcaggcataaccgaggtggaccggacggaggctaaagaaggtctgaagcgtggcgagaccacacaccatgccgttagtagagggtctgccaaattgcagtggtttgtggaaaggaacatggtcatccctgagggacgcgtgattgatctgggctgtgggcggggaggctggtcctactattgcgcgggtctcaagaaagtcactgaagtgcgagggtacaccaagggaggcccgggccacgaggagcccgttccaatgagcacatatgggtggaatatcgtaaagcttatgtcaggaaaagacgtgttctacctgcctcccgaaaagtgtgatactttgctgtgcgacattggtgagagtagcccttccccaaccgtcgaagagtctagaacaatcagggtgctcaaaatggttgagccctggttaaagaacaatcagttctgtattaaagtgctgaacccttacatgccaaccgtcatcgaacaccttgagcgcctgcagcggaagtatggcgggatgctagtgagaaatcccctcagccgtaactccactcatgaaatgtactggatatcaaatggaacgggcaacattgtatctagtgtgaatatggtttcgaggctgttgctgaaccggtttacaatgacccaccgccgaccgactatcgagaaggatgtcgacctcggtgctgggaccagacatgtgaacgcagaacctgagacaccaaatatggacgtgatcggagagaggattaaacggataaaggaagagcacagctccacgtggcactatgatgacgaaaacccctacaaaacctgggcctatcatggctcttacgaggtcaaggctactggctcagccagctccatgatcaatggggttgtgaaacttctgacaaagccttgggatgtagtgccaatggtcacccaaatggcaatgactgacacaacccccttcggacagcagcgcgtgtttaaggaaaaagttgatacaagaactccgaggcctatgcccggtacccgaaaggtgatggagattacggccgagtggttatggcggaccctgggccgtaacaaaaagccaagattgtgcacacgcgaagagttcactaaaaaggtcaggaccaatgctgcgatgggggccgtgtttacagaagagaaccaatgggacagtgcacgggctgccgtagaagatgaggagttctggaagctcgttgacagagaacgcgagctgcacaaactaggaaagtgtggctcttgcgtgtataatatgatgggtaaaagggaaaagaaacttggggagtttggaaaggcaaaaggcagccgagccatctggtacatgtggctgggcgctcggttcctcgagtttgaagccctggggttcttgaacgaggatcattggttttcaagagaaaattcctacagtggagtcgagggtgaaggcctgcacaagctcgggtatattcttagggacatcagcaagatacctggaggcgcgatgtacgcagatgacactgccggttgggacacccgcatcacggaggatgacctgcataacgaggaaaaaattacacagcagatggatcccgagcaccgtcagttagctaatgccatcttcaagctgacctatcaaaacaaagtggtgaaggtccagcggccaactcccaaagggacagttatggacattatctctagaaaggatcagaggggatccggccaggtgggcacctacgggttgaatacttttaccaacatggaagcacaactcgtacgccagatggagggagaaggtgtgctgtcaaagacagacctagagaatcctcaccttctggagaaaaagataacgcagtggctcgaaaacaaaggcgtcgagcgactgaagcggatggctattagcggggatgactgcgtggttaaaccaatcgatgacagattcgccaacgctttgttagccctgaatgatatgggaaaggtgaggaaggacatcccgcagtggcaaccctcgaaaggctggcatgattggcagcaggtccctttctgttctcaccattttcacgaactcattatgaaggacggtcgcaaacttgtggtaccatgcagaccccaggacgagctgatagggcgggcaaggatcagtcaaggagcgggctggtccctaaaggaaaccgcctgtctgggcaaagcttatgcccagatgtggagcctcatgtacttccaccgtcgagatttgcgcctggcatcaaacgctatttgctccgccgttcctgtgcattgggtcccaacttctagaacaacctggagcatccacgcacatcaccagtggatgactacagaggacatgcttaccgtgtggaatcgggtttggattgaggataacccctggatggaagacaagacgcctgtgacaacctgggaggatgtcccgtatctggggaagagggaagaccaatggtgtggaagtctcatcggtttaacttcccgcgccacctgggcgcagaatatactgacagctatccagcaggtgagaagcttgattggcgatgaggagtttctggactacatgccatctatgaaacggttcaggaaggaagaggaatcagagggggccatctggtga

SEQ ID NO: 15229 - RNA, 9873 nt, synthetic construct
  misc_feature 1..9873: note = derived and/or modified CDS sequence (opt3) from DENV-3__GQ868626__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcaaccggtattaatatgtgtacactaatagccatggatctcggcgagatgtgcgacgatactgtcacctacaaatgtccactgatcgcggaagttgagccggaagacattgattgctggtgtaaccttacatcaacctgggtgacttatgggacatgcaatcaggctggagagcatcgccgagacaagcgtagtgtagccctggcaccccacgtgggcatgggtttggataccagaacgcaaacttggatgagcgccgagggggcttggaggcaggtcgaaaaagtggagacctgggcactccggcatcctggattcacaatcctggccctgtttctcgctcactacattggcacttccttaatccagaaggttgtgatattcatcctgcttatgttggtcaccccatctatgacaatgcgctgtgtgggcgtagggaacagagactttgttgaaggactgtcgggtgccacctgggtggatgtcgtgctagagcatggcgggtgcgtgacgactatggcgaagaataaacccacactcgacattgagctgcagaagaccgaagcaactcaacttgccacactgaggaaattgtgtatcgagggaaagattaccaacatcacgaccgattcacggtgccctacacagggcgaagctatactcccagaggaacaggaccagaattatgtctgtaaacacacttacgttgatcgcggttgggggaacggatgcggcctgttcggcaaggggagcttagtgacctgcgccaagtttcaatgtctggagcccattgagggaaaagtagtgcagtatgaaaatctcaagtacacagtcatcattactgtgcacaccggtgaccagcatcaggttggcaacgacacacaaggggtgaccgtcgagatcactcctcaggcaagtacggtggaagctgtacttccagagtatggaacactgggcttggaatgctccccgcgaaccggtctagatttcaatgagatgatcctgctcactatgaaaaacaaggcctggatggttcacagacagtggtttttcgacctgccccttccttggacctctggggcgacaattgagaccccaacttggaataggaaagaactgttggtgacatttaagaacgcccatgcaaaaaagcaagaggtcgtggtcctcggcagccaggaaggagctatgcacacggccctgaccggcgctactgagatacagaattccgggggaacatcaatcttcgccggtcacttaaagtgtcggctgaaaatggataagctagaactcaaaggcatgagttacgcaatgtgcctgaacacctttgtgcttcgtaaggaggttagcgagacacagcatgggactattttgatcaaagtggaatacaagggagaggacgccccctgtaagatacctttctctaccgaagatggccaaggtaaagctcacaacgggcgcctgattacggcgaatccagtagtcaccaagaaagaggagcccgtgaacatcgaagcagagccgcctttcggcgaatccaatatcgttattggaatcggcgacaaggccctcaaaattaactggtataagaaggggtcaagcataggaaaaatgtttgaggctacagccagaggtgcaaggcggatggccatcctgggcgatactgcttgggacttcgggagtgtgggaggcgtccttaattctctgggtaagatggtgcatcagatttttgggtccgcctacaccgcattgttcagcggcgtatcgtggatcatgaaaatcggaattggcgtgctcctgacatggatagggttaaactctaagaatacttccatgtcatttagttgcatcgttattggaatcattaccctgtatctaggcgcggtcgtgcaggctgatatgggttgtgtgatcaactggaaagggaaggaactcaagtgcggaagcggcatattcgtcacgaatgaggttcacacatggaccgagcagtacaaatttcaagccgactcccccaagcgactggcaactgccatcgctggtgcctgggaaaacggcgtgtgtgggattcgctctacaaccagaatggagaatcttttgtggaaacagatcgcaaacgaactgaattatattctctgggagaacaatatcaagctgactgtggtagtcggagatataattggcgtgttagaacaggggaaaaggaccctgacaccacagcctatggagcttaagtacagctggaaaacgtggggaaaggctaagatcgttaccgccgagactcaaaactcaagtttcattatcgacggccccaacacaccagaatgcccctccgcgagccgggcctggaatgtgtgggaggtcgaagactatggttttggggtgttcaccacaaacatatggttgaaactccgcgaggtttacactcagtcttgtgatcatagactgatgtcagctgcaatcaaggacgaaagggccgtgcacgctgatatgggatactggattgagagtcagaaaaatggcagctggaagctagagaaagcctcctttatcgaagtaaagacctgcacgtggcctaagtctcacacactgtggtcgaacggtgtcctcgagagcgacatgattatcccaaaatccctggcaggcccgatatcacagcataatcaccgtcccgggtatcatacccaaactgcgggaccttggcaccttggcaagttggaactggatttcaactactgcgaggggaccacagtggtgattactgagaattgtggaacccggggcccaagtttacgaacaacgaccgtctctggtaaactcatccacgaatggtgctgtagaagctgcactctgccccctcttaggtatatgggggaggacggatgttggtacggcatggaaatccgcccaattaacgagaaggaagagaatatggttaaatccctggtgtcagccggtagcggcaaggtagataactttacaatgggggtgttgtgcctcgctatcctgttcgaggaagtcatgcggggaaagttcggcaaaaagcatatgattgccggggtgctatttaccttcgttctgctcctgtctggacagataacttggagagacatggcacacacacttatcatgattggctccaatgctagtgataggatgggtatgggggtgacctatttggccctgatcgcaacgtttaaaattcagcccttcttagccctcggatttttcctgcgcaagcttactagccgagagaacctgctactcggcgtcggcctggctatggcgaccacattgcaactgccggaagacatcgagcagatggccaatgggatagcattaggactcatgaccctgaaacttatcactcagtttgaaacataccagctgtggaccgctttggtgtctctcacatgttccaacactattttcaccctgacggttgcctggcggacagccaccctaatcctggctggtgtgtcacttctccctctgtgccaaagtagctcgatgcgtaagactgattggttgccaatgaccgtcgcagccatgggcgtaccccctctgcccttatttattttctccctcaaggacacaccaaaaagaaggtcttggcctctgaatgagggggtgatggcggttggacttgtgagcatcctggcttcaagtttgctccgcaacgatgtccccatggccggcccactggtggcaggtgggctactgatagcctgttatgtaattactggaacctccgctgaccttacggtggagaaggcagccgacgtcacatgggaagaggaagcggagcagaccggcgtttctcataacctcatgatcactgtggatgacgatggcacaatgcggatcaaagacgatgaaaccgagaatattctgactgtgttgttaaagacagctctgctcatagtcagcgggatctttccgtactccattcctgccaccctgcttgtgtggcacacgtggcagaaacagactcaaagatcaggagttctgtgggacgtacccagcccacccgagacccagaaggcagaattggaggaaggtgtgtacaggatcaaacagcagggcattttcgggaagacacaagtcggagtgggcgttcagaaggagggtgtgtttcataccatgtggcacgtcacacgaggggccgtgctaactcacaacggaaaacgcctggagcctaattgggctagtgtaaagaaagatctcatctcttatggcggcgggtggcggctgtccacccagtggcaaaagggagaagaggtccaggtgatagccgttgaaccaggtaaaaaccccaagaatttccagacgatgcctggcatcttccagacaactaccggggagattggagcaatcgctcttgactttaagccgggcacaagcggttcgccaattatcaacagagaagggaaagtggtcggattatacggcaatggcgtggttaccaagaacgggggatatgtgtcaggtatagcccaaactaatgcggagcccgatggccctaccccagagctggaagaggaaatgttcaaaaagaggaacctcacaattatggacttgcatcccgggtctggaaaaacgcgtaagtacctgcctgccatcgtccgcgaggcaatcaagcggagactcaggactctgattcttgctccgacccgagtggtagccgctgaaatggaggaggcactgaaaggcttgcccatccggtatcagacaaccgccactaagagtgaacacacaggtcgcgagatagtggatctaatgtgccatgccacctttacgatgagactgctctccccagttagggtccctaattacaacttaattatcatggacgaagctcacttcactgatcccgcgagcattgcagcccgggggtatatctctacacgagtgggaatgggcgaggctgccgcaatatttatgaccgccaccccacctggcactgctgaagcgttcccccagagcaatgccccaattcaggacgaggagagagacatcccggaacgctcctggaactcagggaatgagtggatcacagattttgtgggaaaaaccgtctggttcgtacctagtattaaggcaggtaacgacatcgctaactgtctgaggaaaaatggcaagaaggtgattcaacttagccgtaaaacatttgatactgaataccagaagacgcggctgaacgactgggatttcgttgtgaccacagacatatctgagatgggggccaattttaaagcagatagagtcatcgaccccaggcgctgcctcaagccagtgattttgactgatggacccgagcgagttatcctggccggccctatgccagtgaccgctgcctccgcggcacagagacggggtagggtcgggcgcaacccccagaaagaaaatgaccaatacatcttcacaggccagcctctcaacaatgatgaggaccatgcccactggaccgaagctaagatgctgcttgacaacattaatactccggagggaataatcccagccctattcgaacccgagcgtgagaagtcagctgcaattgatggcgaatatagactgaaaggggagagtcggaagacgtttgtggaattgatgaggcgcggagacttacctgtatggctggcctacaaagtggctagcgagggtatcaagtataccgatcgaaaatggtgcttcgacggcgaaagaaacaatcagattctcgaggagaacatggatgttgaaatctggacaaaggagggggaacggaaaaagctgaggccccgctggcttgacgccagaacttactccgatccactggcactcaaggagtttaaagacttcgcggccggaaggaagtctatagctttggatctggtcaccgaaatcggccgggtgccttcgcacctagcccatcgtacacgcaatgcactggacaacctcgtgatgcttcacaccagcgagcatggtgggcgagcttatagacacgccgtcgaggaactgcccgagactatggaaacattattgctgctcggcctgatgattcttctgacgggaggcgcaatgctctttttgatctcagggaaaggaattggtaagaccactatcggcctgatatgtgttattgtgtccagtgggatgttatggatggccgatatcccactacagtggattgcttctgcgatcgtactggagttctttatgatggtgctccttatacctgagccggaaaaacaaaggacaccccaggacaatcagctggcctacgtcgtgatcggaattttgaccctggcagctatcgttgccgccaacgagatgggcctcctggaaaccacaaagcgggatcttggtatgagcaaggagccaggggtggtctcccctacttcatatctcgacgtagacctgcaccccgcatctgcttggacgttgtacgccgtggcgaccacagttattactccaatgctgcgccataccatcgaaaatagcacagctaacgtgagtttagccgcaatagccaaccaagctgtcgtgctaatgggcctggataaaggatggcctatttccaagatggacctcggcgtcccccttctggcattggggtgctacagccaggtgaatccgctgaccctcactgccgcggttctgcttttagtgacgcactatgctatcatcggaccaggcctgcaggccaaagcaacaagagaggcccagaagaggaccgctgccggtattatgaaaaaccctactgtagatgggatcatgaccatagacctcgatcccgtgatttacgactctaagttcgagaagcaattgggacaggtcatgctgctagttctgtgtgcagtgcagctccttctgatgcggacatcatgggctttgtgcgaagccctgactctcgcgaccggcccaatcacaacgctgtgggagggttcccccggcaaattttggaataccactattgccgtcagtatggcaaacatcttccgagggagctatttagctggagccggccttgcattttcgataatgaagtctgtggggacaggaagacgcggcaccggttcccagggggaaactctgggagagaaatggaagaaaaagctcaatcaactaagcaggaaggaattcgatctgtacaaaaagtcaggcatcacagaggtagaccggaccgaggctaaagaaggtttgaagcgtggcgagacgacccatcacgccgtgagtagagggtctgccaaactgcagtggtttgttgaaaggaacatggtgattcctgagggacgcgtcatcgatctcggctgtgggcggggaggctggtcctattactgcgcgggtcttaagaaagtgacagaagtccgagggtatactaagggaggcccgggccatgaggagcccgtgccaatgagcacctacgggtggaatattgttaagctgatgtcaggaaaagacgtattctacttgcctcccgaaaagtgtgatacactgctctgcgacatcggtgagagtagcccttccccaactgtggaagagtctagaaccattagggtcttaaaaatggtggagccctggctgaagaacaatcagttctgtatcaaagttcttaacccttatatgccaacagtgatagaacacctggagcgcctacagcggaagtacggcgggatgctcgtcagaaatcccctgagccgtaactccacccacgaaatgtattggatttcaaatggaactggcaacatcgtgtctagtgtaaatatggtgtcgaggttgctgctcaaccggtttacgatgacacatcgccgaccgaccatcgagaaggatgttgaccttggtgctgggactagacacgtcaacgcagaacctgagaccccaaatatggacgtgattggagagaggataaaacggatcaaggaagagcatagctccacatggcactacgatgacgaaaacccctataaaacgtgggcctaccacggctcttatgaggtgaaggctaccggctcagccagctccatgattaatggggtcgttaaactgttaactaagccttgggatgtggtaccaatggtgacacaaatggcaatgaccgacactacacccttcggacagcagcgcgtctttaaggaaaaagtggataccagaacaccgaggcctatgcccggtactcgaaaggttatggagatcaccgccgagtggctgtggcggacgttgggccgtaacaaaaagccaagactctgcacccgcgaagagttcacaaaaaaggtgaggactaatgctgcgatgggggccgtctttaccgaagagaaccaatgggacagtgcacgggctgccgtggaagatgaggagttctggaagctggtagacagagaacgcgagctacataaacttggaaagtgtggctcttgcgtttacaatatgatgggtaaaagggaaaagaaactgggggagtttggaaaggcaaaaggcagccgagccatttggtacatgtggctcggcgctcggttcctggagtttgaagccttggggttcctgaacgaggatcactggttttcaagagaaaattcctatagtggagtggagggtgaaggcctccataagcttgggtacatcctgagggacataagcaagatccctggaggcgcgatgtatgcagatgacacagccggttgggacactcgcattaccgaggatgacttacacaacgaggaaaaaatcacgcagcagatggatcccgagcatcgtcagctggctaatgccattttcaagttgacataccaaaacaaagtcgtgaaggtgcagcggccaacccccaaagggactgtcatggacatcatatctagaaaggatcagaggggatccggccaggttggcacatatgggctcaatacctttactaacatggaagcacaactggtgcgccagatggagggagaaggtgtactatcaaaggctgaccttgagaatcctcacctgctcgagaaaaagattacccagtggctggaaaacaaaggcgtggagcgattgaagcggatggccatcagcggggatgactgcgtcgtgaaaccaatcgatgacagattcgctaacgccttactggcactcaatgatatgggaaaggttaggaaggacattccgcagtggcaaccctcgaaaggctggcacgattggcagcaggtgcctttctgttctcatcactttcatgaacttataatgaaggacggtcgcaaactggtcgtgccatgcagaccccaggacgagctaatcgggcgggcgaggattagtcaaggagccggctggtccctgaaggaaacagcttgtctcggcaaagcctacgcacagatgtggagcttgatgtatttccaccgtcgagatctgcgccttgcttcaaacgccatctgctccgcagtacctgttcactgggtgccaacgtctagaaccacttggagcattcatgcccaccatcagtggatgacaaccgaggacatgctggcggtctggaatcgggtgtggatcgaggataacccctggatggaagacaagactcctgttacaacctgggaggatgtgccgtacctcgggaagagggaagaccaatggtgtggaagtttaataggtctgacgtcccgcgctacatgggcccagaatatcttgaccgcaattcagcaggtcagaagcctgatcggcgatgaggagtttctcgactacatgccatctatgaaacggttcaggaaggaagaggaatcagagggggccatttggtga

SEQ ID NO: 15230 - RNA, 9873 nt, synthetic construct
  misc_feature 1..9873: note = derived and/or modified CDS sequence (opt3) from DENV-3__GQ868627__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcaaccggtattaatatgtgtacactaatagccatggatctcggcgagatgtgcgacgatactgtcacctacaaatgtccactgatcgcggaagttgagccggaagacattgattgctggtgtaaccttacatcaacctgggtgacttatgggacatgcaatcaggctggagagcatcgccgagacaagcgtagtgtagccctggcaccccacgtgggcatgggtttggataccagaacgcaaacttggatgagcgccgagggggcttggaggcaggtcgaaaaagtggagacctgggcactccggcatcctggattcacaatcctggccctgtttctcgctcactacattggcacttccttaatccagaaggttgtgatattcatcctgcttatgttggtcaccccatctatgacaatgcgctgtgtgggcgtagggaacagagactttgttgaaggactgtcgggtgccacctgggtggatgtcgtgctagagcatggcgggtgcgtgacgactatggcgaagaataaacccacactcgacattgagctgcagaagaccgaagcaactcaacttgccacactgaggaaattgtgtatcgagggaaagattaccaacatcacgaccgattcacggtgccctacacagggcgaagctatactcccagaggaacaggaccagaattatgtctgtaaacacacttacgttgatcgcggttgggggaacggatgcggcctgttcggcaaggggagcttagtgacctgcgccaagtttcaatgtctggagcccattgagggaaaagtagtgcagtatgaaaatctcaagtacacagtcatcattactgtgcacaccggtgaccagcatcaggttggcaacgacacacaaggggtgaccgtcgagatcactcctcaggcaagtacggtggaagctgtacttccagagtatggaacactgggcttggaatgctccccgcgaaccggtctagatttcaatgagatgatcctgctcactatgaaaaacaaggcctggatggttcacagacagtggtttttcgacctgccccttccttggacctctggggcgacaaccgagactccaacatggaataggaaagaactgttggtgacgtttaagaacgcccatgcaaaaaagcaagaggtcgtggtcctcggcagccaggaaggagctatgcacaccgccctgactggcgctacagagattcagaattccgggggaacctcaatattcgccggtcacttaaagtgtcggctgaaaatggataagctagaactcaaaggcatgagttacgcaatgtgcctgaacacatttgtgcttcgtaaggaggttagcgagactcagcatgggaccatcttgattaaagtggaatacaagggagaggacgccccctgtaagatccctttctctacggaagatggccaaggtaaagctcacaacgggcgcctgataaccgcgaatccagtagtcacaaagaaagaggagcccgtgaacattgaagcagagccgcctttcggcgaatccaatatcgttatcggaattggcgacaaggccctcaaaatcaactggtataagaaggggtcaagcattggaaaaatgtttgaggctactgccagaggtgcaaggcggatggccatactgggcgataccgcttgggacttcgggagtgtgggaggcgtccttaattctctgggtaagatggtgcatcagatctttgggtccgcctacacagcattgttcagcggcgtatcgtggattatgaaaatcggaatcggcgtgctcctgacttggattgggttaaactctaagaatacctccatgtcatttagttgcatagttatcggaattatcacgctgtatctaggcgcggtcgtgcaggctgatatgggttgtgtgattaactggaaagggaaggaactcaagtgcggaagcggcatcttcgtcacaaatgaggttcacacctggactgagcagtacaaatttcaagccgactcccccaagcgactggcaacagccatagctggtgcctgggaaaacggcgtgtgtgggatccgctctaccactagaatggagaatcttttgtggaaacagattgcaaacgaactgaattatatcctctgggagaacaatattaagctgaccgtggtagtcggagatatcataggcgtgttagaacaggggaaaaggacactgacgccacagcctatggagcttaagtacagctggaaaacctggggaaaggctaagattgttactgccgagacacaaaactcaagtttcatcattgacggccccaacaccccagaatgcccctccgcgagccgggcctggaatgtgtgggaggtcgaagactatggttttggggtgttcacaactaacatctggttgaaactccgcgaggtttacacccagtcttgtgatcatagactgatgtcagctgcaataaaggacgaaagggccgtgcacgctgatatgggatactggatcgagagtcagaaaaatggcagctggaagctagagaaagcctcctttattgaagtaaagacgtgcacatggcctaagtctcacaccctgtggtcgaacggtgtcctcgagagcgacatgatcattccaaaatccctggcaggcccgatctcacagcataatcaccgtcccgggtatcatactcaaaccgcgggaccttggcaccttggcaagttggaactggatttcaactactgcgaggggacaactgtggtgataaccgagaattgtggaacacggggcccaagtttacgaacgaccactgtctctggtaaactcattcacgaatggtgctgtagaagctgcacactgccccctcttaggtatatgggggaggacggatgttggtacggcatggaaatccgcccaatcaacgagaaggaagagaatatggttaaatccctggtgtcagccggtagcggcaaggtagataactttaccatgggggtgttgtgcctcgctattctgttcgaggaagtcatgcggggaaagttcggcaaaaagcatatgatcgccggggtgctatttactttcgttctgctcctgtctggacagattacatggagagacatggcacacacccttataatgatcggctccaatgctagtgataggatgggtatgggggtgacgtatttggccctgattgcaacttttaaaatccagcccttcttagccctcggatttttcctgcgcaagcttaccagccgagagaacctgctactcggcgtcggcctggctatggcgacaaccttgcaactgccggaagacattgagcagatggccaatgggatcgcattaggactcatgactctgaaacttataacacagtttgaaacctaccagctgtggacagctttggtgtctctcacttgttccaacaccatcttcacgctgacagttgcctggcggaccgccactctaattctggctggtgtgtcacttctccctctgtgccaaagtagctcgatgcgtaagaccgattggttgccaatgacagtcgcagccatgggcgtaccccctctgcccttatttatcttctccctcaaggacactccaaaaagaaggtcttggcctctgaatgagggggtgatggcggttggacttgtgagcattctggcttcaagtttgctccgcaacgatgtccccatggccggcccactggtggcaggtgggctactgatcgcctgttatgtaataaccggaacgtccgctgaccttacagtggagaaggcagccgacgtcacctgggaagaggaagcggagcagactggcgtttctcataacctcatgattacagtggatgacgatggcaccatgcggatcaaagacgatgaaactgagaatatcctgacagtgttgttaaagaccgctctgctcattgtcagcgggatatttccgtactccatccctgccacgctgcttgtgtggcacacttggcagaaacagacccaaagatcaggagttctgtgggacgtacccagcccacccgagacacagaaggcagaattggaggaaggtgtgtacaggattaaacagcagggcatcttcgggaagacccaagtcggagtgggcgttcagaaggagggtgtgtttcatacaatgtggcacgtcactcgaggggccgtgctaacccacaacggaaaacgcctggagcctaattgggctagtgtaaagaaagatctcatttcttatggcggcgggtggcggctgtccacgcagtggcaaaagggagaagaggtccaggtgatcgccgttgaaccaggtaaaaaccccaagaatttccagacaatgcctggcatattccagactaccacaggggagatcggagcaattgctcttgactttaagccgggcaccagcggttcgccaatcattaacagagaagggaaagtggtcggattatacggcaatggcgtggttactaagaacgggggatatgtgtcaggtatcgcccaaaccaatgcggagcccgatggccctacaccagagctggaagaggaaatgttcaaaaagaggaacctcacgataatggacttgcatcccgggtctggaaaaactcgtaagtacctgcctgccattgtccgcgaggcaatcaagcggagactcaggaccctgatccttgctccgacacgagtggtagccgctgaaatggaggaggcactgaaaggcttgcccattcggtatcagaccactgccacaaagagtgaacacaccggtcgcgagatcgtggatctaatgtgccatgccacgtttactatgagactgctctccccagttagggtccctaattacaacttaataattatggacgaagctcacttcacagatcccgcgagcatcgcagcccgggggtatatttctacccgagtgggaatgggcgaggctgccgcaatctttatgaccgccactccacctggcacagctgaagcgttcccccagagcaatgccccaatacaggacgaggagagagacattccggaacgctcctggaactcagggaatgagtggatcaccgattttgtgggaaaaacagtctggttcgtacctagtatcaaggcaggtaacgacattgctaactgtctgaggaaaaatggcaagaaggtgatccaacttagccgtaaaacttttgatacggaataccagaagacccggctgaacgactgggatttcgttgtgacaactgacatttctgagatgggggccaattttaaagcagatagagtcatagaccccaggcgctgcctcaagccagtgatcttgaccgatggacccgagcgagttattctggccggccctatgccagtgacagctgcctccgcggcacagagacggggtagggtcgggcgcaacccccagaaagaaaatgaccaatacatcttcaccggccagcctctcaacaatgatgaggaccatgcccactggactgaagctaagatgctgcttgacaacatcaatacgccggagggaattataccagccctattcgaacccgagcgtgagaagtcagctgcaatcgatggcgaatatagactgaaaggggagagtcggaagacctttgtggaattgatgaggcgcggagacttacctgtatggctggcctacaaagtggctagcgagggtattaagtatacagatcgaaaatggtgcttcgacggcgaaagaaacaatcagatcctcgaggagaacatggatgttgaaatttggactaaggagggggaacggaaaaagctgaggccccgctggcttgacgccagaacctactccgatccactggcactcaaggagtttaaagacttcgcggccggaaggaagtctatcgctttggatctggtcacagaaataggccgggtgccttcgcacctagcccatcgtacccgcaatgcactggacaacctcgtgatgcttcacactagcgagcatggtgggcgagcttatagacacgccgtcgaggaactgcccgagacaatggaaacgttattgctgctcggcctgatgatccttctgaccggaggcgcaatgctctttttgatttcagggaaaggaatcggtaagactacaattggcctgatctgtgttatagtgtccagtgggatgttatggatggccgatattccactacagtggatcgcttctgcgattgtactggagttctttatgatggtgctccttatccctgagccggaaaaacaaaggaccccccaggacaatcagctggcctacgtcgtgataggaatcttgaccctggcagctattgttgccgccaacgagatgggcctcctggaaacaactaagcgggatcttggtatgagcaaggagccaggggtggtctcccctacgtcatatctcgacgtagacctgcaccccgcatctgcttggaccttgtacgccgtggcgacaactgttatcaccccaatgctgcgccatacaattgaaaatagcaccgctaacgtgagtttagccgcaatcgccaaccaagctgtcgtgctaatgggcctggataaaggatggcctatatccaagatggacctcggcgtcccccttctggcattggggtgctacagccaggtgaatccgctgactctcacggccgcggttctgcttttagtgacacactatgctattatcggaccaggcctgcaggccaaagcaaccagagaggcccagaagaggactgctgccggtatcatgaaaaaccctaccgtagatgggattatgacaatcgacctcgatcccgtgatatacgactctaagttcgagaagcaattgggacaggtcatgctgctagttctgtgtgcagtgcagctccttctgatgcggacttcatgggctttgtgcgaagccctgaccctcgcgacaggcccaattacgaccctgtgggagggttcccccggcaaattttggaatactacaatcgccgtcagtatggcaaacattttccgagggagctatttagctggagccggccttgcattttcgatcatgaagtctgtggggaccggaagacgcggcactggttcccagggggaaacactgggagagaaatggaagaaaaagctcaatcaactaagcaggaaggaattcgatctgtacaaaaagtcaggcataaccgaggtagaccggacggaggctaaagaaggtttgaagcgtggcgagaccacacatcacgccgtgagtagagggtctgccaaactgcagtggtttgttgaaaggaacatggtgatccctgagggacgcgtcattgatctcggctgtgggcggggaggctggtcctattactgcgcgggtcttaagaaagtgactgaagtccgagggtataccaagggaggcccgggccatgaggagcccgtgccaatgagcacatacgggtggaatatcgttaagctgatgtcaggaaaagacgtattctacttgcctcccgaaaagtgtgatactctgctctgcgacattggtgagagtagcccttccccaaccgtggaagagtctagaacaatcagggtcttaaaaatggtggagccctggctgaagaacaatcagttctgtattaaagttcttaacccttatatgccaaccgtgatcgaacacctggagcgcctacagcggaagtacggcgggatgctcgtcagaaatcccctgagccgtaactccactcacgaaatgtattggatatcaaatggaacgggcaacattgtgtctagtgtaaatatggtgtcgaggttgctgctcaaccggtttacaatgacccatcgccgaccgactatcgagaaggatgttgaccttggtgctgggaccagacacgtcaacgcagaacctgagacaccaaatatggacgtgatcggagagaggattaaacggataaaggaagagcatagctccacgtggcactacgatgacgaaaacccctataaaacctgggcctaccacggctcttatgaggtgaaggctactggctcagccagctccatgatcaatggggtcgttaaactgttaacaaagccttgggatgtggtaccaatggtgacccaaatggcaatgactgacacaacccccttcggacagcagcgcgtctttaaggaaaaagtggatacaagaactccgaggcctatgcccggtacccgaaaggttatggagattacggccgagtggctgtggcggaccttgggccgtaacaaaaagccaagactctgcacacgcgaagagttcactaaaaaggtgaggaccaatgctgcgatgggggccgtctttacagaagagaaccaatgggacagtgcacgggctgccgtggaagatgaggagttctggaagctggtagacagagaacgcgagctacataaacttggaaagtgtggctcttgcgtttacaatatgatgggtaaaagggaaaagaaactgggggagtttggaaaggcaaaaggcagccgagccatctggtacatgtggctcggcgctcggttcctggagtttgaagccttggggttcctgaacgaggatcactggttttcaagagaaaattcctatagtggagtggagggtgaaggcctccataagcttgggtacattctgagggacatcagcaagatacctggaggcgcgatgtatgcagatgacactgccggttgggacacccgcatcacggaggatgacttacacaacgaggaaaaaattacacagcagatggatcccgagcatcgtcagctggctaatgccatcttcaagttgacctaccaaaacaaagtcgtgaaggtgcagcggccaactcccaaagggacagtcatggacattatctctagaaaggatcagaggggatccggccaggttggcacctatgggctcaatacttttaccaacatggaagcacaactggtgcgccagatggagggagaaggtgtactatcaaaggctgaccttgagaatcctcacctgctcgagaaaaagataacacagtggctggaaaacaaaggcgtggagcgattgaagcggatggccattagcggggatgactgcgtcgtgaaaccaatcgatgacagattcgctaacgccttactggcactcaatgatatgggaaaggttaggaaggacatcccgcagtggcaaccctcgaaaggctggcacgattggcagcaggtgcctttctgttctcatcactttcatgaacttattatgaaggacggtcgcaaactggtcgtgccatgcagaccccaggacgagctaatagggcgggcgaggatcagtcaaggagccggctggtccctgaaggaaacggcttgtctcggcaaagcctacgcacagatgtggagcttgatgtatttccaccgtcgagatctgcgccttgcttcaaacgccatttgctccgcagtacctgttcactgggtgccaacctctagaactacatggagcatccatgcccaccatcagtggatgaccactgaggacatgctggcggtctggaatcgggtgtggattgaggataacccctggatggaagacaagacacctgttaccacgtgggaggatgtgccgtacctcgggaagagggaagaccaatggtgtggaagtttaatcggtctgacatcccgcgctacctgggcccagaatatattgactgcaatccagcaggtcagaagcctgattggcgatgaggagtttctcgactacatgccatctatgaaacggttcaggaaggaagaggaatcagagggggccatctggtga

SEQ ID NO: 15231 - RNA, 9873 nt, synthetic construct
  misc_feature 1..9873: note = derived and/or modified CDS sequence (opt3) from DENV-3__FJ639721__SS-prME
  source 1..9873: mol_type = other RNA
accagcctgtgcctcatgatgatgcttcccgccacactggctttccacttgacttccagggacggcgaacctaggatgatcgtggggaagaacgaacggggaaagtctttactgtttaagacggcaaccggtattaatatgtgtacactaatagccatggatctcggcgaaatgtgcgacgatactgtcacctacaaatgtccactgatcgttgaagtggaaccggaagacattgattgctggtgtaaccttacatcaacctgggtaacttatgggacatgcaatcaggcgggagagcaccgccgagacaagcgtagtgtggctctggcaccccacgtcggcatgggtttggataccagaacgcagacttggatgagcgcagagggggcctggagacaggtggaaaaagttgagacctgggctctccggcatcctggattcacaatcctggcactgtttctcgcccactacattggcacttccttaatccagaaggtggtcatattcatcctgcttatgttggtgaccccatctatgacaatgcgctgtgtaggcgttgggaacagagactttgtggaaggactgtcgggtgctacctgggtcgatgtggtgctagagcatggcgggtgcgtcacgactatggccaagaataaacccacactcgacattgagctgcagaagaccgaagcgactcagcttgcaacactgaggaaattgtgtatcgagggaaagattaccaacatcacgaccgattcacggtgccctacacagggcgaagccatactcccagaggaacaggaccagaattatgtttgtaaacacacttacgtggatcgcggttgggggaacggatgcggcctgttcggcaaggggagcttagtaacctgcgctaagtttcaatgtctggagcccattgagggaaaagtggtccagtatgaaaatctcaagtacacagtgatcattactgttcacaccggtgaccagcatcaggtgggcaacgacacacaaggggtcaccgtggagatcactcctcaggccagtacggtagaagcagttcttccagagtatggaacactgggcttggaatgctccccgcgaaccggtctagatttcaatgagatgatcctgctcactatgaaaaacaaggcttggatggtgcacagacagtggtttttcgacctgccccttccttggacctctggggccacaaccgagactccaacatggaataggaaagaactgttggtcacgtttaagaacgcgcatgccaaaaagcaagaggtggtcgtgctcggcagccaggaaggagcaatgcacaccgctctgactggcgccacagagattcaaaattccgggggaacctcaatattcgctggtcacttaaagtgtcggctgaaaatggataagctagaactcaaaggcatgagttacgccatgtgcctgaacacatttgttcttaagaaagaggtgagcgagactcagcatgggaccatcttgattaaggtagaatacaagggagaggacgcaccctgtaaaatccctttctctacggaagatggccaaggtaaggcccacaacgggcgtctgataaccgctaatccagtcgtgaccaagaaggaggagcccgttaacattgaagcggagccgcctttcggcgaatccaatatcgtgatcggaattggcgacaaagcactcaagatcaactggtataagaaagggtcaagcattggaaagatgtttgaggccactgctcgcggtgccagaaggatggcaatactgggcgataccgcctgggacttcgggagtgtcggaggcgtgcttaattctctgggtaaaatggtacatcagatctttgggtccgcttacacagccttgttcagcggcgtgtcgtggattatgaagatcggaatcggcgttctcctgacttggattgggttaaactctaaaaatacctccatgtcatttagttgcatagtcatcggaattatcacgctgtatctaggcgcagtggtgcaggcggatatgggttgtgtcattaactggaaggggaaggaactcaaatgcggaagcggcatcttcgttacaaatgaggtgcacacctggactgagcagtacaagtttcaagctgactcccccaaacggctggccacagcaatagccggtgcttgggaaaacggcgtgtgtgggatccgatctaccactcgcatggagaatcttttgtggaagcagattgccaacgaactgaattatatcctctgggagaacaatattaaactgaccgtagtcgtgggagatatcataggcgttttagaacaggggaagagaacactgacgccacagcctatggagcttaaatacagctggaagacctggggaaaggcaaaaattgtgactgctgagacacaaaactcaagtttcatcattgacggccccaacaccccagaatgcccctccgccagcagggcgtggaatgtctgggaggtggaagactatggttttggggttttcacaactaacatctggttgaagctccgggaggtgtacacccagtcttgtgatcatcgcctgatgtcagccgctataaaagacgaaagagcagtacacgccgatatgggatactggatcgagagtcagaagaatggcagctggaaactagagaaggcttcctttattgaagtcaagacgtgcacatggcctaaatctcacaccctgtggtcgaacggtgtgctcgagagcgacatgatcattccaaagtccctggccggcccgatctcacagcataatcacaggcccgggtatcatactcaaaccgcaggaccttggcaccttggcaaattggaactggatttcaactactgcgaggggacaactgtggtcataaccgagaattgtggaacacgtggcccaagtttacggacgaccactgtttctggtaagctcattcacgaatggtgctgtcgaagctgcacactgccccctcttagatatatgggggaggacggatgttggtacggcatggaaatcaggccaatcaacgagaaagaagagaatatggtgaagtccctggtatcagcgggtagcggcaaggtggataactttaccatgggggtcttgtgcctcgccattctgttcgaggaagtgatgcgcggaaaattcggcaagaaacatatgatcgctggggttctatttactttcgtgctgctcctgtctggacagattacatggcgggacatggcccacacccttataatgatcggctccaatgcaagtgatagaatgggtatgggggtcacgtatttggctctgattgccacttttaagatccagcccttcttaaccctcggatttttcctgaggaaacttacaagccgcgagaacctgctactcggcgtgggcctggcaatggccaccactttgcaactgccggaagacattgagcagatggctaatgggatcgcgttaggactcatgacactgaaacttataacccagtttgaaacataccagctgtggactgccttggtttctctcacctgttccaacacgatcttcacactgaccgtggcatggcgaactgctaccctaattctggccggtgtctcacttctccctctgtgccaaagtagctcgatgcggaagacagattggttgccaatgactgtagccgctatgggcgtgccccctctgcccttatttatcttctccctcaaagacgcaccaaagcgtagatcttggcctctgaatgagggggttatggccgtgggacttgtcagcattctggcgtcaagtttgctcaggaacgatgtgcccatggctggcccactggtagccggtgggctactgatcgcatgttatgtgataaccggaacgtccgccgaccttacagtcgagaaagctgcagacgttacctgggaagaggaagccgagcagactggcgtgtctcataacctcatgattacagtggatgacgatggcaccatgcgcatcaaggacgatgaaactgagaatatcctgacagtcttgttaaaaaccgcgctgctcattgtgagcgggatatttccgtactccatccctgctacgctgcttgtttggcacacttggcagaagcagacccaacggtcaggagtactgtgggacgtgcccagcccacccgagacacagaaagccgaattggaggaaggtgtctacagaattaagcagcagggcatcttcgggaagacccaagtgggagttggcgtgcagaaagagggtgtctttcatacaatgtggcacgtgactcgaggggccgtactaacccacaacggaaagaggctggagcctaattgggccagtgtcaaaaaggatctcatttcttatggcggcgggtggcgcctgtccacgcagtggcaaaaaggagaagaggtgcaggttatcgctgtggaaccaggtaagaaccccaagaatttccagacaatgcctggcatattccagactaccacaggggagatcggagccattgcacttgactttaaaccgggcaccagcggttcgccaatcattaaccgggaagggaaggtcgtgggattatacggcaatggcgttgtgactaaaaacgggggatatgtctcaggtatcgctcaaaccaatgccgagcccgatggccctacaccagagctggaagaggaaatgttcaagaaaagaaacctcacgataatggacttgcatcccgggtctggaaagactaggaagtacctgcctgcgattgtgcgtgaggccatcaaacgccggctcagaaccctgatccttgcaccgacaagggtagtggctgccgaaatggaggaggctctgaagggcttgcccattcgatatcagaccactgcaacaaaaagtgaacacaccggtcgggagatcgttgatctaatgtgccatgccacgtttactatgcgcctgctctccccagtcagagtgcctaattacaacttaataattatggacgaagcccacttcacagatcccgctagcatcgcggcaagggggtatatttctacccgggtgggaatgggcgaggccgctgccatctttatgaccgcaactccacctggcacagccgaggctttcccccagagcaatgcgccaatacaggacgaggagcgagacattccggaaagatcctggaactcagggaatgagtggatcaccgattttgtcggaaagacagtatggttcgtgcctagtatcaaagccggtaacgacattgcaaactgtctgcgcaagaatggcaagaaagttatccaacttagcaggaagacttttgatacggaataccagaaaacccgtctgaacgactgggatttcgtggtcacaactgacatttctgagatgggggctaattttaaggccgatcgggtgatagaccccagaaggtgcctcaaaccagttatcttgaccgatggacccgagcgcgtgattctggcaggccctatgccagtcacagccgcttccgccgcgcagcgaagaggtcgggtggggaggaacccccagaaggaaaatgaccaatacatcttcaccggccagcctctcaacaatgatgaggaccatgcacactggactgaagccaagatgctgcttgacaacatcaatacgccggagggaattataccagctctattcgaacccgagcgcgagaaatcagccgctatcgatggcgaatatcgtctgaagggggagagtagaaaaacctttgtagaattgatgcggaggggagacttacctgtgtggctggcacacaaggttgccagcgagggtattaaatacacagatcgcaagtggtgcttcgacggcgaacgaaacaatcagatcctcgaggagaacatggatgtcgaaatttggactaaagagggggaaagaaagaagctgcggcccaggtggcttgacgctcgcacctattccgatccactggccctcaaagagtttaaggacttcgcagcgggaagaaaatctatcgccttggatctggtgacagaaataggcagggtgccttcgcatctagctcaccggacccgtaatgccctggacaacctcgtcatgcttcatactagcgagcacggtgggcgcgcataccgacacgctgttgaggaactgcccgagacaatggaaacgttattgctgctcggcctgatgatccttctgaccggaggcgccatgctctttttggtgtcagggaagggaattggtaaaactacaatcggcctgatttgtgtaatcgtgtccagtgggatgttatggatggcagatataccactacagtggattgcctctgctatcgtcctggagttctttatgatggtgctccttattcctgagccggaaaagcaaagaacaccccaggacaatcagctggcgtatgttgtgatcggaatattgaccctggccgcaatcgtcgctgccaacgagatgggcctcctggaaacaactaagagggatcttggtatgagcaaagagccaggggtagtgtcccctacgtcatacctcgacgttgacctgcatcccgcctctgcatggaccttgtatgctgtggccacaactgtcattaccccaatgctgcggcacacaatcgaaaatagcaccgcgaacgtgagtttagctgccattgcaaaccaagccgtcgtgctaatgggcctggataagggatggcctatctccaaaatggacctcggcgttccccttctggctttggggtgctacagccaggtgaatccgctgactctcacggcagccgtactgcttttagtgacacattacgcgataattggaccaggcctgcaggctaaggccacccgcgaggcacagaaaagaactgccgctggtatcatgaagaaccctaccgtcgatgggatcatgacaattgacctcgatcccgttatctatgactctaagttcgagaaacaattgggacaggtgatgctgctagtcctgtgtgccgtgcagctccttctgatgaggacttcatgggcattgtgcgaagctctgaccctcgccacaggcccaataacgaccctgtgggagggttcccccggcaagttttggaatactacaattgcggtaagtatggccaacatcttccgggggagctacttagcaggagctggccttgccttttcgattatgaaatctgtggggaccggacgaagaggcactggttcccagggggaaacactgggagagaagtggaaaaagaagctcaatcaactaagccgcaaagagttcgatctgtataagaaatcaggcatcaccgaggttgacaggacggaggcaaaggaaggtttgaaacggggcgagaccacacaccatgctgtgagtcgtgggtctgccaagctgcagtggtttgtcgaaagaaacatggtgatacctgagggaagggtcatcgatctcggctgtgggcgcggaggctggtcctactattgcgccggtcttaaaaaggtgactgaagttcgggggtacaccaagggaggcccgggccacgaggagcccgtaccaatgagcacatatgggtggaatattgtgaaactgatgtcaggaaaggacgtcttctacttgcctcccgaaaaatgtgatactctgctctgcgacatcggtgagagtagcccttccccaaccgtggaagagtctcgaacaattagagttttaaagatggtggagccctggctgaaaaacaatcagttctgtatcaaggtccttaacccttacatgccaaccgtgattgaacacctggagaggctacagcgcaagtatggcgggatgctcgtacggaatcccctgagcagaaactccactcatgaaatgtactggatctcaaatggaacgggcaacatagtgtctagtgttaatatggtctcgcgtttgctgctcaacaggtttacaatgacccaccggcgcccgactattgagaaagatgtggaccttggtgcggggacccgacatgtgaacgctgaacctgagacaccaaatatggacgtcatcggagagagaatcaagaggattaaagaagaacacagctccacgtggcactatgatgacgaaaacccctacaagacctgggcatatcatggctcttacgaggttaaagccactggctcagctagctccatgataaatggggtggtaaagctgttaacaaagccttgggatgtggtcccaatggtgacccaaatggccatgactgacacaacccccttcggacagcagcgggtttttaaagaaaaggtggatacacgcactccgagacctatgcccggtaccaggaaagtcatggagatcacggcagagtggctgtggcgaaccttgggccggaacaagaaaccacgtctctgcacaagagaagagttcactaagaaggtgcgcaccaatgccgctatgggggcggtatttacagaagagaaccaatgggacagtgccagggcagctgttgaagatgaggagttctggaaactggtggaccgggaaagagagctacacaaacttggaaaatgtggctcttgcgtctataatatgatgggtaagcgcgagaagaagctgggggagtttggaaaagccaagggcagcagggcaatttggtacatgtggctcggcgcccgattcctggagtttgaggctttggggttcctgaacgaggatcattggttttcacgggaaaattcctacagtggagtggagggtgaaggcctccacaaacttgggtatatcctgagagacattagcaaaatccctggaggcgccatgtacgcggatgacactgcaggttgggacaccaggataacggaggatgacttacataacgaggaaaagatcacacagcagatggatcccgagcaccgccagctggccaatgctattttcaaattgacctatcaaaacaaggtggtcaaagttcagcgtccaactcccaaggggacagtgatggacatcatttctcggaaggatcagagaggatccggccaggtaggcacctacgggctcaatacttttaccaacatggaagcccaactggtgaggcagatggagggagaaggtgtcctatcaaaaacagaccttgagaatcctcatctgctcgagaagaaaatcacgcagtggctggaaaacaagggcgtggagcgcttgaaacgaatggcaataagcggggatgactgcgttgtgaagccaattgatgaccggttcgctaacgccttactggctctcaatgatatgggaaaggtcagaaaagacatcccgcagtggcaaccctcgaagggctggcatgattggcaacaggtgcctttctgttctcaccattttcacgaacttatcatgaaagacggtaggaagctggtagttccatgccgcccccaggacgagctaattgggagagcccggataagtcaaggagcaggctggtccctgaaagaaaccgcgtgtctcggcaaggcctatgctcagatgtggagcttgatgtacttccacaggcgtgatctgcgacttgcctcaaacgcaatctgctccgctgtgcctgtccattgggtgccaacttctcgcacaacctggagcattcacgcccatcaccagtggatgactacagaggacatgctgaccgtttggaatagagtgtggatcgaggataacccctggatggaagacaagacgcctgtcacaacctgggaggatgtgccgtatctcgggaaacgggaagaccaatggtgtggaagtttaattggtctgacttccagggcaacctgggcccagaatatcttgacagcgatacagcaggtacgcagcctgatcggcgatgaggagtttctcgactacatgccatctatgaagagattccggaaagaagaggaatcagagggggctatttggtga

SEQ ID NO: 15232 - RNA, 9873 nt, synthetic construct
  misc_feature 1..9873: note = derived and/or modified CDS sequence (opt3) from DENV-3__FJ639722__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcaaccggtattaatatgtgtacactaatagccatggatctcggcgagatgtgcgacgatactgtcacctacaaatgtccactgatcgcggaagttgagccggaagacattgattgctggtgtaaccttacatcaacctgggtgacttatgggacatgcaatcaggctggagagcatcgccgagacaagcgtagtgtagccctggcaccccacgtgggcatgggtttggataccagaacgcaaacttggatgagcgccgagggggcttggaggcaggtcgaaaaagtggagacctgggcactccggcatcctggattcacaatcctggccctgtttctcgctcactacattggcacttccttaatccagaaggttgtgatattcatcctgcttatgttggtcaccccatctatgacaatgcgctgtgtgggcgtagggaacagagactttgttgaaggactgtcgggtgccacctgggtggatgtcgtgctagagcatggcgggtgcgtgacgactatggcgaagaataaacccacactcgacattgagctgcagaagaccgaagcaactcaacttgccacactgaggaaattgtgtatcgagggaaagattaccaacatcacgaccgattcacggtgccctacacagggcgaagctatactcccagaggaacaggaccagaattatgtctgtaaacacacttacgttgatcgcggttgggggaacggatgcggcctgttcggcaaggggagcttagtgacctgcgccaagtttcaatgtctggagcccattgagggaaaagtagtgcagtatgaaaatctcaagtacacagtcatcattactgtgcacaccggtgaccagcatcaggttggcaacgacacacaaggggtgaccgtcgagatcactcctcaggcaagtacggtggaagctgtacttccagagtatggaacactgggcttggaatgctccccgcgaaccggtctagatttcaatgagatgatcctgctcactatgaaaaacaaggcctggatggttcacagacagtggtttttcgacctgccccttccttggacctctggggcgacaaccgagactccaacatggaataggaaagaactgttggtgacgtttaagaacgcccatgcaaaaaagcaagaggtcgtggtcctcggcagccaggaaggagctatgcacaccgccctgactggcgctacagagattcagaattccgggggaacctcaatattcgccggtcacttaaagtgtcggctgaaaatggataagctagaactcaaaggcatgagttacgcaatgtgcctgaacacatttgtgcttaagaaagaggttagcgagactcagcatgggaccatcttgattaaggtggaatacaagggagaggacgccccctgtaaaatccctttctctacggaagatggccaaggtaaggctcacaacgggcgtctgataaccgcgaatccagtagtcacaaaaaaggaggagcccgtgaacattgaagcagagccgcctttcggcgaatccaatatcgttatcggaattggcgagaaagccctcaagatcaactggtataagaaagggtcaagcattggaaagatgtttgaagctactgcccgcggtgcaagaaggatggccatactgggcgacaccgcttgggatttcgggagtgtgggaggcgtccttaattctctgggtaaaatggtgcatcagatctttgggtccgcctacacagcattgttcagcggcgtatcgtggattatgaagatcggaatcggcgtgctcctgacttggattgggttaaactctaaaaatacctccatgtcatttagttgcatagttatcggaattatcacgctgtatctaggcgcggtcgtgcaggctgacatgggttgtgtgattaactggaaggggaaggagctcaaatgcggaagcggcatcttcgtcacaaatgaggttcacacctggactgaacagtacaagtttcaagccgattcccccaaacggctggcaacagccatagctggtgcctgggagaacggcgtgtgtgggatccgatctaccactcgcatggaaaatcttttgtggaagcagattgcaaacgagctgaattatatcctctgggaaaacaatattaaactgaccgtggtagtcggagacatcataggcgtgttagagcaggggaagagaacactgacgccacagcctatggagcttaaatacagctggaagacctggggaaaggctaaaattgttactgccgaaacacaaaactcaagtttcatcattgatggccccaacaccccagagtgcccctccgcgagcagggcctggaatgtgtgggaagtcgaggactatggttttggggtgttcacaactaacatctggttgaagctccgggaagtttacacccagtcttgtgaccatcgcctgatgtcagctgcaataaaagatgagagagccgtgcacgctgacatgggatactggatcgagagtcagaagaatggcagctggaaactagaaaaggcctcctttattgaggtaaagacgtgcacatggcctaaatctcacaccctgtggtcgaacggtgtcctcgaaagcgatatgatcattccaaagtccctggcaggcccgatctcacagcataatcacaggcccgggtatcatactcaaaccgcgggaccttggcaccttggcaaattggagctggacttcaactactgcgaggggacaactgtggtgataaccgaaaattgtggaacacgtggcccaagtttacggacgaccactgtctctggtaagctcattcacgagtggtgctgtcgaagctgcacactgccccctcttagatatatgggggaagatggatgttggtacggcatggagatcaggccaatcaacgaaaaagaggagaatatggttaagtccctggtgtcagccggtagcggcaaggtagacaactttaccatgggggtgttgtgcctcgctattctgttcgaagaggtcatgcgcggaaaattcggcaagaaacatatgatcgccggggtgctatttactttcgttctgctcctgtctggacagattacatggcgggatatggcacacacccttataatgatcggctccaatgctagtgacagaatgggtatgggggtgacgtatttggccctgattgcaacttttaagatccagcccttcttagccctcggatttttcctgaggaaacttaccagccgcgaaaacctgctactcggcgtcggcctggctatggcgacaaccttgcaactgccggaggatattgaacagatggccaatgggatcgcattaggactcatgactctgaagcttataacacagtttgagacctaccagctgtggacagctttggtgtctctcacttgttccaacaccatcttcacgctgacagttgcctggcgaaccgccactctaattctggctggtgtgtcacttctccctctgtgccaaagtagctcgatgcggaagaccgactggttgccaatgacagtcgcagccatgggcgtaccccctctgcccttatttatcttctccctcaaagatgcgccaaagcgtagatcttggcctctgaatgagggggtgatggctgttggacttgtgagcattctggcctcaagtttgctcaggaacgacgtccccatggcaggcccactggtggccggtgggctactgatcgcttgttatgtaataactggaacctccgcagatcttacggtggaaaaagccgcggacgtcacatgggaggaagaggctgaacagaccggcgtttctcataacctcatgattactgtggacgatgacggcacaatgcgcatcaaggatgacgagaccgagaatatcctgactgtgttgttaaaaacagccctgctcattgtcagcgggatatttccgtactccatccctgcaaccctgcttgtgtggcacacgtggcagaagcagactcaacggtcaggagttctgtgggatgtacccagcccacccgaaacccagaaagccgagttggaagagggtgtgtacagaattaagcagcagggcatcttcgggaagacacaagtcggagtgggcgttcagaaagagggtgtgtttcataccatgtggcacgtcacaaggggggctgtgctaactcacaacggaaagcgactggaacctaattgggccagtgtaaaaaaggacctcatttcttatggcggcgggtggcgcctgtccacccagtggcaaaaaggagaggaagtccaggtgatcgcagttgagccaggtaagaaccccaagaatttccagacgatgcctggcatattccagacaactaccggggaaatcggagctattgcccttgattttaaaccgggcacaagcggttcgccaatcattaaccgggaggggaaggtggtcggattatacggcaatggcgtggttaccaaaaacgggggatatgtgtcaggtatcgcgcaaactaatgccgagcccgacggccctaccccagaactggaggaagagatgttcaagaaaagaaacctcacaataatggatttgcatcccgggtctggaaagacgaggaagtacctgcctgcaattgtccgtgaagctatcaaacgccggctcagaactctgatccttgccccgaccagggtggtagctgcagagatggaggaagccctgaagggcttgcccattcgatatcagacaaccgccactaaaagtgagcacacaggtcgggaaatcgtggacctaatgtgccatgctacctttacgatgcgcctgctctccccagttagagtccctaattacaacttaataattatggatgaggcgcacttcactgaccccgcaagcatcgccgctagggggtatatttctacacgggtgggaatgggcgaagccgcagccatctttatgaccgctaccccacctggcactgcggaggccttcccccagagcaatgcaccaatacaggatgaggaacgagacattccggagagatcctggaactcagggaatgaatggatcacagactttgtgggaaagaccgtctggttcgtacctagtatcaaagctggtaacgatattgccaactgtctgcgcaagaatggcaagaaagtgatccaacttagcaggaagacatttgacactgagtaccagaaaacgcgtctgaacgattgggacttcgttgtgaccacagatatttctgagatgggggcaaattttaaggccgaccgggtcatagatcccagaaggtgcctcaaaccagtgatcttgactgacggacccgaacgcgttattctggctggccctatgccagtgaccgccgcgtccgcagcccagcgaagaggtcgggtcgggaggaacccccagaaggagaatgatcaatacatcttcacaggccagcctctcaacaatgacgaagatcatgctcactggaccgaggccaagatgctgcttgacaacatcaatactccggaaggaattataccagctctattcgagcccgagcgcgaaaaatcagcagccatcgacggcgagtatcgtctgaagggggaaagtagaaaaacgtttgtggagttgatgcggaggggagatttacctgtatggctggctcacaaggtggccagcgaaggtattaaatacaccgaccgcaagtggtgcttcgatggcgagcgaaacaatcagatcctcgaggaaaacatggacgttgagatttggacaaaagaaggggagagaaagaagctgcggcccaggtggcttgatgcacgcacttattccgacccactggcgctcaaagaatttaaggatttcgccgctggaagaaaatctatcgccttggacctggtcaccgagataggcagggtgccttcgcatctagcacaccggacacgtaatgctctggataacctcgtgatgcttcataccagcgagcacggtgggcgcgcctaccgacacgcagtcgaagagctgcccgaaactatggagacattattgctgctcggcctgatgatccttctgacgggaggcgccatgctctttttggtttcagggaagggaattggtaaaaccactatcggcctgatttgtgtgatcgtatccagtgggatgttatggatggctgacataccactacagtggattgcgtctgccatcgtgctggagttctttatgatggtcctccttattcctgaaccggagaagcaaagaacaccccaggataatcagctggcatatgtggttatcggaatattgaccctggctgccatcgtggccgcaaacgaaatgggcctcctggagaccacaaagagggaccttggtatgagcaaagaaccaggggtcgtatcccctacttcatacctcgatgtggacctgcatcccgcttctgcctggacgttgtatgcggttgctaccacagtgattactccaatgctgcggcacaccatcgagaatagcacagccaacgtcagtttagcagccattgctaaccaagcagtggtcctaatgggcctggacaagggatggcctatctccaaaatggatctcggcgtgccccttctggccttggggtgctacagccaggttaatccgctgaccctcactgcggctgtgctgcttttagtaacgcattacgccataattggaccaggcctgcaggcaaaggccacacgcgaggctcagaaaagaaccgccgcaggtatcatgaagaaccctactgtggacgggatcatgaccattgatctcgaccccgtcatctatgattctaagttcgaaaaacaattgggacaggttatgctgctagtgctgtgtgctgtccagctccttctgatgaggacatcatgggccttgtgcgaggcgctgactctcgccaccggcccaataacaacgctgtgggaaggttcccccggcaagttttggaataccactattgcagtgagtatggctaacatcttccgggggagctacttagccggagcaggccttgctttttcgattatgaaatctgtagggacaggacgaagaggcaccggttcccagggggagactctgggagaaaagtggaaaaagaagctcaatcaactaagccgcaaagagttcgacctgtataagaaatcaggcatcacagaggtggataggaccgaagccaaggagggtttgaaacggggcgaaacgacccaccatgccgttagtcgtgggtctgcgaagctgcagtggtttgtggagagaaacatggtcatacctgaaggaagggtgatcgacctcggctgtgggcgcggaggctggtcctactattgcgctggtcttaaaaaggtcacagaggtgcgggggtacactaagggaggcccgggccacgaggaacccgttccaatgagcacctatgggtggaatattgtaaaactgatgtcaggaaaggatgtgttctacttgcctcccgagaaatgtgacacactgctctgcgatatcggtgaaagtagcccttccccaactgtcgaggagtctcgaaccattagagtgttaaagatggttgaaccctggctgaaaaacaatcagttctgtatcaaggtgcttaacccttacatgccaacagtcattgagcacctggaaaggctacagcgcaagtatggcgggatgctcgtgcggaatcccctgagcagaaactccacccatgagatgtactggatctcaaatggaactggcaacatagtatctagtgtgaatatggtttcgcgtttgctgctcaacaggtttacgatgacacaccggcgcccgaccattgaaaaagacgtcgatcttggtgcagggactcgacatgtgaacgccgagcctgagaccccaaatatggacgtgatcggagaaagaatcaagaggattaaagaggaacacagctccacatggcactatgacgatgagaacccctacaagacgtgggcttatcatggctcttacgaagtcaaagccaccggctcagcaagctccatgataaatggggttgtgaagctgttaactaagccttgggacgtagtgccaatggtcacacaaatggccatgaccgatactacacccttcggacagcagcgggtgtttaaagagaaggttgacacccgcacaccgagacctatgcccggtactaggaaagtgatggagatcaccgctgaatggctgtggcgaacgttgggccggaacaagaaaccacgtctctgcaccagagaggaattcacaaagaaggtccgcactaatgcggccatgggggcagtgtttaccgaggaaaaccaatgggatagtgctagggccgcagtagaggacgaggaattctggaaactggttgatcgggagagagaactacacaagcttggaaaatgtggctcttgcgtgtataatatgatgggtaagcgcgagaaaaagctgggggagtttggaaaagccaagggcagcagggctatttggtacatgtggctcggcgcccgattcctggaatttgaggcgttggggttcctgaacgaagaccattggttttcacgggagaattcctacagtggagtcgaaggtgagggcctccacaagcttgggtatatcctgagagatattagcaaaatccctggaggcgcaatgtacgccgacgatacagctggttgggacactaggataaccgaggacgatttacataacgaagagaagatcacgcagcagatggaccccgaacaccgccagctggccaatgcaattttcaaattgacatatcaaaacaaggtggtgaaagtccagcgtccaacccccaaggggactgttatggatatcatttctcggaaggaccagagaggatccggccaggtgggcacatacgggctcaatacctttactaacatggaggctcaactggtaaggcagatggaaggagagggtgtgctatcaaaaaccgatcttgagaatcctcacctgctcgaaaagaaaatcacacagtggctggagaacaagggcgtcgaacgcttgaaacgaatggccataagcggggacgattgcgtggttaagccaattgacgatcggttcgctaacgccttactggcactcaatgacatgggaaaggtgagaaaagatatcccgcagtggcaaccctcgaagggctggcatgactggcagcaggtccctttctgttctcaccattttcacgagcttatcatgaaagatggtaggaagctggtggtaccatgccgcccccaggacgaactaattgggagagcgcggataagtcaaggagccggctggtccctgaaagagacggcttgtctcggcaaggcctatgcacagatgtggagcttgatgtacttccacaggcgtgacctgcgacttgcttcaaacgccatctgctccgcagttcctgtgcattgggtcccaacctctcgcactacatggagcattcacgcccatcaccagtggatgaccactgaggatatgctgacagtgtggaatagagtttggatcgaagacaacccctggatggaggataagacccctgtgacgacatgggaagacgtcccgtatctcgggaaacgggaggatcaatggtgtggaagtttaattggtctgacctccagggcgacttgggctcagaatatcttgaccgccatacagcaggtgcgcagcctgatcggcgacgaggaatttctcgattacatgccatctatgaagagattccggaaagaggaagagtcagaaggggcaatttggtga

SEQ ID NO: 15233 - RNA, 9873 nt, synthetic construct
  misc_feature 1..9873: note = derived and/or modified CDS sequence (opt3) from DENV-3__FJ639723__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcaaccggtattaatatgtgtacactaatagccatggatctcggcgagatgtgcgacgatactgtcacctacaaatgtccactgatcgcggaagttgagccggaagacattgattgctggtgtaaccttacatcagcttgggtgacctatgggacttgcaatcaggccggagagcatcgccgagacaagcgtagtgtagcactggccccccacgtgggcatgggtttggatacaagaacccaaacgtggatgagcgctgagggggcatggaggcaggtcgaaaaagtggagacttgggccctccggcatcctggattcaccatcctggctctgtttctcgcccactacattggcacatccttaatccagaaggttgtgatattcatcctgcttatgttggtcactccatctatgaccatgcgctgtgtgggcgtagggaacagagactttgttgaaggactgtcgggtgcgacatgggtggatgtcgtgctagagcatggcgggtgcgtgaccacgatggcaaagaataaacccactctcgacattgagctgcagaagacagaagccacccaacttgctactctgaggaaattgtgtatcgagggaaagattacaaacatcaccacggattcacggtgccctacccagggcgaagccatactcccagaggaacaggaccagaattatgtctgtaaacacacatacgttgatcgcggttgggggaacggatgcggcctgttcggcaaggggagcttagtgacttgcgcaaagtttcaatgtctggagcccattgagggaaaagtagtgcagtatgaaaatctcaagtacaccgtcatcattacagtgcacactggtgaccagcatcaggttggcaacgacacccaaggggtgacagtcgagatcacccctcaggctagtactgtggaagccgtacttccagagtatggaacgctgggcttggaatgctccccgcgaacaggtctagatttcaatgagatgatcctgctcaccatgaaaaacaaggcgtggatggttcacagacagtggtttttcgacctgccccttccttggacttctggggccaccacagagaccccaacttggaataggaaagaactgttggtgacatttaagaacgcacatgctaaaaagcaagaggtcgtggtcctcggcagccaggaaggagccatgcacacggctctgaccggcgccactgagattcagaattccgggggaacatcaatattcgcaggtcacttaaagtgtcggctgaaaatggataagctagaactcaaaggcatgagttacgccatgtgcctgaacacctttgtgcttcgtaaggaggttagcgagacacagcatgggactatcttgattaaagtggaatacaagggagaggacgctccctgtaagatccctttctctaccgaagatggccaaggtaaagcgcacaacgggcgcctgataacggcaaatccagtagtcaccaagaaagaggagcccgtgaacattgaagccgagccgcctttcggcgaatccaatatcgttatcggaattggcgacaaggctctcaaaatcaactggtataagaaggggtcaagcattggaaaaatgtttgaggccacagcaagaggtgccaggcggatggctatactgggcgatactgcctgggacttcgggagtgtgggaggcgtccttaattctctgggtaagatggtgcatcagatctttgggtccgcatacaccgcgttgttcagcggcgtatcgtggattatgaaaatcggaatcggcgtgctcctgacatggattgggttaaactctaagaatacttccatgtcatttagttgcatagttatcggaattatcaccctgtatctaggcgctgtcgtgcaggccgatatgggttgtgtgattaactggaaagggaaggaactcaagtgcggaagcggcatcttcgtcacgaatgaggttcacacatggaccgagcagtacaaatttcaagcagactcccccaagcgactggccactgctatagccggtgcatgggaaaacggcgtgtgtgggatccgctctacaaccagaatggagaatcttttgtggaaacagattgctaacgaactgaattatatcctctgggagaacaatattaagctgactgtggtagtcggagatatcataggcgtgttagaacaggggaaaaggaccctgacaccacagcctatggagcttaagtacagctggaaaacgtggggaaaggccaagattgttaccgcggagactcaaaactcaagtttcatcattgacggccccaacacaccagaatgcccctccgccagccgggcttggaatgtgtgggaggtcgaagactatggttttggggtgttcaccacaaacatctggttgaaactccgcgaggtttacactcagtcttgtgatcatagactgatgtcagcagccataaaggacgaaagggctgtgcacgccgatatgggatactggatcgagagtcagaaaaatggcagctggaagctagagaaagcatcctttattgaagtaaagacctgcacgtggcctaagtctcacacactgtggtcgaacggtgtcctcgagagcgacatgatcattccaaaatccctggcgggcccgatctcacagcataatcaccgtcccgggtatcatacccaaactgccggaccttggcaccttggcaagttggaactggatttcaactactgcgaggggaccacagtggtgataactgagaattgtggaacccggggcccaagtttacgaacaacgaccgtctctggtaaactcattcacgaatggtgctgtagaagctgcactctgccccctcttaggtatatgggggaggacggatgttggtacggcatggaaatccgcccaacaaacgagaaggaagagaatatggttaaatccctggtgtcagctggtagcggcaaggtagataactttaccatgggggtgttgtgcctcgccatcctgttcgaggaagtcatgcggggaaagttcggcaaaaagcatatgattgcaggggtgctatttactttcgttctgctcctgtctggacagatcacatggagagacatggctcacacccttattatgataggctccaatgccagtgataggatgggtatgggggtgacgtatttggcactgatcgccacttttaaaattcagcccttcttagctctcggatttttcctgcgcaagcttaccagccgagagaacctgctactcggcgtcggcctggcgatggccacaaccttgcaactgccggaagacatcgagcagatggcaaatgggattgctttaggactcatgactctgaaacttatcacacagtttgaaacctaccagctgtggacagccttggtgtctctcacttgttccaacaccatattcacgctgacagttgcctggcggaccgctactctaatcctggcaggtgtgtcacttctccctctgtgccaaagtagctcgatgcgtaagaccgattggttgccaatgacagtcgccgcgatgggcgtaccccctctgcccttatttattttctccctcaaggacactccaaaaagaaggtcttggcctctgaatgagggggtgatggctgttggacttgtgagcatcctggcctcaagtttgctccgcaacgatgtccccatggcaggcccactggtggccggtgggctactgattgcttgttatgtaatcaccggaacgtccgcagaccttacagtggagaaggccgcggacgtcacctgggaagaggaagctgagcagactggcgtttctcataacctcatgataacagtggatgacgatggcaccatgcggattaaagacgatgaaactgagaatatcctgacagtgttgttaaagaccgccctgctcatcgtcagcgggatttttccgtactccatacctgcaacgctgcttgtgtggcacacttggcagaaacagacccaaagatcaggagttctgtgggacgtacccagcccacccgagacacagaaggccgaattggaggaaggtgtgtacaggatcaaacagcagggcattttcgggaagacccaagtcggagtgggcgttcagaaggagggtgtgtttcatacaatgtggcacgtcactcgaggggctgtgctaacccacaacggaaaacgcctggagcctaattgggccagtgtaaagaaagatctcatctcttatggcggcgggtggcggctgtccacgcagtggcaaaagggagaagaggtccaggtgattgcagttgaaccaggtaaaaaccccaagaatttccagacaatgcctggcatcttccagactaccacaggggagataggagctatcgcccttgactttaagccgggcaccagcggttcgccaattatcaacagagaagggaaagtggtcggattatacggcaatggcgtggttactaagaacgggggatatgtgtcaggtattgcgcaaaccaatgccgagcccgatggccctacaccagagctggaagaggaaatgttcaaaaagaggaacctcacgatcatggacttgcatcccgggtctggaaaaactcgtaagtacctgcctgcaatagtccgcgaggctattaagcggagactcaggaccctgatccttgccccgacacgagtggtagctgcagaaatggaggaggccctgaaaggcttgcccatccggtatcagaccactgccacaaagagtgaacacaccggtcgcgagattgtggatctaatgtgccatgctacgtttactatgagactgctctccccagttagggtccctaattacaacttaatcataatggacgaagcgcacttcacagatcccgcaagcattgccgctcgggggtatatctctacccgagtgggaatgggcgaggccgcagccatttttatgaccgctactccacctggcacagcggaagccttcccccagagcaatgcaccaatccaggacgaggagagagacataccggaacgctcctggaactcagggaatgagtggattaccgattttgtgggaaaaacagtctggttcgtacctagtatcaaggctggtaacgacatcgccaactgtctgaggaaaaatggcaagaaggtgattcaacttagccgtaaaacttttgatacggaataccagaagacccggctgaacgactgggatttcgttgtgacaactgacatctctgagatgggggcaaattttaaagccgatagagtcattgaccccaggcgctgcctcaagccagtgatattgaccgatggacccgagcgagttatcctggctggccctatgccagtgacagccgcgtccgcagcccagagacggggtagggtcgggcgcaacccccagaaagaaaatgaccaatacattttcaccggccagcctctcaacaatgatgaggaccatgctcactggactgaagccaagatgctgcttgacaacatcaatacgccggagggaatcattccagctctattcgaacccgagcgtgagaagtcagcagccatagatggcgaatatagactgaaaggggagagtcggaagacctttgtggaattgatgaggcgcggagacttacctgtatggctggcttacaaagtggccagcgagggtatcaagtatacagatcgaaaatggtgcttcgacggcgaaagaaacaatcagattctcgaggagaacatggatgttgaaatctggactaaggagggggaacggaaaaagctgaggccccgctggcttgacgcaagaacctactccgatccactggcgctcaaggagtttaaagacttcgccgctggaaggaagtctattgccttggatctggtcacagaaatcggccgggtgccttcgcacctagcacatcgtacccgcaatgctctggacaacctcgtgatgcttcacactagcgagcatggtgggcgagcctatagacacgcagtcgaggaactgcccgagacaatggaaacgttattgctgctcggcctgatgatacttctgaccggaggcgccatgctctttttgatctcagggaaaggaattggtaagactacaatcggcctgatttgtgttatcgtgtccagtgggatgttatggatggctgatataccactacagtggattgcgtctgccatcgtactggagttctttatgatggtgctccttattcctgagccggaaaaacaaaggaccccccaggacaatcagctggcatacgtcgtgatcggaatattgaccctggctgccatcgttgccgcaaacgagatgggcctcctggaaacaactaagcgggatcttggtatgagcaaggagccaggggtggtctcccctacgtcatatctcgacgtagacctgcaccccgcttctgcctggaccttgtacgcggtggctacaactgttattaccccaatgctgcgccatacaatcgaaaatagcaccgccaacgtgagtttagcagccattgctaaccaagcagtcgtgctaatgggcctggataaaggatggcctatctccaagatggacctcggcgtcccccttctggccttggggtgctacagccaggtgaatccgctgactctcacggcggctgttctgcttttagtgacacactatgccataattggaccaggcctgcaggcaaaagccaccagagaggctcagaagaggactgccgcaggtatcatgaaaaaccctaccgtagatgggatcatgacaattgacctcgatcccgtgatctacgactctaagttcgagaagcaattgggacaggtcatgctgctagttctgtgtgctgtgcagctccttctgatgcggacttcatgggccttgtgcgaagcgctgaccctcgccacaggcccaataacgaccctgtgggagggttcccccggcaaattttggaatactacaattgcagtcagtatggctaacatcttccgagggagctatttagccggagcaggccttgctttttcgattatgaagtctgtggggaccggaagacgcggcactggttcccagggggaaacactgggagagaaatggaagaaaaagctcaatcaactaagcaggaaggaattcgatctgtacaaaaagtcaggcatcaccgaggtagaccggacggaggccaaagaaggtttgaagcgtggcgagaccacacatcacgccgtgagtagagggtctgcgaaactgcagtggtttgttgaaaggaacatggtgatacctgagggacgcgtcatcgatctcggctgtgggcggggaggctggtcctattactgcgctggtcttaagaaagtgactgaagtccgagggtataccaagggaggcccgggccatgaggagcccgtgccaatgagcacatacgggtggaatattgttaagctgatgtcaggaaaagacgtattctacttgcctcccgaaaagtgtgatactctgctctgcgacatcggtgagagtagcccttccccaaccgtggaagagtctagaacaattagggtcttaaaaatggtggagccctggctgaagaacaatcagttctgtatcaaagttcttaacccttatatgccaaccgtgattgaacacctggagcgcctacagcggaagtacggcgggatgctcgtcagaaatcccctgagccgtaactccactcacgaaatgtattggatctcaaatggaacgggcaacatagtgtctagtgtaaatatggtgtcgaggttgctgctcaaccggtttacaatgacccatcgccgaccgactattgagaaggatgttgaccttggtgcagggaccagacacgtcaacgccgaacctgagacaccaaatatggacgtgatcggagagaggatcaaacggattaaggaagagcatagctccacgtggcactacgatgacgaaaacccctataaaacctgggcttaccacggctcttatgaggtgaaggccactggctcagcaagctccatgataaatggggtcgttaaactgttaacaaagccttgggatgtggtaccaatggtgacccaaatggccatgactgacacaacccccttcggacagcagcgcgtctttaaggaaaaagtggatacaagaactccgaggcctatgcccggtacccgaaaggttatggagatcacggctgagtggctgtggcggaccttgggccgtaacaaaaagccaagactctgcacacgcgaagagttcactaaaaaggtgaggaccaatgcggccatgggggcagtctttacagaagagaaccaatgggacagtgctcgggccgcagtggaagatgaggagttctggaagctggtagacagagaacgcgagctacataaacttggaaagtgtggctcttgcgtttacaatatgatgggtaaaagggaaaagaaactgggggagtttggaaaggccaaaggcagccgagctatttggtacatgtggctcggcgcccggttcctggagtttgaagcgttggggttcctgaacgaggatcactggttttcaagagaaaattcctatagtggagtggagggtgaaggcctccataagcttgggtacatcctgagggacattagcaagatccctggaggcgcaatgtatgccgatgacactgctggttgggacacccgcataacggaggatgacttacacaacgaggaaaaaatcacacagcagatggatcccgagcatcgtcagctggccaatgcaattttcaagttgacctaccaaaacaaagtcgtgaaggtgcagcggccaactcccaaagggacagtcatggacatcatttctagaaaggatcagaggggatccggccaggttggcacctatgggctcaatacttttaccaacatggaagctcaactggtgcgccagatggagggagaaggtgtactatcaaaggccgaccttgagaatcctcacctgctcgagaaaaagatcacacagtggctggaaaacaaaggcgtggagcgattgaagcggatggctataagcggggatgactgcgtcgtgaaaccaattgatgacagattcgccaacgcattactggcgctcaatgatatgggaaaggttaggaaggacatcccgcagtggcaaccctcgaaaggctggcacgattggcagcaggtgcctttctgttctcatcactttcatgaacttatcatgaaggacggtcgcaaactggtcgtgccatgcagaccccaggacgagctaattgggcgggccaggataagtcaaggagctggctggtccctgaaggaaacggcctgtctcggcaaagcatacgctcagatgtggagcttgatgtatttccaccgtcgagatctgcgccttgcctcaaacgcaatctgctccgccgtacctgttcactgggtgccaacctctagaactacatggagcattcatgcgcaccatcagtggatgaccactgaggacatgctggctgtctggaatcgggtgtggatcgaggataacccctggatggaagacaagacacctgttaccacgtgggaggatgtgccgtacctcgggaagagggaagaccaatggtgtggaagtttaattggtctgacatcccgcgccacctgggcacagaatatcttgactgccatacagcaggtcagaagcctgatcggcgatgaggagtttctcgactacatgccatctatgaaacggttcaggaaggaagaggaatcagagggggctatttggtga

SEQ ID NO: 15234 - RNA, 9873 nt, synthetic construct
  misc_feature 1..9873: note = derived and/or modified CDS sequence (opt3) from DENV-3__FJ639724__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaacgggtggagacttgggcactccgccatcctggattcaccatcctggccctgtttctcgctcactacattggcacatctttaactcagaaagttgtgatcttcatactgcttatgttggtcaccccatcgatgacaatgagatgtgtgggcgtagggaacagggactttgttgaaggactgtcaggtgccacctgggtggatgtcgtgctagagcatggcgggtgcgtgacgactatggcgaagagcaagcccacactcgacatcgagctgcagaaaaccgaagcaactcaacttgccacactgcggaagttgtgtattgagggaaaaatcaccaatattacgaccgatagtcgctgccctacacagggcgaagctactctcccagaggaacaggaccagaactatgtctgtaagcacacctacgttgatcgaggttgggggaatggatgcggcctgttcggcaaagggtccttagtgacatgcgccaagtttcaatgtctggagcccatcgagggaaaggtagtgcagtatgaaaacctcaaatacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgagaactggtctagatttcaacgagatgattctgctcaccatgaagaataaagcctggatggttcacaggcagtggtttttcgacctgccccttccttggacatccggggcgaccactgagacaccaacgtggaaccggaaggaactgttggtgacctttaaaaatgcccatgcaaagaaacaagaggtcgtggtcctcggctcacaggaaggagctatgcacactgccctgacaggcgctaccgagatccagaacagtgggggaacaagcatcttcgccggtcacttaaagtgtcgtctgaagatggataaactagaactcaagggcatgtcttacgcaatgtgcctgaatacttttgtgcttaaaaaggaggtttccgagacccagcatgggacgattttgataaaagtggaatacaagggagaggacgccccctgtaagatccctttctcaaccgaagatggccaaggtaaagctcacaacgggcgcctgattacagcgaacccagtagtcactaagaaagaggagcccgtgaatatcgaagcagagccgcctttcggcgaaagcaacatagttattggaatcggcgacaaggccctcaaaatcaattggtataagaaggggagttctattggaaaaatgtttgaggctaccgccagaggtgcaaggcggatggccatcctgggcgatacagcttgggacttcgggtccgtgggaggcgtccttaacagcctgggtaagatggtgcatcagatttttgggtcggcctacactgcattgttctctggcgtatcctggataatgaaaatcggaattggcgtgctcctgacctggatcgggttaaattcaaagaacacgagtatgagcttttcctgcatcgttattggaataatcacactgtatctaggcgcggtcgtgcaggctgatatgggttgtgtgattaattggaaagggaaggaactcaagtgcggatctggcatcttcgtcaccaacgaggttcacacttggacagagcagtacaaatttcaagccgacagccccaagcgactggcaaccgccattgctggtgcctgggaaaatggcgtgtgtgggatccgctcaactaccagaatggagaaccttttgtggaaacagatagcaaatgaactgaactatatcctctgggagaataacattaagctgacagtggtagtcggagatatcattggcgtgttagaacaggggaaaaggacgctgaccccacagcctatggagcttaagtacagttggaaaacttggggaaaggctaagatcgttacagccgagacccaaaattccagcttcataattgacggccccaacacaccagaatgcccctctgcgtcacgggcctggaacgtgtgggaggtcgaagactatggttttggggtgttcactaccaatatctggttgaaactccgcgaggtttacacgcagagttgtgatcatagactgatgagcgctgcaattaaggacgaaagggccgtgcacgctgatatgggatactggatcgagtcccagaaaaacggctcttggaagctagagaaagcctcgtttatagaagtaaagacatgcacctggcctaagagccacactctgtggtccaatggtgtcctcgagtcagacatgatcattccaaaaagtctggcaggcccgatctctcagcataaccaccgtcccgggtatcatacccaaacaactggaccttggcaccttggcaagttggaactggatttcaattactgcgaggggaccacagtggtgattacggagaactgtggaacccggggcccaagcttacgaactacaaccgtctccggtaaactcatccacgaatggtgctgtagatcatgcactctgccccctcttaggtatatgggggaggacggatgttggtacggcatggaaatacgcccaattaatgagaaggaagagaacatggttaaaagcctggtgtctgcgggttccggcaaggtagataattttacaatgggggtgttgtgcctcgccatcctgttcgaggaagtcatgcggggaaagttcggcaaaaagcatatgatcgctggggtgctatttaccttcgttctgctcctgagtggacagattacgtggagagacatggcccacactcttatcatgattggcagcaacgcatctgataggatgggtatgggggtgacctatttggctctgatagccacatttaaaatccagcccttcttagcactcggatttttcctgcgcaagcttacctcccgagagaatctgctactcggcgtcggcctggccatggctactacattgcaactgccggaagacattgagcagatggcgaacgggatcgccttaggactcatgaccctgaaacttattacacagtttgaaacttaccagctgtggaccgcattggtgtcactcacgtgtagtaatacaatcttcaccctgactgttgcttggcggaccgccacactaatactggccggtgtgagccttctccctctgtgccaatcgtcctctatgcgtaagactgattggttgccaatgaccgtcgctgcaatgggcgtaccccctctgcccttatttatcttcagcctcaaggacacgccaaaaagaaggtcatggcctctgaacgagggggtgatggccgttggacttgtgagtattctggcgtcctctttgctccgcaatgatgtccccatggctggcccactggtggccggtgggctactgatcgcatgttatgtaattacaggaaccagcgccgaccttactgtggagaaggctgcagacgtcacatgggaagaggaagccgagcagaccggcgtttcccataacctcatgatcactgtggatgacgatggcacaatgcggataaaagacgatgaaaccgagaacattctgacggtgttgttaaagactgcgctgctcatcgtctcagggatctttccgtacagcattcctgctaccctgcttgtgtggcacacatggcagaaacagacccaaagaagtggagttctgtgggacgtaccctctccacccgagacacagaaggccgaattggaggaaggtgtgtacaggataaaacagcagggcatcttcgggaagactcaagtcggagtgggcgttcagaaggagggtgtgtttcataccatgtggcacgtcacgcgaggggcagtgctaacacacaatggaaaacgcctggagcctaactgggcctccgtaaagaaagatctcattagctatggcggcgggtggcggctgtcggctcagtggcaaaagggagaagaggtccaggtgatcgccgttgaaccaggtaaaaatcccaagaacttccagactatgcctggcattttccagaccacaaccggggagatcggagcaatagctcttgactttaagccgggcacttcaggttctccaatcattaatagagaagggaaagtggtcggattatacggcaacggcgtggttaccaagaatgggggatatgtgagtggtatcgcccaaacaaacgcggagcccgatggccctacgccagagctggaagaggaaatgttcaaaaagaggaatctcactattatggacttgcatcccgggtccggaaaaacccgtaagtacctgcctgccatcgtccgcgaggcaataaagcggagactcaggacactgattcttgctccgacccgagtggtagccgctgaaatggaggaggcactgaaaggcttgcccatccggtatcagactacagccaccaagagcgaacacacgggtcgcgagatcgtggatctaatgtgccatgccacttttacaatgagactgctctctccagttagggtccctaactacaatttagtgattatggacgaagctcacttcaccgatcccgcgagcatcgcagcccgggggtatatatccacccgagtgggaatgggcgaggctgccgcaatttttatgactgccacaccacctggcaccgctgaagcgttcccccagtcaaacgccccaatccaggacgaggagagagacattccggaacgcagttggaatagcgggaacgagtggatcacagattttgtcggaaaaactgtatggttcgtgccttctataaaggcaggtaatgacattgctaactgtctgaggaaaaacggcaagaaggttatccaactttcccgtaaaacgtttgataccgaataccagaagacacggctgaatgactgggatttcgtggtcactaccgacatctcagagatgggggccaactttaaagcagatagagtgattgaccccaggcgctgcctcaagccagttatcttgacagatggacccgagcgagtgattctggccggccctatgccagtcaccgctgccagtgcggcacagagacggggtagggtggggcgcaatccccagaaagaaaacgaccaatacatattcactggccagcctctcaataacgatgaggaccatgcccactggacggaagctaagatgctgcttgacaatatcaacaccccggagggaattatcccagccctattcgaacccgagcgtgagaagagcgctgcaatcgatggcgaatatagactgaaaggggagtcccggaagacatttgtagaattgatgaggcgcggagacttacctgtgtggctggcccacaaagttgcttctgagggtattaagtacactgatcgaaaatggtgcttcgacggcgaaagaaataaccagatactcgaggagaatatggatgtcgaaatctggaccaaggagggggaacggaaaaagctgaggccccgctggcttgacgccagaacatattcggatccactggcactcaaggagtttaaagacttcgcggccggaaggaagagcattgctttggatctggtgaccgaaatcggccgggtgccttcacatctagcccaccgtactcgcaacgcactggacaatctcgtcatgcttcatacatccgagcacggtgggcgagcttacagacacgccgttgaggaactgcccgagacgatggaaaccttattgctgctcggcctgatgattcttctgactggaggcgcaatgctctttttgatcagtgggaaaggaataggtaagacatctatcggcctgatttgtgtgatcgtaagctccgggatgttatggatggccgatgtgccactacagtggattgcttcagcgatcgtcctggagttctttatgatggtgctccttatacctgagccggaaaaacaaaggaccccccaggacaaccagctggcctatgttgtgattggaatcttgaccctggcagctattgtcgccgccaatgagatgggcctcctggaaacaactaagcgggatcttggtatgtctaaggagccaggggtagtgagccctacgagttacctcgacgttgacctgcatcccgcatccgcttggaccttgtatgccgtggcgacaactgtcatcaccccaatgctgcgccacacaatagaaaacagcaccgctaatgtgtctttagccgcaatcgccaaccaagctgtcgtgctaatgggcctggataaaggatggcctatttcaaagatggacctcggcgttccccttctggcattggggtgctactcccaggtgaacccgctgactctcacggccgcggtactgcttttagtgacacattacgctatcattggaccaggcctgcaggccaaagcaaccagagaggcccagaagaggactgctgccggtatcatgaaaaatcctaccgtcgatgggataatgacaattgacctcgatcccgttatctatgacagtaagttcgagaagcaattgggacaggtgatgctgctagtcctgtgtgcagtgcagctccttctgatgcggactagctgggctttgtgcgaagccctgaccctcgcgacaggcccaatcacgaccctgtgggagggttcgcccggcaaattttggaacactacaattgccgtatctatggcaaatatcttccgagggtcctacttagctggagccggccttgcatttagcataatgaagtcagtggggaccggaagacgcggcactggtagtcagggggaaacactgggagagaaatggaagaaaaagctcaaccaactatctaggaaggaattcgatctgtataaaaagtccggcattaccgaggttgaccggacggaggctaaagaaggtttgaagcgtggcgagaccacacaccatgccgtgagcagagggtcagccaaactgcagtggtttgtcgaaaggaatatggtgatccctgagggacgcgtcattgatctcggctgtgggcggggaggctggagttactattgcgcgggtcttaagaaagtgactgaagttcgagggtacaccaagggaggcccgggccacgaggagcccgtaccaatgagcacatatgggtggaacatcgtgaagctgatgtccggaaaagacgtcttctacttgcctcccgaaaagtgtgatactctgctctgcgacataggtgagtctagcccttccccaaccgtggaagagtcaagaacaatcagggttttaaaaatggtggagccctggctgcgcaataaccagttctgtattaaggtccttaatccttacatgccaaccgtgatcgaacacctggagcggctacagagaaaatatggcgggatgctcgtacgtaaccccctgtctaggaatagtactcatgaaatgtactggatttcgaacggaacgggcaatatcgtgagctccgttaacatggtctctcggttgctgctcaatcgctttacaatgacccaccgaagaccgactattgagaaggatgtggaccttggtgctgggaccaggcatgtgaacgcagaacctgagacaccaaacatggacgtcatcggagagcggataaagcgcattaaagaagagcactcaagcacgtggcactatgatgacgaaaatccctacaagacctgggcctatcatggctcctacgaggttaaagctactggcagtgcctctagcatgatcaacggggtggtaaagctgttaacaaaaccttgggatgtggtcccaatggtgacccaaatggcaatgactgacacaacccccttcggacagcagagagtttttaaggaaaaggtggatacaaggactccgcgacctatgcccggtacccggaaagtcatggagatcacggccgagtggctgtggcgtaccttgggcagaaataagaaaccacgcctctgcacaagggaagagttcactaagaaagtgcggaccaacgctgcgatgggggccgtatttacagaagagaatcaatgggactcagcaagagctgccgttgaagatgaggagttctggaagctggtggaccgcgaaagggagctacacaagcttggaaaatgtggctcctgcgtctataacatgatgggtaagcgagaaaaaaagctgggggagtttggaaaagcaaagggcagtcgggccatttggtacatgtggctcggcgctagatacctggagttcgaagccttggggtttctgaatgaggatcattggttcagcagggaaaactcttattccggagtggagggtgaaggcctccacaaacttgggtacatactgcgcgacatctcaaagattcctggaggcgcgatgtatgcagatgacactgccggttgggacacccgtatcacggaggatgacttacataatgaggaaaagattacacagcagatggatcccgagcaccggcagctggctaacgccatctttaaattgacctaccaaaataaggtggtcaaagttcagagaccaactcccaaggggacagtgatggacataatcagcaggaaagatcagcgcggatcgggccaggtaggcacctatgggctcaacactttcaccaatatggaagcacaactggtgcgacagatggagggagaaggtgtcctatctaaggctgaccttgagaaccctcacctgctcgagaagaaaattacacagtggctggaaacgaagggcgtggagcggttgaaaagaatggccatcagtggggatgactgcgttgtgaagccaattgatgacaggtttgctaatgccttactggcactcaacgatatgggaaaagtccgcaaggacatcccgcagtggcaaccctccaagggctggcatgattggcagcaggtgcctttctgtagccaccatttccacgaacttataatgaaagacggtagaaagctggtagttccatgccggccccaggacgagctaattgggagggcgcgtatctcacaaggagccggctggtccctgaaagaaaccgcttgtctcggcaaggcctacgcacagatgtggtctttgatgtattttcaccgacgcgatctgagacttgctagcaacgccatctgcagtgcagtgcctgtccattggattccaacttcccggacaacctggagcatacacgcccatcaccagtggatgactacagaggacatgctgaccgtgtggaatagggtttggatcgaggataacccctggatggaagacaaaacgcctgtgacaacctgggaggatgtcccgtacctcgggaagcgcgaagaccaatggtgtggatctttaattggtctgacttcaagagcgacctgggctcagaatatcttgacagccattcagcaggtgcggagtctgatcggcgatgaggagttcctcgactacatgccatccatgaagaggtttcgaaaagaagaggaaagcgagggggcaatatggtga

SEQ ID NO: 15235 - RNA, 9873 nt, synthetic construct
  misc_feature 1..9873: note = derived and/or modified CDS sequence (opt3) from DENV-3__FJ639725__SS-prME
  source 1..9873: mol_type = other RNA
accagcctgtgcctcatgatgatgcttccagcaacactggctttccacttgacttccagagacggcgaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaaaagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaattcaaagaacacgagtatgagcttttcctgcatcgttattggaataatcacactgtatctaggcgcggtcgtgcaggctgatatgggttgtgtgattaattggaaggggaaggaactcaaatgcggatctggcatcttcgtcaccaacgaggttcacacttggacagagcagtacaagtttcaagccgacagccccaaacggctggcaaccgccattgctggtgcctgggaaaatggcgtgtgtgggatccgatcaactacccgcatggagaaccttttgtggaagcagatagcaaatgaactgaactatatcctctgggagaataacattaaactgacagtggtagtcggagatatcattggcgtgttagaacaggggaagagaacgctgaccccacagcctatggagcttaaatacagttggaagacttggggaaaggctaaaatcgttacagccgagacccaaaattccagcttcataattgacggccccaacacaccagaatgcccctctgcgtcaagggcctggaacgtgtgggaggtcgaagactatggttttggggtgttcactaccaatatctggttgaagctccgggaggtttacacgcagagttgtgatcatcgcctgatgagcgctgcaattaaagacgaaagagccgtgcacgctgatatgggatactggatcgagtcccagaagaacggctcttggaaactagagaaggcctcgtttatagaagtaaagacatgcacctggcctaaaagccacactctgtggtccaatggtgtcctcgagtcagacatgatcattccaaagagtctggcaggcccgatctctcagcataaccacaggcccgggtatcatacccaaacagcgggaccttggcaccttggcaaattggaactggatttcaattactgcgaggggactaccgtggtgattacagagaactgtggaacgcgtggccccagcttacggaccactacagtctccggtaagctcatccacgaatggtgctgtcgatcatgcaccctgccccctcttagatatatgggggaggacggatgttggtacggcatggaaataaggccaattaatgagaaagaagagaacatggttaagagcctggtgtctgccggttccggcaaggtagataattttactatgggggtgttgtgcctcgctatcctgttcgaggaagtcatgcgcggaaaattcggcaagaaacatatgatcgccggggtgctatttacattcgttctgctcctgagtggacagattacctggcgggacatggcacacacgcttatcatgattggcagcaacgcttctgatagaatgggtatgggggtgacttatttggccctgatagcaacctttaagatccagcccttcttagccctcggatttttcctgaggaaacttacatcccgcgagaatctgctactcggcgtcggcctggctatggcgaccactttgcaactgccggaagacattgagcagatggccaacgggatcgcattaggactcatgacactgaaacttattacccagtttgaaacataccagctgtggactgctttggtgtcactcacctgtagtaatacgatcttcacactgaccgttgcctggcgaactgccaccctaatactggctggtgtgagccttctccctctgtgccaatcgtcctctatgcggaagacagattggttgccaatgactgtcgcagccatgggcgtaccccctctgcccttatttatcttcagcctcaaagacaccccaaagcgtagatcatggcctctgaacgagggggtgatggcggttggacttgtgagtattctggcttcctctttgctcaggaatgatgtccccatggccggcccactggtggccggtgggctactgatcgcctgttatgtaattacgggaacaagcgctgaccttaccgtggagaaagcagccgacgtcacttgggaagaggaagcggagcagacaggcgtttcccataacctcatgatcaccgtggatgacgatggcactatgcgcataaaggacgatgaaacagagaacattctgaccgtgttgttaaaaacggctctgctcatcgtctcagggatctttccgtacagcattcctgccactctgcttgtgtggcacacctggcagaagcagacacaacggagtggagttctgtgggacgtaccctctccacccgagacccagaaagcagaattggaggaaggtgtgtacagaataaagcagcagggcatcttcgggaagacacaagtcggagtgggcgttcagaaagagggtgtgtttcatactatgtggcacgtcacccgaggggcagtgctaacgcacaatggaaagaggctggagcctaactgggcttccgtcaaaaaggatctcattagctatggcggcgggtggcgcctgtcggcccagtggcaaaaaggagaagaggtccaggtgatcgcagttgaaccaggtaagaatcccaagaacttccagacaatgcctggcattttccagactaccacaggggagatcggagctatagcccttgactttaaaccgggcacctcaggttctccaatcattaatcgggaagggaaggtggtcggattatacggcaacggcgtggttactaaaaatgggggatatgtgagtggtatcgcgcaaaccaacgccgagcccgatggccctacaccagagctggaagaggaaatgttcaagaaaagaaatctcacgattatggacttgcatcccgggtccggaaagactaggaagtacctgcctgcaatcgtccgtgaggctataaaacgccggctcagaaccctgattcttgccccgacaagggtggtagctgcagaaatggaggaggccctgaagggcttgcccatccgatatcagaccactgccacaaaaagcgaacacaccggtcgggagatcgtggatctaatgtgccatgctacgtttactatgcgcctgctctctccagttagagtccctaactacaatttagtgattatggacgaagcgcacttcacagatcccgcaagcatcgccgctagggggtatatatccacccgggtgggaatgggcgaggccgcagccatttttatgaccgctactccacctggcacagcggaagccttcccccagtcaaacgcaccaatccaggacgaggagcgagacattccggaaagaagttggaatagcgggaacgagtggatcaccgattttgtcggaaagacagtatggttcgtgccttctataaaagctggtaatgacattgccaactgtctgcgcaagaacggcaagaaagttatccaactttccaggaagacttttgatacggaataccagaaaacccgtctgaatgactgggatttcgtggtcacaactgacatctcagagatgggggcaaactttaaggccgatcgggtgattgaccccagaaggtgcctcaaaccagttatcttgaccgatggacccgagcgcgtgattctggctggccctatgccagtcacagccgcgagtgcagcccagcgaagaggtcgggtggggaggaatccccagaaggaaaacgaccaatacatattcaccggccagcctctcaataacgatgaggaccatgctcactggactgaagccaagatgctgcttgacaatatcaacacgccggagggaattatcccagctctattcgaacccgagcgcgagaaaagcgcagccatcgatggcgaatatcgtctgaagggggagtccagaaaaacctttgtagaattgatgcggaggggagacttacctgtgtggctggctcacaaggttgcctctgagggtattaaatacacagatcgcaagtggtgcttcgacggcgaacgaaataaccagatactcgaggagaatatggatgtcgaaatctggactaaagagggggaaagaaagaagctgcggcccaggtggcttgacgcacgcacctattcggatccactggcgctcaaagagtttaaggacttcgccgctggaagaaaaagcattgccttggatctggtgacagaaatcggcagggtgccttcacatctagcacaccggacccgtaacgctctggacaatctcgtcatgcttcatacttccgagcacggtgggcgcgcctaccgacacgcagttgaggaactgcccgagacaatggaaacgttattgctgctcggcctgatgattcttctgaccggaggcgccatgctctttttgatcagtgggaagggaataggtaaaacttctatcggcctgatttgtgtgatcgctagctccgggatgttatggatggcggatgtaccactacagtggattgcctcagcaatcgtgctggagttctttatgatggtcctccttatacctgagccggaaaagcaaagaacaccccaggacaaccagctggcttatgtggttattggaatcttgaccctggccgccattgtggcagctaatgagatgggcctcctggaaaccacaaagagggatcttggtatgtctaaagagccaggggtcgtaagccctacaagttacctcgacgtggacctgcatcccgcctccgcgtggacgttgtatgctgttgccaccacagtgatcactccaatgctgcggcacaccatagaaaacagcacagcaaatgtctctttagccgctatcgcaaaccaagccgtggtcctaatgggcctggataagggatggcctatttcaaaaatggacctcggcgtgccccttctggcgttggggtgctactcccaggttaacccgctgaccctcactgctgccgtgctgcttttagtaacgcattacgcaatcattggaccaggcctgcaggccaaggctacacgcgaggcccagaaaagaaccgcagctggtatcatgaagaatcctactgtggatgggataatgaccattgacctcgatcccgtcatctatgacagtaagttcgagaaacaattgggacaggttatgctgctagtgctgtgtgccgtccagctccttctgatgaggacaagctgggcgttgtgcgaagccctgactctcgcaaccggcccaatcacaacgctgtgggagggttcgcccggcaagttttggaacaccactattgctgtgtctatggccaatatcttccgggggtcctacttagcaggagctggccttgcctttagcataatgaaatcagtagggacaggacgaagaggcaccggtagtcagggggaaactctgggagagaagtggaaaaagaagctcaaccaactatctcgcaaagagttcgatctgtataagaaatccggcattacagaggtggacaggaccgaggccaaggaaggtttgaaacggggcgagacgacccaccatgcggttagccgtgggtcagctaagctgcagtggtttgtggaaagaaatatggtcatccctgagggaagggtgattgatctcggctgtgggcgcggaggctggagttactattgcgcaggtcttaaaaaggtcacagaagtgcgggggtacactaagggaggcccgggccacgaggagcccgttccaatgagcacctatgggtggaacatcgtaaaactgatgtccggaaaggacgtgttctacttgcctcccgaaaaatgtgatacactgctctgcgacataggtgagtctagcccttccccaactgtcgaagagtcacgaaccatcagagtgttaaagatggttgagccctggctgaggaataaccagttctgtattaaagtgcttaatccttacatgccaacagtcatcgaacacctggagcgcctacagcggaagtatggcgggatgctcgtgagaaaccccctgtctcgtaatagtacccatgaaatgtactggatttcgaacggaactggcaatatcgtaagctccgtgaacatggtttctaggttgctgctcaatcggtttacgatgacacaccgccgaccgaccattgagaaggatgtcgaccttggtgccgggactagacatgtgaacgctgaacctgagaccccaaacatggacgtgatcggagagaggataaaacggattaaggaagaacactcaagcacatggcactatgatgacgaaaatccctacaaaacgtgggcctatcatggctcctacgaggtcaaggcaaccggcagtgcctctagcatgatcaacggggttgtgaaactgttaactaagccttgggatgtagtgccaatggtcacacaaatggctatgaccgacactacacccttcggacagcagcgcgtgtttaaggaaaaagttgataccagaacaccgaggcctatgcccggtactcgaaaggtgatggagatcaccgcggagtggctgtggcggacgttgggccgtaataaaaagccaagactctgcacccgcgaagagttcactaaaaaggtcaggactaacgccgcaatgggggctgtgtttaccgaagagaatcaatgggactcagcccgggcagccgtagaagatgaggagttctggaagctggttgacagagaacgcgagctacacaaacttggaaagtgtggctcctgcgtgtataacatgatgggtaaaagggaaaagaaactgggggagtttggaaaggctaaaggcagtcgagccatttggtacatgtggctcggcgcgcggtacctggagttcgaagcattggggtttctgaatgaggatcattggttcagcagagaaaactcttattccggagtcgagggtgaaggcctccacaaacttgggtacatactgagggacatctcaaagattcctggaggcgccatgtatgctgatgacacagccggttgggacactcgcatcaccgaggatgacttacataatgaggagaaaattacgcagcagatggatcccgagcaccgtcagctggcaaacgctatctttaagttgacataccaaaataaagtggtgaaggtccagcggccaacccccaaagggactgttatggacataatcagcagaaaggatcagaggggatcgggccaggtgggcacatatgggctcaacaccttcactaatatggaagcccaactggtacgccagatggagggagaaggtgtgctatctaaggctgaccttgagaaccctcatctgctcggcaaaaagattacccagtggctggagacaaaaggggtcgaacgattgaagcggatggccatcagtggagatgactgcgtggttaaaccaattgatgacagatttgcaaatgcgttactggccctcaacgatatgggcaaggtgaggaaggacatcccgcagtggcaaccctccaaaggttggcatgattggcagcaggtccctttctgtagccaccatttccacgagcttataatgaaggacgggcgcaaactggtggtaccatgcagaccccaggacgaactaattggacgggctaggatctcacaaggcgccggctggtccctgaaggagacggcatgtctcgggaaggcttacgcccagatgtggtctttgatgtattttcaccgtcgagatctgcgccttgcaagcaacgccatctgcagtgcggttcctgtgcattggattccaacctccagaactacatggagcatacacgctcatcaccagtggatgaccactgaagacatgctgacagtctggaatcgggtgtggatcgaggataacccctggatggaggacaagacccctgttacgacatgggaagatgtgccgtacctcggaaagagggaggaccaatggtgtggttctttaattggcctgacctcacgcgccacttgggcacagaatatcttgaccgccattcagcaggtcagaagtctgatcggggatgaagagttcctcgactacatgccatccatgaaacggtttaggaaggaggaagagagcgaaggagctatatggtga

SEQ ID NO: 15236 - RNA, 9873 nt, synthetic construct
  misc_feature 1..9873: note = derived and/or modified CDS sequence (opt3) from DENV-3__FJ639726__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaacgggtggagacttgggcactccgccatcctggattcaccatcctggccctgtttctcgctcactacattggcacatctttaactcagaaagttgtgatcttcatactgcttatgttggtcaccccatcgatgacaatgagatgtgtgggcgtagggaacagggactttgttgaaggactgtcaggtgccacctgggtggatgtcgtgctagagcatggcgggtgcgtgacgactatggcgaagagcaagcccacactcgacatcgagctgcagaaaaccgaagcaactcaacttgccacactgcggaagttgtgtattgagggaaaaatcaccaatattacgaccgatagtcgctgccctacacagggcgaagctactctcccagaggaacaggaccagaactatgtctgtaagcacacctacgttgatcgaggttgggggaatggatgcggcctgttcggcaaagggtccttagtgacatgcgccaagtttcaatgtctggagcccatcgagggaaaggtagtgcagtatgaaaacctcaaatacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgagaactggtctagatttcaacgagatgattctgctcaccatgaagaataaagcctggatggttcacaggcagtggtttttcgacctgccccttccttggacatccggggcgaccactgagacaccaacgtggaaccggaaggaactgttggtgacctttaaaaatgcccatgcaaagaaacaagaggtcgtggtcctcggctcacaggaaggagctatgcacactgccctgacaggcgctaccgagatccagaacagtgggggaacaagcatcttcgccggtcacttaaagtgtcgtctgaagatggataaactagaactcaagggcatgtcttacgcaatgtgcctgaatacttttgtgcttaaaaaggaggtttccgagacccagcatgggacgattttgataaaagtggaatacaagggagaggacgccccctgtaagatccctttctcaaccgaagatggccaaggtaaagctcacaacgggcgcctgattacagcgaacccagtagtcactaagaaagaggagcccgtgaatatcgaagcagagccgcctttcggcgaaagcaacatagttattggaatcggcgacaaggccctcaaaatcaattggtataagaaggggagttctattggaaaaatgtttgaggctaccgccagaggtgcaaggcggatggccatcctgggcgatacagcttgggacttcgggtccgtgggaggcgtccttaacagcctgggtaagatggtgcatcagatttttgggtcggcctacactgcattgttctctggcgtatcctggataatgaaaatcggaattggcgtgctcctgacctggatcgggttaaattcaaagaacacgagtatgagcttttcctgcatcgttattggaataatcacactgtatctaggcgcggtcgtgcaggctgatatgggttgtgtgattaattggaaagggaaggaactcaagtgcggatctggcatcttcgtcaccaacgaggttcacacttggacagagcagtacaaatttcaagccgacagccccaagcgactggcaaccgccattgctggtgcctgggaaaatggcgtgtgtgggatccgctcaactaccagaatggagaaccttttgtggaaacagatagcaaatgaactgaactatatcctctgggagaataacattaagctgacagtggtagtcggagatatcattggcgtgttagaacaggggaaaaggacgctgaccccacagcctatggagcttaagtacagttggaaaacttggggaaaggctaagatcgttacagccgagacccaaaattccagcttcataattgacggccccaacacaccagaatgcccctctgcgtcacgggcctggaacgtgtgggaggtcgaagactatggttttggggtgttcactaccaatatctggttgaaactccgcgaggtttacacgcagagttgtgatcatagactgatgagcgctgcaattaaggacgaaagggccgtgcacgctgatatgggatactggatcgagtcccagaaaaacggctcttggaagctagagaaagcctcgtttatagaagtaaagacatgcacctggcctaagagccacactctgtggtccaatggtgtcctcgagtcagacatgatcattccaaaaagtctggcaggcccgatctctcagcataaccaccgtcccgggtatcatacccaaacagcgggaccttggcaccttggcaagttggaactggatttcaattactgcgaggggactaccgtggtgattacagagaactgtggaacgcggggcccaagcttacgaaccactacagtctccggtaaactcatccacgaatggtgctgtagatcatgcaccctgccccctcttaggtatatgggggaggacggatgttggtacggcatggaaatacgcccaattaatgagaaggaagagaacatggttaaaagcctggtgtctgccggttccggcaaggtagataattttactatgggggtgttgtgcctcgctatcctgttcgaggaagtcatgcggggaaagttcggcaaaaagcatatgatcgccggggtgctatttacattcgttctgctcctgagtggacagattacctggagagacatggcacacacgcttatcatgattggcagcaacgcttctgataggatgggtatgggggtgacttatttggccctgatagcaacctttaaaatccagcccttcttagccctcggatttttcctgcgcaagcttacatcccgagagaatctgctactcggcgtcggcctggctatggcgaccactttgcaactgccggaagacattgagcagatggccaacgggatcgcattaggactcatgacactgaaacttattacccagtttgaaacataccagctgtggactgctttggtgtcactcacctgtagtaatacgatcttcacactgaccgttgcctggcggactgccaccctaatactggctggtgtgagccttctccctctgtgccaatcgtcctctatgcgtaagacagattggttgccaatgactgtcgcagccatgggcgtaccccctctgcccttatttatcttcagcctcaaggacaccccaaaaagaaggtcatggcctctgaacgagggggtgatggcggttggacttgtgagtattctggcttcctctttgctccgcaatgatgtccccatggccggcccactggtggcaggtgggctactgatcgcctgttatgtaattacgggaacaagcgctgaccttaccgtggagaaggcagccgacgtcacttgggaagaggaagcggagcagacaggcgtttcccataacctcatgatcaccgtggatgacgatggcactatgcggataaaagacgatgaaacagagaacattctgaccgtgttgttaaagacggctctgctcatcgtctcagggatctttccgtacagcattcctgccactctgcttgtgtggcacacctggcagaaacagacacaaagaagtggagttctgtgggacgtaccctctccacccgagacccagaaggcagaattggaggaaggtgtgtacaggataaaacagcagggcatcttcgggaagacacaagtcggagtgggcgttcagaaggagggtgtgtttcatactatgtggcacgtcacccgaggggccgtgctaacgcacaatggaaaacgcctggagcctaactgggcttccgtaaagaaagatctcattagctatggcggcgggtggcggctgtcggcccagtggcaaaagggagaagaggtccaggtgatcgcagttgaaccaggtaaaaatcccaagaacttccagacaatgcctggcattttccagactaccacaggggagatcggagctatagcccttgactttaagccgggcacctcaggttctccaatcattaatagagaagggaaagtggtcggattatacggcaacggcgtggttactaagaatgggggatatgtgagtggtatcgcgcaaaccaacgccgagcccgatggccctacaccagagctggaagaggaaatgttcaaaaagaggaatctcacgattatggacttgcatcccgggtccggaaaaactcgtaagtacctgcctgcaatcgtccgcgaggctataaagcggagactcaggaccctgattcttgccccgacacgagtggtagctgcagaaatggaggaggccctgaaaggcttgcccatccggtatcagaccactgccacaaagagcgaacacaccggtcgcgagatcgtggatctaatgtgccatgctacgtttactatgagactgctctctccagttagggtccctaactacaatttagtgattatggacgaagcgcacttcacagatcccgcaagcatcgccgctcgggggtatatatccacccgagtgggaatgggcgaggccgcagccatttttatgaccgctactccacctggcacagcggaagccttcccccagtcaaacgcaccaatccaggacgaggagagagacattccggaacgcagttggaatagcgggaacgagtggatcaccgattttgtcggaaaaacagtatggttcgtgccttctataaaggctggtaatgacattgccaactgtctgaggaaaaacggcaagaaggttatccaactttcccgtaaaacttttgatacggaataccagaagacccggctgaatgactgggatttcgtggtcacaactgacatctcagagatgggggcaaactttaaagccgatagagtgattgaccccaggcgctgcctcaagccagttatcttgaccgatggacccgagcgagtgattctggctggccctatgccagtcacagccgcgagtgcagcccagagacggggtagggtggggcgcaatccccagaaagaaaacgaccaatacatattcaccggccagcctctcaataacgatgaggaccatgctcactggactgaagccaagatgctgcttgacaatatcaacacgccggagggaattatcccagctctattcgaacccgagcgtgagaagagcgcagccatcgatggcgaatatagactgaaaggggagtcccggaagacctttgtagaattgatgaggcgcggagacttacctgtgtggctggctcacaaagttgcctctgagggtattaagtacacagatcgaaaatggtgcttcgacggcgaaagaaataaccagatactcgaggagaatatggatgtcgaaatctggactaaggagggggaacggaaaaagctgaggccccgctggcttgacgcaagaacctattcggatccactggcgctcaaggagtttaaagacttcgccgctggaaggaagagcattgccttggatctggtgacagaaatcggccgggtgccttcacatctagcacaccgtacccgcaacgctctggacaatctcgtcatgcttcatacttccgagcacggtgggcgagcctacagacacgcagttgaggaactgcccgagacaatggaaacgttattgctgctcggcctgatgattcttctgaccggaggcgccatgctctttttgatcagtgggaaaggaataggtaagacttctatcggcctgatttgtgtgatcgtaagctccgggatgttatggatggctgatgtgccactacagtggattgcgtcagccatcgtcctggagttctttatgatggtgctccttatacctgagccggaaaaacaaaggacaccccaggacaaccagctggcatatgttgtgattggaatcttgaccctggctgccattgtcgccgcaaatgagatgggcctcctggaaaccacaaagcgggatcttggtatgtctaaggagccaggggtagtgagccctactagttacctcgacgttgacctgcatcccgcttccgcctggacgttgtatgcggtggctaccacagtcatcactccaatgctgcgccacaccatagaaaacagcacagccaatgtgtctttagcagccatcgctaaccaagcagtcgtgctaatgggcctggataaaggatggcctatttcaaagatggacctcggcgttccccttctggccttggggtgctactcccaggtgaacccgctgaccctcactgcggctgtactgcttttagtgacgcattacgccatcattggaccaggcctgcaggcaaaagccacaagagaggctcagaagaggaccgccgcaggtatcatgaaaaatcctactgtcgatgggataatgaccattgacctcgatcccgttatctatgacagtaagttcgagaagcaattgggacaggtgatgctgctagtcctgtgtgctgtgcagctccttctgatgcggacaagctgggccttgtgcgaagcgctgactctcgccaccggcccaatcacaacgctgtgggagggttcgcccggcaaattttggaacaccactattgcagtatctatggctaatatcttccgagggtcctacttagccggagcaggccttgcttttagcataatgaagtcagtggggacaggaagacgcggcaccggtagtcagggggaaactctgggagagaaatggaagaaaaagctcaaccaactatctaggaaggaattcgatctgtataaaaagtccggcattacagaggttgaccggaccgaggccaaagaaggtttgaagcgtggcgagacgacccaccatgccgtgagcagagggtcagcgaaactgcagtggtttgtcgaaaggaatatggtgatccctgagggacgcgtcattgatctcggctgtgggcggggaggctggagttactattgcgctggtcttaagaaagtgacagaagttcgagggtacactaagggaggcccgggccacgaggagcccgtaccaatgagcacctatgggtggaacatcgtgaagctgatgtccggaaaagacgtcttctacttgtctcctgaaaagtgtgatacactgctctgcgacataggtgagagctccccctcacctactgtggaagagtctagaaccatcagggttttaaaaatggtggagccatggctgcgcaataaccagttctgtattaaggtccttaatccctacatgcctacagtgatcgaacacctggagcggctacagagaaaatatggcgggatgctcgtacgtaacccactgagtaggaattcgacccatgaaatgtactggattagcaacggaactggcaatatcgtgtcctctgttaacatggtctcacggttgctgctcaatcgctttacgatgacacaccgaagacccaccattgagaaggatgtggaccttggtgcagggactaggcatgtgaacgccgaaccggagacccctaacatggacgtcatcggagagcggataaagcgcattaaagaagagcacagctccacatggcactatgatgacgaaaatccatacaagacgtgggcttatcatggcagttacgaggttaaagccaccggctctgcaagctcaatgatcaacggggtggtaaagctgttaactaaaccctgggatgtggtccctatggtgacacaaatggccatgaccgacactacaccattcggacagcagagagtttttaaggaaaaggtggataccaggacaccccgaccgatgcctggtactcggaaagtcatggagatcaccgctgagtggctgtggcgtacgttgggcagaaataagaaaccccgcctctgcaccagggaagagttcacaaagaaagtgcggactaacgcggccatgggggcagtatttaccgaagagaatcaatgggactccgctagagccgcagttgaagatgaggagttctggaagctggtggaccgcgaaagggagctacacaagcttggaaaatgtggcagttgcgtctataacatgatgggtaagcgagaaaaaaagctgggggagtttggaaaagccaagggcagccgggctatttggtacatgtggctcggcgccagatacctggagttcgaagcgttggggtttctgaatgaggatcattggttctctagggaaaactcctattcaggagtggagggtgaaggcctccacaaacttgggtacatactgcgcgacatcagcaagattccaggaggcgcaatgtatgccgatgacacagctggttgggacactcgtatcaccgaggatgacttacataatgaggaaaagattacgcagcagatggatcctgagcaccggcagctggccaacgcaatctttaaattgacataccaaaataaggtggtcaaagttcagagacccaccccaaaggggactgtgatggacataatctcgaggaaagatcagcgcggatctggccaggtaggcacatatgggctcaacaccttcactaatatggaagctcaactggtgcgacagatggagggagaaggtgtcctaagtaaggccgaccttgagaacccccacctgctcgagaagaaaattacccagtggctggaaacaaagggcgtggagcggttgaaaagaatggctatctccggggatgactgcgttgtgaagcctattgatgacaggtttgccaatgcattactggcgctcaacgatatgggaaaagtccgcaaggacatcccacagtggcaaccgagcaagggctggcatgattggcagcaggtgcccttctgttcacaccatttccacgaacttataatgaaagacggtagaaagctggtagttccttgccggccacaggacgagctaattgggagggcccgtatctcccaaggagctggctggtctctgaaagaaacggcctgtctcggcaaggcatacgctcagatgtggagcttgatgtattttcaccgacgcgatctgagacttgccagtaacgcaatctgctccgccgtgcccgtccattggattcctaccagccggactacatggtctatacacgcgcatcaccagtggatgaccactgaggacatgctgacagtgtggaatagggtttggatcgaggataacccatggatggaagacaaaacccccgtgacgacatgggaggatgtcccttacctcgggaagcgcgaagaccaatggtgtggatcattaattggtctgaccagtagagctacttgggcccagaatatcttgaccgcaattcagcaggtgcggtccctgatcggcgatgaggagttcctcgactacatgccgagcatgaagaggtttcgaaaagaagaggaatctgagggggccatatggtga

SEQ ID NO: 15237 - RNA, 9873 nt, synthetic construct
  misc_feature 1..9873: note = derived and/or modified CDS sequence (opt3) from DENV-3__KF955333__SS-prME
  source 1..9873: mol_type = other RNA
accagcctgtgcctcatgatgatgcttcccgcaaccctggctttccacttgacttccagggacggagaacctaggatgatcgtggggaagaacgaacggggaaaatctttactgtttaagacggcgtcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcaccgccgagacaagcgtagcgtggccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaattcaaagaacacgagtatgagcttttcctgcatcgttattggaataatcacactgtatctaggcgcggtcgtgcaggctgatatgggttgtgccattaattggaaggggaaggaactcaaatgcggatctggcatcttcgtgaccaacgaggtccacacttggacagagcagtacaagtttcaagcagacagccccaaacggctggccaccgctattgccggtgcatgggaaaatggcgtttgtgggatccgatcaactacccgcatggagaaccttttgtggaagcagatagctaatgaactgaactatatcctctgggagaataacattaaactgacagtggtggtaggagatatcattggcgtcttagaacaggggaagagaacgctgaccccacagcctatggagcttaaatacagttggaagacttggggaaaggccaaaatcgtgacagcggagacccaaaattccagcttcataattgacggccccaacacaccagaatgcccctctgcctcaagggcttggaacgtttgggaggtggaagactatggttttggggtcttcactaccaatatctggttgaagctccgggaggtgtacacgcagagttgtgatcatcgcctgatgagcgcagccattaaagacgaaagagctgcccacgcagatatgggatactggatcgagtcccagaagaacggctcttggaaactagagaaggcgtcgtttatagaagttaagacatgcacctggcctaaaagccacactctgtggtccaatggtgtgctcgagtcagacatgatcattccaaagagtctggccggcccgatctctcagcataaccacaggcccgggtatcatacccaaacagctggaccttggcaccttggcaaattggaactggatttcaattactgcgaggggactaccgtagtcattacagagaactgtggaacgcgtggccccagcttacggaccactacagtgtccggtaagctcatccacgaatggtgctgtcgatcatgcaccctgccccctcttagatatatgggggaggacggatgttggtacggcatggaaataaggccaattaatgagaaagaagagaacatggtaaagagcctggtctctgccggttccggcaaggttgataattttactatgggggtgttgtgcctcgcaatcctgttcgaggaagtaatgcgcggaaaattcggcaagaaacatatgatcgctggggtgctatttacattcgtcctgctcctgagtggacagattacctggcgggacatggcccacacgcttatcatgattggcagcaacgcatctgatagaatgggtatgggggtgacttatttggccctgatagctacctttaagatccagcccttcttagcgctcggatttttcctgaggaaacttacatcccgcgagaatctgctactcggcgttggcctggccatggcaaccactttgcaactgccggaagacattgagcagatggctaacgggatcgccttaggactcatgacactgaaacttattacccagtttgaaacataccagctgtggactgccttggtgtcactcacctgtagtaatacgatcttcacactgaccgtcgcttggcgaactgcaaccctaatactggccggtgtgagccttctccctctgtgccaatcgtcctctatgcggaagacagattggttgccaatgactgttgcggctatgggcgtgccccctctgcccttatttatcttcagcctcaaagacaccccaaagcgtagatcatggcctctgaacgagggggtcatggccgtaggacttgtgagtattctggcatcctctttgctcaggaatgatgttcccatggccggcccactggtggctggtgggctactgatcgcatgttatgtcattacgggaacaagcgccgaccttaccgtggagaaaccggcggacgtaccttgggaagaggaagctgagcagactggcgtgtcccataacctcatgatcacagtcgatgacgatggccccatgcgcataaaggacgatgaaaccgagaacattctgactgttttgttaaaaacagccctgctcatcgtgtcagggatctttccatacagcattcccgcaaccctgcttgtgtggcacacgtggcagaagcagactcaacggagtggagtcctgtgggacgtgccttctccacccgagacccagaaagccgaattggaggaaggtgtttacagaataaagcagcagggcatcttcgggaagacacaagtaggagtgggcgtccagaaagagggtgtgtttcataccatgtggcacgttacaagaggggctgtgctaactcacaatggaaagcgactggagcctaactgggcctccgtcaaaaaggatctcattagctatggcggcgggtggcgcctgaatgcacagtggcaaaaaggagaagaggtgcaggtaatcgctgtcgaaccgggtaagaacccaaagaatttccagaccatgcccggcattttccagacgacaactggggagatcggagccatagcgcttgactttaaacctggcacctcgggttcaccaatcattaaccgggaagggaaggtggttggattatacggcaatggcgtggtcactaaaaacgggggatatgtgtctggtatcgcccaaaccaatgcagagcccgatggccctactccggagctggaagaggaaatgttcaagaaaagaaacctcaccattatggacttgcatcccgggagtggaaagacaaggaagtacctgccagctatcgttcgtgaggccataaaacgccggctcagaacgctgattcttgctcctactagggtggtcgcagccgaaatggaggaggccctgaagggcttgcccatccgatatcagaccacagctaccaaatccgaacacactggtcgggagatcgtggatctaatgtgccatgcgacatttaccatgcgcctgctcagcccagtaagagtgcctaattacaacttagttattatggacgaagcacacttcacggatcccgcctctatcgctgccagggggtatataagcactcgggtcggaatgggcgaggcagccgctatttttatgacagcgaccccaccgggcaccgccgaagcattccctcagtccaatgctcccatccaggacgaggagcgagacattccagaaagatcatggaacagtgggaatgagtggatcactgattttgtgggaaagacagtgtggttcgtccccagcataaaagccggtaacgacattgcaaactgtctgcgcaagaatggcaagaaagtaatccaactttctaggaagacctttgatacagaataccagaaaactcgtctgaacgactgggatttcgtggttacgaccgacatctccgagatgggggccaattttaaggctgatcgggtgattgaccctagaaggtgcctcaaaccagtcatcttgacagatggacccgagcgcgtgattctggccggccctatgccggttactgcggcatcagccgctcagcgaagaggtcgggtggggaggaacccacagaaggaaaatgaccaatacatattcaccggccagcccctcaacaatgatgaggaccatgcccactggacagaagctaagatgctgcttgacaacatcaatacccctgagggaattatccccgcactattcgaaccagagcgcgagaaaagtgccgctatcgatggcgaatatcgtctgaagggggagagcagaaaaacttttgtcgaattgatgcggaggggagacttacctgtgtggctggcccacaaggtagcatccgagggtattaaatacacggatcgcaagtggtgcttcgacggcgaacgaaacaatcagatactcgaggagaacatggatgtggaaatctggaccaaagagggggaaagaaagaagctgcggcccaggtggcttgacgcgcgcacatattctgatccactggccctcaaagagtttaaggacttcgctgccggaagaaaatcgattgcattggatctggttactgaaatcggcagggtccctagccatctagctcaccggacccgtaatgccctggacaacctcgtgatgcttcatacatcagagcacggtgggcgcgcataccgacacgccgtggaggaactgccggagaccatggaaactttattgctgctcggcctgatgattcttctgacaggaggcgctatgctctttttgatctccgggaagggaataggtaaaacgagtatcggcctgatttgtgtcatcgtttctagcgggatgttatggatggcggatgtgcccctacagtggattgcctccgcaatcgtactggagttctttatgatggtgctccttataccagagcctgaaaagcaaagaacaccacaggacaatcagctggcttatgtcgtgattggaatcttgactctggccgccattgttgcagctaacgagatgggcctcctggaaacaaccaagagggatcttggtatgtcaaaagagccaggggtggtctctcctaccagctacctcgacgtagacctgcatcccgccagtgcgtggacattgtatgctgtggccactacggttatcaccccgatgctgcggcacacaatagaaaattccactgcaaacgtgagcttagccgctatcgcaaaccaagccgtcgtgctaatgggcctggataagggatggccaatttctaaaatggacctcggcgtccctcttctggcgttggggtgctactcacaggtgaatcccctgaccctcacagctgccgttctgcttttagtgacccattacgcaatcattggaccaggcctgcaggccaaggctactcgcgaggcccagaaaagaacggcagctggtatcatgaagaaccccacagtagatgggataatgaccattgacctcgatcctgtgatctatgactccaagttcgagaaacaattgggacaggtcatgctgctagttctgtgtgccgtgcagctccttctgatgaggacaagttgggcgttgtgcgaagccctgaccctcgcaacaggcccgatcactaccctgtgggagggtagccccggcaagttttggaatacaacgattgctgtctcgatggccaacatcttccgggggtcttacttagcaggagctggccttgccttttccataatgaaaagcgtggggaccggacgaagaggcactggttcacagggggaaacactgggagagaagtggaaaaagaagctcaatcaactaagtcgcaaagagttcgatctgtataagaaatctggcattaccgaggtagacaggactgaggccaaggaaggtttgaaacggggcgagacaacccaccatgcggtgtcccgtgggagcgctaagctgcagtggtttgttgaaagaaacatggtgatcccagagggaagggtcattgatctcggctgtgggcgcggaggctggtcatactattgcgcaggtcttaaaaaggtgacggaagtccgggggtacaccaagggaggccctggccacgaggagcccgtgcctatgagtacatatgggtggaatatcgttaaactgatgagcggaaaggacgtattctacttgccacccgaaaaatgtgatactctgctctgcgacataggtgagtcctctcctagcccaaccgtggaagagtcccgaacaatcagagtcttaaagatggtggagccctggctgaggaacaatcagttctgtattaaagttcttaacccgtacatgcctactgtgatcgaacacctggagcgcctacagcggaagtatggcgggatgctcgtcagaaatccactgtcacgtaactctacccatgaaatgtactggattagtaatggaacaggcaacatcgtgtcgagcgtaaatatggtgtccaggttgctgctcaaccggtttaccatgactcaccgccgacccacgattgagaaggatgttgaccttggtgccgggacaagacatgtcaacgctgaacctgagaccccaaatatggacgtgatcggagagaggataaaacggattaaggaagaacactcttcaacttggcactatgatgacgaaaacccctacaaaacctgggcctatcatggcagctacgaggtgaaggcaacaggctccgccagttctatgatcaatggggtcgttaaactgttaacgaagccgtgggatgtggtacctatggtgacccaaatggctatgactgacacaacccccttcggacagcagcgcgtctttaaggaaaaagtggatactagaacaccaaggcctatgcccggtacccgaaaggttatggagatcacagcggagtggctgtggcggactttgggccgtaacaaaaagccaagactctgcacccgcgaagagttcacgaaaaaggtgaggaccaatgccgcaatgggggctgtctttacagaagagaaccaatgggacagcgcccgggcagccgtggaagatgaggagttctggaagctggtagacagagaacgcgagctacacaaacttggaaagtgtggctcatgcgtttataatatgatgggtaaaagggaaaagaaactgggggagtttggaaaggctaaaggctcccgagccatttggtacatgtggctcggcgcgcggtacctggagttcgaagcattggggtttctgaacgaggatcattggttcagtagagaaaatagctattctggagtggagggtgaaggcctccacaaacttgggtacatactgagggacatctccaagattcccggaggcgccatgtatgctgatgacactgccggttgggacacccgcatcacagaggatgacttacataacgaggagaaaattactgcacagatggatcctgagcaccgtcagctggctaatgccatctttaagttgacctaccagaacaaagtcgtgaaggtgcaacggccaacgccgaaagggacagtcatggacataatctcaagaaaggatcagaggggaagcggccaggttggcacctatgggctcaatactttcacaaacatggaagctcagctggtgcgccaaatggagggagaaggtgtactatcgaaggccgaccttgagaatccccatctgctcgagaaaaagattacccagtggctggaaactaaaggcgtggagcgattgaagcggatggcaatctctggggatgactgcgtcgtgaaacctattgatgacagatttgcgaacgccttactggctctcaacgatatgggaaaggttaggaaggacatcccacagtggcagcccagtaaaggctggcatgattggcaacaggtgcctttctgttcccaccatttccacgaacttataatgaaggacggtcgcaaactggtcgtgccatgcagaccccaggacgagctaattgggcgggccaggatcagccagggagcaggctggtcactgaaggaaaccgcttgtctcggcaaagcctacgcacaaatgtggtccttgatgtattttcaccgtcgagatctgcgccttgcctctaatgcgatctgcagcgctgtacctgttcattggattccgacaagtagaacgacctggtccatacacgcccatcaccagtggatgactacagaggacatgctgaccgtgtggaaccgggtctggatcgaggataatccatggatggaagacaagactcccgtgacaacctgggaggatgttccttacctcgggaagagggaagaccagtggtgtggcagcttaattggtctgacgtctcgcgcaacatgggcccaaaacatcttgaccgctattcaacaggtgagatcactgatcggcgatgaggagttcctcgactacatgcccagtatgaaacggtttaggaaggaagaggaatccgagggggccatatggtga

SEQ ID NO: 15238 - RNA, 9873 nt, synthetic construct
  misc_feature 1..9873: note = derived and/or modified CDS sequence (opt3) from DENV-3__GQ868628__SS-prME
  source 1..9873: mol_type = other RNA
accagcctgtgcctcatgatgatgcttccagcaacactggctttccacttgacttccagggacggcgaacctaggatgatcgtggggaagaacgaacggggaaaatctttactgtttaagacggcatcaggtattaatatgtgtaccctaatagcaatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaaaagcaaacccacactcgacatcgagctgcagaagaccgaagcaactcagcttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaattcaaagaacacgagtatgagcttttcctgcatcgttattggaataatcacactgtatctaggcgcggtcgtgcaggctgatatgggttgtgtgattaattggaaggggaaggaactcaaatgcggatctggcatcttcgtcaccaacgaggttcacacttggacagagcagtacaagtttcaagccgacagccccaaacggctggcaaccgccattgctggtgcctgggaaaatggcgtgtgtgggatccgatcaactacccgcatggagaaccttttgtggaagcagatagcaaatgaactgaactatatcctctgggagaataacattaaactgacagtggtagtcggagatatcattggcgtgttagaacaggggaagagaacgctgaccccacagcctatggagcttaaatacagttggaagacttggggaaaggctaaaatcgttacagccgagacccaaaattccagcttcataattgacggccccaacacaccagaatgcccctctgcgtcaagggcctggaacgtgtgggaggtcgaagactatggttttggggtgttcactaccaatatctggttgaagctccgggaggtttacacgcagagttgtgatcatcgcctgatgagcgctgcaattaaagacgaaagagccgtgcacgctgatatgggatactggatcgagtcccagaagaacggctcttggaaactagagaaggcctcgtttatagaagtaaagacatgcgcatggcctaaaagccacaccctgtggtccaatggtgtcctcgagtcagacatgatcattccaaagagtctggcgggcccgatctctcagcataaccacaggcccgggtatcatactcaaaccgccggaccttggcaccttggcaaattggaactggatttcaattactgcgaggggacaactgtggtgattaccgagaactgtggaacacgtggccccagcttacggacgaccactgtctccggtaagctcatccacgaatggtgctgtcgatcatgcacactgccccctcttagatatatgggggaggacggatgttggtacggcatggaaataaggccaattaatgagaaagaagagaacatggttaagagcctggtgtctgctggttccggcaaggtagataattttaccatgggggtgttgtgcctcgccatcctgttcgaggaagtcatgcgcggaaaattcggcaagaaacatatgatcgcaggggtgctatttactttcgttctgctcctgagtggacagattacatggcgggacatggctcacacccttatcatgattggcagcaacgcctctgatagaatgggtatgggggtgacgtatttggcactgatagccacttttaagatccagcccttcttagctctcggatttttcctgaggaaacttacctcccgcgagaatctgctactcggcgtcggcctggcgatggccacaaccttgcaactgccggaagacattgagcagatggcaaacgggatcgctttaggactcatgactctgaaacttattacacagtttgaaacctaccagctgtggacagccttggtgtcactcacttgtagtaataccatcttcacgctgacagttgcctggcgaaccgctactctaatactggccggtgtgagccttctccctctgtgccaatcgtcctctatgcggaagaccgattggttgccaatgacagtcgccgcgatgggcgtaccccctctgcccttatttatcttcagcctcaaagacactccaaagcgtagatcatggcctctgaacgagggggtgatggctgttggacttgtgagtattctggcctcctctttgctcaggaatgatgtccccatggcaggcccactggtggccggtgggctactgatcgcttgttatgtaattaccggaacgagcgcagaccttacagtggagaaagccgcggacgtcacctgggaagaggaagctgagcagactggcgtttcccataacctcatgatcacagtggatgacgatggcaccatgcgcataaaggacgatgaaactgagaacattctgacagtgttgttaaaaaccgccctgctcatcgtctcagggatctttccgtacagcattcctgcaacgctgcttgtgtggcacacttggcagaagcagacccaacggagtggagttctgtgggacgtaccctctccacccgagacacagaaagccgaattggaggaaggtgtgtacagaataaagcagcagggcatcttcgggaagacccaagtcggagtgggcgttcagaaagagggtgtgtttcatacaatgtggcacgtcactagaggggctgtgctaacccacaatggaaagcgactggagcctaactgggcctccgtcaaaaaggatctcattagctatggcggcgggtggcgcctgtcggcacagtggcaaaaaggagaagaggtccaggtgatcgctgttgaaccaggtaagaatcccaagaacttccagacgatgcctggcattttccagacaactaccggggagatcggagccatagcgcttgactttaaaccgggcacatcaggttctccaatcattaatcgggaagggaaggtggtcggattatacggcaacggcgtggttaccaaaaatgggggatatgtgagtggtatcgcccaaactaacgcagagcccgatggccctaccccagagctggaagaggaaatgttcaagaaaagaaatctcacaattatggacttgcatcccgggtccggaaagacgaggaagtacctgcctgctatcgtccgtgaggccataaaacgccggctcagaactctgattcttgctccgaccagggtggtagcagccgaaatggaggaggccctgaagggcttgcccatccgatatcagacaaccgctactaaaagcgaacacacaggtcgggagatcgtggatctaatgtgccatgcgacctttacgatgcgcctgctctctccagttagagtccctaactacaatttagtgattatggacgaagcacacttcactgatcccgccagcatcgctgccagggggtatatatccacacgggtgggaatgggcgaggcagccgctatttttatgaccgcgaccccacctggcactgccgaagcattcccccagtcaaacgctccaatccaggacgaggagcgagacattccggaaagaagttggaatagcgggaacgagtggatcacagattttgtcggaaagaccgtatggttcgtgccttctataaaagccggtaatgacattgcaaactgtctgcgcaagaacggcaagaaagttatccaactttccaggaagacatttgatactgaataccagaaaacgcgtctgaatgactgggatttcgtggtcaccacagacatctcagagatgggggccaactttaaggctgatcgggtgattgaccccagaaggtgcctcaaaccagttatcttgactgatggacccgagcgcgtgattctggccggccctatgccagtcaccgcggcaagtgccgctcagcgaagaggtcgggtggggaggaatccccagaaggaaaacgaccaatacatattcacaggccagcctctcaataacgatgaggaccatgcccactggaccgaagctaagatgctgcttgacaatatcaacactccggagggaattatcccagcactattcgaacccgagcgcgagaaaagcgccgctatcgatggcgaatatcgtctgaagggggagtccagaaaaacgtttgtagaattgatgcggaggggagacttacctgtgtggctggcccacaaggttgcatctgagggtattaaatacaccgatcgcaagtggtgcttcgacggcgaacgaaataaccagatactcgaggagaatatggatgtcgaaatctggacaaaagagggggaaagaaagaagctgcggcccaggtggcttgacgcgcgcacttattcggatccactggccctcaaagagtttaaggacttcgctgccggaagaaaaagcattgcattggatctggtgaccgaaatcggcagggtgccttcacatctagctcaccggacacgtaacgccctggacaatctcgtcatgcttcatacctccgagcacggtgggcgcgcataccgacacgccgttgaggaactgcccgagactatggaaacattattgctgctcggcctgatgattcttctgacgggaggcgctatgctctttttgatcagtgggaagggaataggtaaaacctctatcggcctgatttgtgtgatcgtaagctccgggatgttatggatggcggatgtgccactacagtggattgcctcagcaatcgtcctggagttctttatgatggtgctccttatacctgagccggaaaagcaaagaactccccaggacaaccagctggcttatgttgtgattggaatcttgacactggccgccattgtcgcagctaatgagatgggcctcctggaaaccaccaagagggatcttggtatgtctaaagagccaggggtagtgagccctacaagttacctcgacgttgacctgcatcccgcctccgcgtggactttgtatgctgtggccacgaccgtcatcacaccaatgctgcggcacactatagaaaacagcaccgcaaatgtgtctttagccgctatcgcaaaccaagccgtcgtgctaatgggcctggataagggatggcctatttcaaaaatggacctcggcgttccccttctggcgttggggtgctactcccaggtgaacccgctgacactcaccgctgccgtactgcttttagtgactcattacgcaatcattggaccaggcctgcaggccaaggctacgcgcgaggcccagaaaagaacagcagctggtatcatgaagaatcctaccgtcgatgggataatgactattgacctcgatcccgttatctatgacagtaagttcgagaaacaattgggacaggtgatgctgctagtcctgtgtgccgtgcagctccttctgatgaggaccagctgggcgttgtgcgaagccctgacactcgcaactggcccaatcaccacactgtgggagggttcgcccggcaagttttggaacacgaccattgctgtatctatggccaatatcttccgggggtcctacttagcaggagctggccttgcctttagcataatgaaatcagtggggactggacgaagaggcacaggtagtcagggggaaaccctgggagagaagtggaaaaagaagctcaaccaactatctcgcaaagagttcgatctgtataagaaatccggcattactgaggttgacaggacagaggccaaggaaggtttgaaacggggcgagaccacgcaccatgcggtgagccgtgggtcagctaagctgcagtggtttgtcgaaagaaatatggtgatccctgagggaagggtcattgatctcggctgtgggcgcggaggctggagttactattgcgcaggtcttaaaaaggtgaccgaagttcgggggtacacaaagggaggcccgggccacgaggagcccgtaccaatgagcacttatgggtggaacatcgtgaaactgatgtccggaaaggacgtcttctacttgcctcccgaaaaatgtgataccctgctctgcgacataggtgagtctagcccttccccaacagtggaagagtcacgaactatcagagttttaaagatggtggagccctggctgaggaataaccagttctgtattaaagtccttaatccttacatgccaaccgtgatcgaacacctggagcgcctacagcggaagtatggcgggatgctcgtaagaaaccccctgtctcgtaatagtacacatgaaatgtactggatttcgaacggaaccggcaatatcgtgagctccgttaacatggtctctaggttgctgctcaatcggtttactatgacgcaccgccgaccgacaattgagaaggatgtggaccttggtgccgggaccagacatgtgaacgctgaacctgagactccaaacatggacgtcatcggagagaggataaaacggattaaggaagaacactcaagcacctggcactatgatgacgaaaatccctacaaaacatgggcctatcatggctcctacgaggttaaggcaacgggcagtgcctctagcatgatcaacggggtggtaaaactgttaaccaagccttgggatgtggtcccaatggtgactcaaatggctatgacagacaccactcccttcggacagcagcgcgtttttaaggaaaaagtggatacaagaaccccgaggcctatgcccggtacacgaaaggtcatggagatcactgcggagtggctgtggcggaccttgggccgtaataaaaagccaagactctgcacgcgcgaagagttcaccaaaaaggtgaggacaaacgccgcaatgggggctgtatttactgaagagaatcaatgggactcagcccgggcagccgttgaagatgaggagttctggaagctggtggacagagaacgcgagctacacaaacttggaaagtgtggctcctgcgtctataacatgatgggtaaaagggaaaagaaactgggggagtttggaaaggctaaaggcagtcgagccatttggtacatgtggctcggcgcgcggtacctggagttcgaagcattggggtttctgaatgaggatcattggttcagcagagaaaactcttattccggagtggagggtgaaggcctccacaaacttgggtacatactgagggacatctcaaagattcctggaggcgccatgtatgctgatgacaccgccggttgggacacacgcatcactgaggatgacttacataatgaggagaaaattacccagcagatggatcccgagcaccgtcagctggcaaacgctatctttaagttgacgtaccaaaataaagtggtcaaggttcagcggccaacacccaaagggaccgtgatggacataatcagcagaaaggatcagaggggatcgggccaggtaggcacttatgggctcaacacattcaccaatatggaagcccaactggtgcgccagatggagggagaaggtgtcctatctaaggctgaccttgagaaccctcatctgctcgagaaaaagattactcagtggctggaaaccaaaggcgtggagcgattgaagcggatggccatcagtggggatgactgcgttgtgaaaccaattgatgacagatttgcaaatgcgttactggccctcaacgatatgggaaaggtcaggaaggacatcccgcagtggcaaccctccaaaggctggcatgattggcaacaggtgcctttctgtagccaccatttccacgaacttataatgaaggacggtcgcaaactggtagttccatgcagaccccaggacgagctaattgggcgggctaggatctcacaaggagccggctggtccctgaaggaaacagcatgtctcggcaaggcttacgcccagatgtggtctttgatgtattttcaccgtcgagatctgcgccttgcaagcaacgccatctgcagtgcggtgcctgtccattggattccaacgtccagaaccacttggagcatacacgctcatcaccagtggatgacaaccgaggacatgctgactgtgtggaatcgggtttggatcgaggataacccctggatggaagacaagacacctgtgaccacgtgggaggatgtcccgtacctcgggaagagggaagaccaatggtgtggatctttaattggtctgacatcacgcgccacctgggcacagaatatcttgactgccattcaacaggtgagaagtctgatcggcgatgaggagttcctcgactacatgccatccatgaaacggtttaggaaggaagaggaaagcgagggggctatatggtga

SEQ ID NO: 15239 - RNA, 9873 nt, synthetic construct
  misc_feature 1..9873: note = derived and/or modified CDS sequence (opt3) from DENV-3__FJ639727__SS-prME
  source 1..9873: mol_type = other RNA
accagcctgtgcctcatgatgatgcttcccgccactctggctttccacttgacttccagggacggcgaacctaggatgatcgtggggaagaatgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtcgccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcagcttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaagagccacaacgggcgtctgattacagctaacccagtagtcactaaaaaggaggagcccgtgaatatcgaagcggagccgcctttcggcgaaagtaacatagttattggaatcggcgacaaagcactcaagatcaattggtataagaaagggtcttccattggaaagatgtttgaggccaccgctcgcggtgccagaaggatggcaatcctgggcgatacagcctgggacttcgggagcgtgggaggcgtccttaactcgctgggtaaaatggtgcatcagatttttgggtctgcttacactgccttgttctccggcgtatcatggataatgaagatcggaattggcgtgctcctgacctggatcgggttaaatagtaaaaacacgagcatgtccttttcttgcatcgttattggaataatcacactgtatctaggcgcagtcgtgcaggcggatatgggttgtgtgattaattggaaggggaaggaactcaaatgcggaagcggcatcttcgtcaccaacgaggttcacacttggacagagcagtacaagtttcaagctgactcacccaaacggctggccaccgcaattgccggtgcttgggaaaatggcgtgtgtgggatccgaagtactacccgcatggagaaccttttgtggaagcagatagccaatgaactgaactatatcctctgggagaataacattaaactgacagtggtagtcggagatatcattggcgtgttagaacaggggaagagaacgctgaccccacagcctatggagcttaaatactcctggaagacttggggaaaggcaaaaatcgttacagctgagacccaaaatagctctttcataattgacggccccaacacaccagaatgcccctcagccagtagggcgtggaacgtgtgggaggtcgaagactatggttttggggtgttcactaccaatatctggttgaagctccgggaggtttacacgcagagctgtgatcatcgcctgatgtccgccgctattaaagacgaaagagcagtgcacgccgatatgggatactggatcgagtctcagaagaacggctcgtggaaactagagaaggctagctttatagaagtaaagacatgcacctggcctaaatcccacactctgtggtcaaatggtgtcctcgagagtgacatgatcattccaaagtctctggccggcccgatcagccagcataaccacaggcccgggtattacacccaaacagcaggaccttggcatcttggcaaattggaactggatttcaattattgcgaggggactaccgtggtgattacagagaactgtggaacgcgtggcccatccttacggaccactacagtctcaggtaagctcatccacgaatggtgctgtcgaagctgcaccctgccccctcttagatacatgggggaggacggatgttggtatggcatggaaataaggccaattaatgagaaagaagagaacatggttaagtctctggtgtccgcgggtagtggcaaggtagataattttactatgggggtgttgtgcctcgccatcctgttcgaggaagtcatgcgcggaaaattcggcaagaaacacatgatcgctggggccctatttacattcgtgctgctcctgagcggacagattacctggcgggacatggcacatacgcttatcatgattggctctaacgcttccgatagaatgggtatgggggttacttacttggccctgatagcaacctttaagatccagcccttcttagccctcggatttttcctgaggaaacttacatcacgcgagaatctgctactcggcgtgggcctggctatggcgaccactttgcaactgccggaagacattgagcagatggccaacgggatcgcattaggactcatgacactgaaacttattacccagtttgaaacatatcagctgtggactgctttggtcagtctcacctgtagcaatacgatcttcacactgaccgtggcctggcgaactgccaccctaatactggctggtgtttcgcttctccctctgtgccaatcctctagcatgcggaagacagattggttgccaatgactgtggcagccatgggcgtaccccctctgcccttatttatcttctcactcaaagacaccccaaagcgtagaagttggcctctgaacgagggggtaatggcggtgggacttgtttccattctggcttctagcttgctcaggaatgatgtgcccatggccggcccactggtcgcgggtgggctactgatcgcctgttacgtgattacgggaacatccgctgaccttaccgtagagaaagcagccgacgtgacttgggaagaggaagcggagcagacaggcgtctcacacaacctcatgatcaccgttgatgacgatggcactatgcgcataaaggacgatgaaacagagaacattctgaccgtgttgttaaaaacggctctgctcatcgtgagcgggatctttccgtacagtattcctgccactctgcttgtctggcatacctggcagaagcagacacaacggtctggagtgctgtgggacgttccctccccacccgagacccagaaagcagaattggaggaaggtgtatatagaataaagcagcagggcatcttcgggaagacacaagtgggagtcggcgtgcagaaagagggtgtttttcacactatgtggcatgtgacccgaggggcagtcctaacgcacaatggaaagaggctggagcctaactgggctagcgtgaaaaaggatctcatttcgtacggcggcgggtggcgcctgtcagcccagtggcaaaaaggagaagaggtacaggtcatcgcagtggaaccaggtaagaatcccaagaacttccagacaatgcctggcattttccagactaccacaggggagatcggagctatagcccttgactttaaaccgggcacctctggtagtccaatcattaatcgggaagggaaggttgtgggattatatggcaacggcgtcgtgactaaaaatgggggatacgtttccggtatcgcgcaaaccaacgccgagcccgatggccctacaccagagctggaagaggaaatgttcaagaaaagaaatctcacgattatggacttgcaccccgggagcggaaagactaggaagtatctgcctgcaatcgtgcgtgaggctataaaacgccggctcagaaccctgattcttgccccgacaagggtcgtggctgcagaaatggaggaggccctgaagggcttgcccatccgataccagaccactgccacaaaatctgaacataccggtcgggagatcgtagatctaatgtgccacgctacgtttactatgcgcctgctcagcccagtgagagttcctaactataatttagtcgtgatggacgaagcgcatttcacagatcccgcatccattgccgctagggggtacatctcaacccgggtgggaatgggcgaggccgcagccatatttatgaccgctactccacctggcacagcggaagccttcccccagagtaacgcaccaattcaggacgaggagcgagacatcccggaaagaagctggaactctgggaacgagtggattaccgattttgtcggaaagacagtatggttcgtgccttccatcaaagctggtaatgacatagccaactgtctgcgcaagaacggcaagaaagttattcaactttcaaggaagacttttgatacggaataccagaaaacccgtctgaatgactgggatttcgtggtcacaactgacatcagtgagatgggggcaaactttcgggccgatagagtgatcgaccccaggcgctgcctcaagccagttattttgaccgatggacccgagcgagtgatcctggctggccctatgccagtcacagccgcgagcgcagcccagagacggggtagggtggggcgcaatccccagaaagaaaacgaccaatatattttcaccggccagcctctcaataacgatgaggaccacgctcattggactgaagccaagatgctgcttgacaatataaacacgccggagggaatcattccagctctattcgaacccgagcgtgagaagtccgcagccatcgatggcgaatacagactgaaaggggagtctcggaagacctttgtagaattgatgaggcgcggagacttacctgtgtggctggctcacaaagttgcctcggagggtatcaagtatacagatcgaaaatggtgcttcgacggcgaaagaaataaccagattctcgaggagaatatggatgtcgaaatatggactaaggagggggaacggaaaaagctgaggccccgctggcttgacgcaagaacctacagcgatccactggcgctcaaggagtttaaagacttcgccgctggaaggaagtcaatcgccttggatctggtgacagaaattggccgggtgccttcccacctagcacatcgtacccgcaacgctctggacaatctcgtcatgcttcacacaagtgagcatggtgggcgagcctatagacacgcagttgaggaactgcccgagacaatggaaacgttattgctgctcggcctgatgatccttctgaccggaggcgccatgctctttttgatttctgggaaaggaatcggtaagactagcataggcctgatctgtgtgattgtatcctcagggatgttatggatggctgatgtgccactacagtggatcgcgtctgccattgtcctggagttctttatgatggtgctccttatccctgagccggaaaaacaaaggacaccccaggacaaccagctggcatacgttgtgataggaattttgaccctggctgccatcgtcgccgcaaatgagatgggcctcctggaaaccacaaagcgggatcttggtatgagcaaggagccaggggtagtgagtcctacttcctatctcgacgttgacctgcaccccgctagcgcctggacgttgtacgcggtggctaccacagtcattactccaatgctgcgccataccatcgaaaactctacagccaatgtgtcattagcagccatagctaaccaagcagtcgtgctaatgggcctggataaaggatggcctatctccaagatggacctcggcgttccccttctggccttggggtgctacagtcaggtgaacccgctgaccctcactgcggctgtactgcttttagtgacgcactatgccattatcggaccaggcctgcaggcaaaagccacaagagaggctcagaagaggaccgccgcaggtattatgaaaaatcctactgtcgatgggatcatgaccatagacctcgatcccgttatttacgacagcaagttcgagaagcaattgggacaggtgatgctgctagtcctgtgtgctgtgcagctccttctgatgcggacatcgtgggccttgtgcgaagcgctgactctcgccaccggcccaatcacaacgctgtgggagggttctcccggcaaattttggaacaccactatcgcagtatccatggctaatattttccgagggagctatttagccggagcaggccttgctttttcaatcatgaagagtgtggggacaggaagacgcggcaccggttctcagggggaaactctgggagagaaatggaagaaaaagctcaaccaactatccaggaaggagttcgatctgtacaaaaagagcggcataacagaggttgaccggaccgaggccaaagaaggtttgaagcgtggcgagacgacccatcacgccgtgtcaagagggagtgcgaaactgcagtggtttgtcgaaaggaatatggtgattcctgagggacgcgtcatcgatctcggctgtgggcggggaggctggagctattactgcgctggtcttaagaaagtgacagaagttcgagggtatactaagggaggcccgggccatgaggagcccgtaccaatgtccacctacgggtggaacattgtgaagctgatgtctggaaaagacgtcttctacttgcctcccgaaaagtgtgatacactgctctgcgacatcggtgagagctccccttcaccaactgtggaagagtctagaaccataagggttttaaaaatggtggagccctggctgcgcaataaccagttctgtatcaaggtccttaatccttatatgccaacagtgattgaacacctggagcggctacagagaaaatacggcgggatgctcgtacgtaaccccctgagtagaaattcgacccacgaaatgtattggatcagcaacggaactggcaatattgtgtcctctgttaacatggtctcacggttgctgctcaatcgctttacgatgacacatcgaagaccgaccatcgagaaggatgtggaccttggtgcagggactaggcacgtgaacgccgaacctgagaccccaaacatggacgtcattggagagcggatcaagcgcataaaagaagaacacagctccacatggcactacgatgacgaaaatccctataagacgtgggcttaccacggcagttatgaggttaaagccaccggctctgcaagctcaatgattaacggggtggtaaagctgttaactaaaccttgggatgtggtcccaatggtgacacaaatggccatgaccgacactacacccttcggacagcagagagtttttaaggaaaaggtggataccaggacaccgcgacctatgcccggtactcggaaagtcatggagatcaccgctgagtggctgtggcgtacgttgggcagaaataagaaaccacgcctctgcaccagggaagagttcacaaagaaagtgcggactaacgcggccatgggggcagtatttaccgaagagaatcaatgggactccgctagagccgcagttgaagatgaggagttctggaagctggtggaccgcgaaagggagctacataaacttggaaaatgtggcagttgcgtctacaacatgatgggtaagcgagagaagaagctgggggagtttggaaaagccaagggcagccgggctatctggtacatgtggctcggcgccagatatctggagttcgaagcgttggggtttctgaatgaggatcactggttctctagggaaaactcctactcaggagtggagggtgaaggcctccataaacttgggtatattctgcgcgacataagcaagatccctggaggcgcaatgtacgccgatgacacagctggttgggacactcgtattaccgaggatgacttacacaatgaggaaaagatcacgcagcagatggatcccgagcatcggcagctggccaacgcaatttttaaattgacatatcaaaataaggtggtcaaagttcagagaccaacccccaaggggactgtgatggacatcatatcgaggaaagatcagcgcggatctggccaggtaggcacatacgggctcaacaccttcactaatatggaagctcaactggtgcgacagatggagggagaaggtgtcctaagtaaggccgaccttgagaaccctcatctgctcgagaagaaaatcacccagtggctggaaacaaagggcgtggagcggttgaaaagaatggctatttccggggatgactgcgttgtgaagccaatcgatgacaggtttgccaatgcattactggcgctcaacgatatgggaaaagtccgcaaggacattccgcagtggcaacccagcaagggctggcacgattggcaacaggtgcctttctgttcacatcacttccatgaacttatcatgaaagacggtagaaagctggtagttccatgccggccccaggacgagctaatagggagggcccgtatttcccaaggagctggctggtctctgaaagaaacggcctgtctcggcaaggcatatgctcagatgtggagcttgatgtactttcaccgacgcgatctgagacttgccagtaacgcaatctgctccgccgtgcctgtccactggatcccaaccagccggactacatggtctattcatgcgcaccatcagtggatgaccactgaggacatgctgacagtgtggaatagggtttggatagaggataacccctggatggaagacaaaacccctgtgacgacatgggaggatgtcccgtacctcgggaagcgcgaagaccaatggtgtggatcattaatcggtctgaccagtagagctacttgggcccagaatattttgaccgcaatccaacaggtgcggtccctgattggcgatgaggagttcctcgactatatgccaagcatgaagaggtttcgaaaagaagaggaatctgagggggccatctggtga

SEQ ID NO: 15240 - RNA, 9873 nt, synthetic construct
  misc_feature 1..9873: note = derived and/or modified CDS sequence (opt3) from DENV-3__GQ868629__SS-prME
  source 1..9873: mol_type = other RNA
acaagcctgtgcctcatgatgatgcttccagccacactggctttccacttgacttccagagacggcgaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcagcttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgatcaccgagactccaacatggaacaggaaagaactgttggtgacgtttaagaatgcccatgccaagaagcaagaggtcgtggtcctcggctcacaggaaggagctatgcacaccgccctgactggcgctacagagatccagaacagtgggggaaccagcattttcgccggtcacttaaagtgtcggctgaaaatggataagctagaactcaaaggcatgtcttacgcaatgtgcctgaatacatttgtgcttaagaaagaggtttccgagactcagcatgggaccatattgatcaaggtggaatacaagggagaggacgccccctgtaaaattcctttctcaacggaagatggccaaggtaaggctcacaacgggcgtctgatcaccgcgaacccagtagtcaccaaaaaggaggagcccgtgaatatagaagcagagccgcctttcggcgaaagcaacattgttatcggaatcggcgacaaagccctcaagattaattggtataagaaagggagttctatcggaaagatgtttgaggctactgcccgcggtgcaagaaggatggccattctgggcgataccgcttgggacttcgggtccgtgggaggcgtccttaacagcctgggtaaaatggtgcatcagatatttgggtcggcctacacagcattgttctctggcgtatcctggatcatgaagattggaatcggcgtgctcctgacttggatcgggttaaattcaaagaacaccagtatgagcttttcctgcattgttataggaatcattacgctgtatctaggcgcggtcgtgcaggctgatatgggttgtgtgatcaattggaaggggaaggaactcaaatgcggatctggcattttcgtcacaaacgaggttcacacctggactgagcagtacaagtttcaagccgacagccccaaacggctggcaacagccatcgctggtgcctgggaaaatggcgtgtgtgggatacgatcaaccactcgcatggagaaccttttgtggaagcagatcgcaaatgaactgaactatattctctgggagaataacatcaaactgaccgtggtagtcggagatattatcggcgtgttagaacaggggaagagaacactgacgccacagcctatggagcttaaatacagttggaagacctggggaaaggctaaaatagttactgccgagacacaaaattccagcttcattatcgacggccccaacaccccagaatgcccctctgcgtcaagggcctggaacgtgtgggaggtcgaagactatggttttggggtgttcacaactaatatttggttgaagctccgggaggtttacacccagagttgtgatcatcgcctgatgagcgctgcaatcaaagacgaaagagccgtgcacgctgatatgggatactggatagagtcccagaagaacggctcttggaaactagagaaggcctcgtttatcgaagtaaagacgtgcacatggcctaaaagccacaccctgtggtccaatggtgtcctcgagtcagacatgattatcccaaagagtctggcaggcccgatttctcagcataaccacaggcccgggtatcatactcaaaccgcgggaccttggcaccttggcaaattggaactggatttcaattactgcgaggggacaactgtggtgatcaccgagaactgtggaacacgtggccccagcttacggacgaccactgtctccggtaagctcatacacgaatggtgctgtcgatcatgcacactgccccctcttagatatatgggggaggacggatgttggtacggcatggaaattaggccaatcaatgagaaagaagagaacatggttaagagcctggtgtctgccggttccggcaaggtagataattttaccatgggggtgttgtgcctcgctatcctgttcgaggaagtcatgcgcggaaaattcggcaagaaacatatgattgccggggtgctatttactttcgttctgctcctgagtggacagatcacatggcgggacatggcacacacccttattatgataggcagcaacgcttctgatagaatgggtatgggggtgacgtatttggccctgatcgcaacttttaagattcagcccttcttagccctcggatttttcctgaggaaacttacctcccgcgagaatctgctactcggcgtcggcctggctatggcgacaaccttgcaactgccggaagacatcgagcagatggccaacgggattgcattaggactcatgactctgaaacttatcacacagtttgaaacctaccagctgtggacagctttggtgtcactcacttgtagtaataccatattcacgctgacagttgcctggcgaaccgccactctaatcctggctggtgtgagccttctccctctgtgccaatcgtcctctatgcggaagaccgattggttgccaatgacagtcgcagccatgggcgtaccccctctgcccttatttattttcagcctcaaagacactccaaagcgtagatcatggcctctgaacgagggggtgatggcggttggacttgtgagtatcctggcttcctctttgctcaggaatgatgtccccatggccggcccactggtggcgggtgggctactgattgcctgttatgtaatcaccggaacgagcgctgaccttacagtggagaaagcagccgacgtcacctgggaagaggaagcggagcagactggcgtttcccataacctcatgataacagtggatgacgatggcaccatgcgcattaaggacgatgaaactgagaacatcctgacagtgttgttaaaaaccgctctgctcatcgtctcagggatttttccgtacagcatacctgccacgctgcttgtgtggcacacttggcagaagcagacccaacggagtggagttctgtgggacgtaccctctccacccgagacacagaaagcagaattggaggaaggtgtgtacagaatcaagcagcagggcattttcgggaagacccaagtcggagtgggcgttcagaaagagggtgtgtttcatacaatgtggcacgtcactcgaggggcagtgctaacccacaatggaaagaggctggagcctaactgggcttccgtcaaaaaggatctcatcagctatggcggcgggtggcgcctgtcggcccagtggcaaaaaggagaagaggtccaggtgattgcagttgaaccaggtaagaatcccaagaacttccagacgatgcctggcatcttccagacaactaccggggagataggagctatcgcccttgactttaaaccgggcacatcaggttctccaattatcaatcgggaagggaaggtggtcggattatacggcaacggcgtggttaccaaaaatgggggatatgtgagtggtattgcgcaaactaacgccgagcccgatggccctaccccagagctggaagaggaaatgttcaagaaaagaaatctcacaatcatggacttgcatcccgggtccggaaagacgaggaagtacctgcctgcaatagtccgtgaggctattaaacgccggctcagaactctgatccttgccccgaccagggtggtagctgcagaaatggaggaggccctgaagggcttgcccatccgatatcagacaaccgccactaaaagcgaacacacaggtcgggagattgtggatctaatgtgccatgctacctttacgatgcgcctgctctctccagttagagtccctaactacaatttagtgatcatggacgaagcgcacttcactgatcccgcaagcatagccgctagggggtatatttccacacgggtgggaatgggcgaggccgcagccatctttatgaccgctaccccacctggcactgcggaagccttcccccagtcaaacgcaccaattcaggacgaggagcgagacatcccggaaagaagttggaatagcgggaacgagtggataacagattttgtcggaaagaccgtatggttcgtgccttctattaaagctggtaatgacatcgccaactgtctgcgcaagaacggcaagaaagttatccaactttccaggaagacatttgatactgaataccagaaaacgcgtctgaatgactgggatttcgtggtcaccacagacatttcagagatgggggcaaactttaaggccgatcgggtgatcgaccccagaaggtgcctcaaaccagttattttgactgatggacccgagcgcgtgatactggctggccctatgccagtcaccgccgcgagtgcagcccagcgaagaggtcgggtggggaggaatccccagaaggaaaacgaccaatacatcttcacaggccagcctctcaataacgatgaggaccatgctcactggaccgaagccaagatgctgcttgacaatattaacactccggagggaatcatcccagctctattcgaacccgagcgcgagaaaagcgcagccattgatggcgaatatcgtctgaagggggagtccagaaaaacgtttgtagaattgatgcggaggggagacttacctgtgtggctggctcacaaggttgcctctgagggtataaaatacaccgatcgcaagtggtgcttcgacggcgaacgaaataaccagatcctcgaggagaatatggatgtcgaaatttggacaaaagagggggaaagaaagaagctgcggcccaggtggcttgacgcacgcacttattcggatccactggcgctcaaagagtttaaggacttcgccgctggaagaaaaagcatcgccttggatctggtgaccgaaattggcagggtgccttcacatctagcacaccggacacgtaacgctctggacaatctcgtcatgcttcatacctccgagcacggtgggcgcgcctaccgacacgcagttgaggaactgcccgagactatggaaacattattgctgctcggcctgatgatccttctgacgggaggcgccatgctctttttgataagtgggaagggaatcggtaaaacctctattggcctgatctgtgtgattgtaagctccgggatgttatggatggctgatgtgccactacagtggatcgcgtcagccatagtcctggagttctttatgatggtgctccttattcctgagccggaaaagcaaagaactccccaggacaaccagctggcatatgttgtgatcggaattttgacactggctgccatcgtcgccgcaaatgagatgggcctcctggaaaccaccaagagggatcttggtatgtctaaagagccaggggtagtgagccctacaagttacctcgacgttgacctgcatcccgcttccgcctggactttgtatgcggtggctacgaccgtcataacaccaatgctgcggcacactatcgaaaacagcaccgccaatgtgtctttagcagccattgctaaccaagcagtcgtgctaatgggcctggataagggatggcctatctcaaaaatggacctcggcgttccccttctggccttggggtgctactcccaggtgaacccgctgacactcaccgcggctgtactgcttttagtgactcattacgccattatcggaccaggcctgcaggcaaaggccacgcgcgaggctcagaaaagaacagccgcaggtataatgaagaatcctaccgtcgatgggattatgactatcgacctcgatcccgttatctatgacagtaagttcgagaaacaattgggacaggtgatgctgctagtcctgtgtgctgtgcagctccttctgatgaggaccagctgggccttgtgcgaagcgctgacactcgccactggcccaattaccacactgtgggagggttcgcccggcaagttttggaacacgaccatcgcagtatctatggctaatatattccgggggtcctacttagccggagcaggccttgcttttagcattatgaaatcagtggggactggacgaagaggcacaggtagtcagggggaaaccctgggagagaagtggaaaaagaagctcaaccaactatctcgcaaagagttcgatctgtataagaaatccggcatcactgaggttgacaggacagaggccaaggaaggtttgaaacggggcgagaccacgcaccatgccgtgagccgtgggtcagcgaagctgcagtggtttgtcgaaagaaatatggtgattcctgagggaagggtcatcgatctcggctgtgggcgcggaggctggagttactattgcgctggtcttaaaaaggtgaccgaagttcgggggtacacaaagggaggcccgggccacgaggagcccgtaccaatgagcacttatgggtggaacatagtgaaactgatgtccggaaaggacgtcttctacttgcctcccgaaaaatgtgataccctgctctgcgacatcggtgagtctagcccttccccaacagtggaagagtcacgaactattagagttttaaagatggtggagccctggctgaggaataaccagttctgtatcaaagtccttaatccttacatgccaaccgtgattgaacacctggagcgcctacagcggaagtatggcgggatgctcgtaagaaaccccctgtctcgtaatagtacacatgaaatgtactggatctcgaacggaaccggcaatattgtgagctccgttaacatggtctctaggttgctgctcaatcggtttactatgacgcaccgccgaccgacaatcgagaaggatgtggaccttggtgcagggaccagacatgtgaacgccgaacctgagactccaaacatggacgtcataggagagaggattaaacggatcaaggaagaacactcaagcacctggcactatgatgacgaaaatccctacaaaacatgggcttatcatggctcctacgaggttaaggccacgggcagtgcatctagcatgatcaacggggtggtaaaactgttaaccaagccttgggatgtggtcccaatggtgactcaaatggccatgacagacaccactcccttcggacagcagcgcgtttttaaggaaaaagtggatacaagaaccccgaggcctatgcccggtacacgaaaggtcatggagattactgctgagtggctgtggcggaccttgggccgtaataaaaagccaagactctgcacgcgcgaagagttcaccaaaaaggtgaggacaaacgcggccatgggggcagtatttactgaagagaatcaatgggactcagctcgggccgcagttgaagatgaggagttctggaagctggtggacagagaacgcgagctacacaaacttggaaagtgtggctcctgcgtctataacatgatgggtaaaagggaaaagaaactgggggagtttggaaaggccaaaggcagtcgagctatatggtacatgtggctcggcgcccggtacctggagttcgaagcgttggggtttctgaatgaggatcattggttcagcagagaaaactcttattccggagtggagggtgaaggcctccacaaacttgggtacatcctgagggacatttcaaagatccctggaggcgcaatgtatgccgatgacaccgctggttgggacacacgcattactgaggatgacttacataatgaggagaaaatcacccagcagatggatcccgagcaccgtcagctggccaacgcaatatttaagttgacgtaccaaaataaagtggtcaaggttcagcggccaacacccaaagggaccgtgatggacatcattagcagaaaggatcagaggggatcgggccaggtaggcacttatgggctcaacacattcaccaatatggaagctcaactggtgcgccagatggagggagaaggtgtcctatctaaggccgaccttgagaaccctcatctgctcgagaaaaagatcactcagtggctggaaaccaaaggcgtggagcgattgaagcggatggctattagtggggatgactgcgttgtgaaaccaatcgatgacagatttgccaatgcattactggcgctcaacgatatgggaaaggtcaggaaggacataccgcagtggcaaccctccaaaggctggcatgattggcaacaggtgcctttctgtagccaccatttccacgaacttattatgaaggacggtcgcaaactggtagttccatgcagaccccaggacgagctaatcgggcgggccaggatctcacaaggagctggctggtccctgaaggaaacagcctgtctcggcaaagcatacgctcagatgtggtctttgatgtattttcaccgtcgagatctgcgccttgccagcaacgcaatttgcagtgccgtgcctgtccattggataccaacgtccagaaccacttggagcatccacgcgcatcaccagtggatgacaaccgaggacatgctgactgtgtggaatcgggtttggattgaggataacccctggatggaagacaagacacctgtgaccacgtgggaggatgtcccgtacctcgggaagagggaagaccaatggtgtggatctttaatcggtctgacatcacgcgctacctgggcccagaatattttgactgcaatccaacaggtgagaagtctgataggcgatgaggagttcctcgactacatgccatccatgaaacggtttaggaaggaagaggaaagcgagggggccatctggtga

SEQ ID NO: 15241 - RNA, 9873 nt, synthetic construct
  misc_feature 1..9873: note = derived and/or modified CDS sequence (opt3) from DENV-3__FJ639728__SS-prME
  source 1..9873: mol_type = other RNA
accagcctgtgcctcatgatgatgcttcccgcaacactggctttccacttgacttccagagacggcgaacctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaaaagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaatagtaaaaacacgtcaatgagcttttcctgcatcgttattggaataatcacactgtatctaggcgcggtcgtgcaggctgatatgggttgtgtgattaattggaaggggaaggaactcaaatgcggatctggcatcttcgtcaccaacgaggttcacacttggacagagcagtacaagtttcaagccgacagccccaaacggctggcaaccgccattgctggtgcctgggaaaatggcgtgtgtgggatccgatcaactacccgcatggagaaccttttgtggaagcagatagcaaatgaactgaactatatcctctgggagaataacattaaactgacagtggtagtcggagatatcattggcgtgttagaacaggggaagagaacgctgaccccacagcctatggagcttaaatacagttggaagacttggggaaaggctaaaatcgttacagccgagacccaaaattccagcttcataattgacggccccaacacaccagaatgcccctctgcgttgagggcctggaacgtgtgggaggtcgaagactatggttttggggtgttcactaccaatatctggctcaagctgcgggaggtttacacgcagtcatgtgatcatcgcctaatgagtgctgcaattaaagacgaaagagccgtgcacgctgatatgggatactggatcgagagccagaagaacggctcctggaaactggagaaggcctcttttatagaagtaaagacatgcacctggcctaaatcgcacactctctggagcaatggtgtcctggagtccgacatgatcattccaaagtcacttgcaggcccgatcagtcagcataaccacaggcccgggtatcatacccaaacagcgggaccttggcacttgggcaaactggaattagatttcaattactgcgaggggactaccgtggtgattacagagaactgtggaacgcgtggcccatctctccggaccactacagtcagcggtaagctgatccacgaatggtgctgtcgatcctgcacccttccccctctgagatatatgggggaggacggatgttggtacggcatggaaataaggccaattaatgagaaagaagagaacatggttaagtcattggtgagcgccggttctggcaaggtagataattttactatgggggtgctctgcctggctatcctattcgaggaagtcatgcgcggaaaattcggcaagaaacatatgatcgccggggtgctgtttacattcgttctcctgctttccggacagattacctggcgggacatggcacacacgttgatcatgattggcagtaacgctagcgatagaatgggtatgggggtgacttatctggccttaatagcaacctttaagatccagcccttcctcgccctgggatttttccttaggaaactgacatctcgcgagaatctactcctgggcgtcggcttggctatggcgaccactctgcaattaccggaagacattgagcagatggccaacgggatcgcactcggactgatgacacttaagctgattacccagtttgaaacataccagttgtggactgctctcgtgtccctgacctgttcaaatacgatcttcacactaaccgttgcctggcgaactgccaccctgatacttgctggtgtgagtctcctgcctttgtgccaaagctcgtccatgcggaagacagattggctgccaatgactgtcgcagccatgggcgtaccccctttacccctctttatcttctctctgaaagacaccccaaagcgtagaagctggcctcttaacgagggggtgatggcggttggactggtgtcaattttggctagttccctcctgaggaatgatgtccccatggccggcccgctagtagccggtgggctgcttatcgcctgttatgtaattacgggaacatctgctgacctcaccgtggagaaagcagccgacgtcacttgggaagaggaagcggagcagacaggcgttagccataacctgatgatcaccgtggatgacgatggcactatgcgcataaaggacgatgaaacagagaacattttgaccgtgttactgaaaacggctctcctgatcgtctccgggatctttccatactcaattcctgccactcttctggtgtggcacacctggcagaagcagacacaacggagcggagttttgtgggacgtacccagtccacccgagacccagaaagcagaactagaggaaggtgtgtacagaataaagcagcagggcatcttcgggaagacacaagtcggagtgggcgttcagaaagagggtgtgtttcatactatgtggcacgtcacccgaggggcagtgctgacgcacaatggaaagaggctcgagcctaactgggcttctgtgaaaaaggatctgatttcctatggcggcgggtggcgccttagcgcccagtggcaaaaaggagaagaggtccaggtgatcgcagttgaaccaggtaagaatcccaagaacttccagacaatgcctggcattttccagactaccacaggggagatcggagctatagccttagactttaaaccgggcacctcgggttcaccaatcattaatcgggaagggaaggtggtcggactgtacggcaacggcgtggttactaaaaatgggggatatgtgtctggtatcgcgcaaaccaacgccgagcccgatggccctacaccagagctcgaagaggaaatgttcaagaaaagaaatttgacgattatggacctgcatcccgggagtggaaagactaggaagtacctccctgcaatcgtccgtgaggctataaaacgccggctgagaacccttattctggccccgacaagggtggtagctgcagaaatggaggaggccttgaagggcctacccatccgatatcagaccactgccacaaaatccgaacacaccggtcgggagatcgtggatctgatgtgccatgctacgtttactatgcgcctcttaagcccagttagagtccctaactacaatctggtgattatggacgaagcgcacttcacagatcccgcatctatcgccgctagggggtatataagcacccgggtgggaatgggcgaggccgcagccatttttatgaccgctactccacctggcacagcggaagccttcccccagtccaacgcaccaatccaggacgaggagcgagacattccggaaagatcatggaatagtgggaacgagtggatcaccgattttgtcggaaagacagtatggttcgtgcctagcataaaagctggtaatgacattgccaactgtcttcgcaagaacggcaagaaagttatccaactgtctaggaagacttttgatacggaataccagaaaacccgtctcaatgactgggatttcgtggtcacaactgacatctccgagatgggggcaaactttaaggccgatcgggtgattgaccccagaaggtgcttgaaaccagttatcctgaccgatggacccgagcgcgtgattctcgctggccctatgccagtcacagccgcgtcagcagcccagcgaagaggtcgggtggggaggaatccccagaaggaaaacgaccaatacatattcaccggccagcctctgaataacgatgaggaccatgctcactggactgaagccaagatgcttctagacaatatcaacacgccggagggaattatcccagctctgttcgaacccgagcgcgagaaaagtgcagccatcgatggcgaatatcgtttgaagggggagagcagaaaaacctttgtagaattaatgcggaggggagacctgcctgtgtggctcgctcacaaggttgcctccgagggtattaaatacacagatcgcaagtggtgcttcgacggcgaacgaaataaccagatactggaggagaatatggatgtcgaaatctggactaaagagggggaaagaaagaaacttcggcccaggtggctggacgcacgcacctattctgatccactcgcgttgaaagagtttaaggacttcgccgctggaagaaaatcgattgccctggatctagtgacagaaatcggcagggtgcctagccatctggcacaccggacccgtaacgctctcgacaatcttgtcatgctgcatacttcagagcacggtgggcgcgcctaccgacacgcagttgaggaattacccgagacaatggaaacgttgctgctcctgggccttatgattctgctcaccggaggcgccatgttgtttctgatctccgggaagggaataggtaaaacaagtatcggcttaatttgtgtgatcgtatctagcgggatgctatggatggctgatgtgccactgcagtggattgcgtccgccatcgtcctcgagttctttatgatggtgcttctgatacctgagccggaaaagcaaagaacaccccaggacaaccagttggcatatgttgtgattggaatcctgaccctcgctgccattgtcgccgcaaatgagatgggcctgcttgaaaccacaaagagggatctcggtatgtcaaaagagccaggggtagtgtctcctactagctacctggacgttgacttgcatcccgctagtgcctggacgctgtatgcggtggctaccacagtcatcactccaatgttacggcacaccatagaaaactccacagccaatgtgagcctagcagccatcgctaaccaagcagtcgtgctgatgggcctcgataagggatggcctatttctaaaatggaccttggcgttcccctgttggccctggggtgctactcacaggtgaacccgctcaccctgactgcggctgtacttttactggtgacgcattacgccatcattggaccaggcctccaggcaaaggccacacgcgaggctcagaaaagaaccgccgcaggtatcatgaagaatcctactgtcgatgggataatgaccattgacttggatcccgttatctatgactccaagttcgagaaacaactgggacaggtgatgctactggtcctctgtgctgtgcagcttctgttgatgaggacaagttgggccctgtgcgaagcgctcactctggccaccggcccaatcacaacgttatgggagggtagccccggcaagttttggaacaccactattgcagtatcgatggctaatatcttccgggggtcttaccttgccggagcaggcctggctttttccataatgaaaagcgtggggacaggacgaagaggcaccggttcacagggggaaactctcggagagaagtggaaaaagaagctaaaccaactgagtcgcaaagagttcgatttgtataagaaatctggcattacagaggttgacaggaccgaggccaaggaaggtctgaaacggggcgagacgacccaccatgccgtgtcccgtgggagcgcgaagctccagtggtttgtcgaaagaaatatggtgatccctgagggaagggtcattgatcttggctgtgggcgcggaggctggtcatactattgcgctggtctgaaaaaggtgacagaagttcgggggtacactaagggaggcccgggccacgaggagcccgtaccaatgagtacctatgggtggaacatcgtgaaattgatgagcggaaaggacgtcttctacctgcctcccgaaaaatgtgatacactcttatgcgacataggtgagtcctctcctagcccaactgtggaagagtcccgaaccatcagagttctgaagatggtggagccctggcttaggaataaccagttctgtattaaagtcctgaatccttacatgccaacagtgatcgaacacctagagcgcctccagcggaagtatggcgggatgctggtaagaaaccccttgtcacgtaattctacccatgaaatgtactggattagtaacggaactggcaatatcgtgtcgagcgttaacatggtctccaggctgctccttaatcggtttacgatgacacaccgccgaccgaccattgagaaggatgtggacctgggtgcagggactagacatgtgaacgccgaacctgagaccccaaacatggacgtcatcggagagaggataaaacggattaaggaagaacactcttcaacatggcactatgatgacgaaaatccctacaaaacgtgggcttatcatggcagctacgaggttaaggccaccggctccgcaagttctatgatcaacggggtggtaaaattactgactaagccttgggatgtggtcccaatggtgacacaaatggccatgaccgacactacacccttcggacagcagcgcgtttttaaggaaaaagtggataccagaacaccgaggcctatgcccggtactcgaaaggtcatggagatcaccgctgagtggttgtggcggacgctcggccgtaataaaaagccaagactgtgcacccgcgaagagttcactaaaaaggtgaggactaacgcggccatgggggcagtatttaccgaagagaatcaatgggacagcgctcgggccgcagttgaagatgaggagttctggaagctagtggacagagaacgcgagcttcacaaactgggaaagtgtggctcatgcgtctataacatgatgggtaaaagggaaaagaaactcggggagtttggaaaggccaaaggctcccgagctatttggtacatgtggctgggcgcccggtacttggagttcgaagcgctggggtttctcaatgaggatcattggttcagtagagaaaacagctattctggagtggagggtgaaggccttcacaagctggggtacatattaagggacatctccaagattcctggaggcgcaatgtatgccgatgacacagctggttgggacactcgcatcaccgaggatgacctgcataatgaggagaaaattacgcagcagatggatcccgagcaccgtcagttggccaacgcaatctttaagctcacataccaaaataaagtggtcaaggttcagcggccaacccccaaagggactgtgatggacataatctcaagaaaggatcagaggggaagcggccaggtaggcacatatgggctgaacaccttcactaatatggaagctcagctagtgcgccagatggagggagaaggtgtcctttcgaaggccgacctggagaaccctcacctcctggagaaaaagattacccagtggttggaaacaaaaggcgtggagcgattaaagcggatggctatctctggggatgactgcgttgtgaaaccaattgatgacagatttgccaatgcactgctcgcgcttaacgatatgggaaaggtcaggaaggacatcccgcagtggcaacccagtaaaggctggcatgattggcaacaggtgcctttctgttcccaccatttccacgaactgataatgaaggacggtcgcaagctagtagttccatgcagaccccaggacgagctgattgggcgggccaggatcagccaaggagctggctggtcactcaaggaaacggcctgtttgggcaaagcatacgctcagatgtggtccctgatgtattttcaccgtcgagatcttcgcctggcctctaacgcaatctgcagcgccgtgcctgtccattggattccaaccagtagaactacatggtccatacacgcgcatcaccagtggatgaccactgaggacatgctcacagtgtggaatcgggtttggatcgaggataacccctggatggaagacaagacccctgtgacgacatgggaggatgtcccgtacttagggaagagggaagaccaatggtgtggaagcctgattggtttgacctctcgcgctacttgggcccagaatatcctgaccgcaattcaacaggtgagatcactcatcggcgatgaggagttccttgactacatgccaagtatgaaacggtttaggaaggaagaggaatccgagggggccatatggtga

SEQ ID NO: 15242 - RNA, 9873 nt, synthetic construct
  misc_feature 1..9873: note = derived and/or modified CDS sequence (opt3) from DENV-3__FJ639729__SS-prME
  source 1..9873: mol_type = other RNA
acaagcctgtgcctcatgatgatgcttccagccacactggctttccacttgacttccagagacggagaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcagcttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgatcaccgagactccaacatggaacaggaaagaactgttggtgacgtttaagaatgcccatgccaagaagcaagaggtcgtggtcctcggctcacaggaaggagctatgcacaccgccctgactggcgctacagagatccagaacagtgggggaaccagcattttcgccggtcacttaaagtgtcggctgaaaatggataagctagaactcaaaggcatgtcttacgcaatgtgcctgaatacatttgtgcttaagaaagaggtttccgagactcagcatgggaccatattgatcaaggtggaatacaagggagaggacgccccctgtaaaattcctttctcaacggaagatggccaaggtaaggctcacaacgggcgtctgatcaccgcgaacccagtagtcaccaaaaaggaggagcccgtgaatatagaagcagagccgcctttcggcgaaagcaacattgttatcggaatcggcgacaaagccctcaagattaattggtataagaaagggagttctatcggaaagatgtttgaggctactgcccgcggtgcaagaaggatggccattctgggcgataccgcttgggacttcgggtccgtgggaggcgtccttaacagcctgggtaaaatggtgcatcagatatttgggtcggcctacacagcattgttctctggcgtatcctggatcatgaagattggaatcggcgtgctcctgacttggatcgggttaaattcaaagaacaccagtatgagcttttcctgcattgttataggaatcattacgctgtatctaggcgcggtcgtgcaggctgatatgggttgtgtgatcaattggaaggggaaggaactcaaatgcggatctggcattttcgtcacaaacgaggttcacacctggactgagcagtacaagtttcaagccgacagccccaaacggctggcaacagccatcgctggtgcctgggaaaatggcgtgtgtgggatacgatcaaccactcgcatggagaaccttttgtggaagcagatcgcaaatgaactgaactatattctctgggagaataacatcaaactgaccgtggtagtcggagatattatcggcgtgttagaacaggggaagagaacactgacgccacagcctatggagcttaaatacagttggaagacctggggaaaggctaaaatagttactgccgagacacaaaattccagcttcattatcgacggccccaacaccccagaatgcccctctgcgtcaagggcctggaacgtgtgggaggtcgaagactatggttttggggtgttcacaactaatatttggttgaagctccgggaggtttacacccagagttgtgatcatcgcctgatgagcgctgcaatcaaagacgaaagagccgtgcacgctgatatgggatactggatagagtcccagaagaacggctcttggaaactagagaaggcctcgtttatcgaagtaaagacgtgcacatggcctaaaagccacaccctgtggtccaatggtgtcctcgagtcagacatgattatcccaaagagtctggcaggcccgatttctcagcataaccacaggcccgggtatcatactcaaaccgcgggaccttggcaccttggcaaattggaactggatttcaattactgcgaggggacaactgtggtgatcaccgagaactgtggaacacgtggccccagcttacggacgaccactgtctccggtaagctcatacacgaatggtgctgtcgatcatgcacactgccccctcttagatatatgggggaggacggatgttggtacggcatggaaattaggccaatcaatgagaaagaagagaacatggttaagagcctggtgtctgccggttccggcaaggtagataattttaccatgggggtgttgtgcctcgctatcctgttcgaggaagtcatgcgcggaaaattcggcaagaaacatatgattgccggggtgctatttactttcgttctgctcctgagtggacagatcacatggcgggacatggcacacacccttattatgataggcagcaacgcttctgatagaatgggtatgggggtgacgtatttggccctgatcgcaacttttaagattcagcccttcttagccctcggatttttcctgaggaaacttacctcccgcgagaatctgctactcggcgtcggcctggctatggcgacaaccttgcaactgccggaagacatcgagcagatggccaacgggattgcattaggactcatgactctgaaacttatcacacagtttgaaacctaccagctgtggacagctttggtgtcactcacttgtagtaataccatattcacgctgacagttgcctggcgaaccgccactctaatcctggctggtgtgagccttctccctctgtgccaatcgtcctctatgcggaagaccgattggttgccaatgacagtcgcagccatgggcgtaccccctctgcccttatttattttcagcctcaaagacactccaaagcgtagatcatggcctctgaacgagggggtgatggcggttggacttgtgagtatcctggcttcctctttgctcaggaatgatgtccccatggccggcccactggtggcgggtgggctactgattgcctgttatgtaatcaccggaacgagcgctgaccttacagtggagaaagcagccgacgtcacctgggaagaggaagcggagcagactggcgtttcccataacctcatgataacagtggatgacgatggcaccatgcgcattaaggacgatgaaactgagaacatcctgacagtgttgttaaaaaccgctctgctcatcgtctcagggatttttccgtacagcatacctgccacgctgcttgtgtggcacacttggcagaagcagacccaacggagtggagttctgtgggacgtaccctctccacccgagacacagaaagcagaattggaggaaggtgtgtacagaatcaagcagcagggcattttcgggaagacccaagtcggagtgggcgttcagaaagagggtgtgtttcatacaatgtggcacgtcactcgaggggcagtgctaacccacaatggaaagaggctggagcctaactgggcttccgtcaaaaaggatctcatcagctatggcggcgggtggcgcctgtcggcccagtggcaaaaaggagaagaggtccaggtgattgcagttgaaccaggtaagaatcccaagaacttccagacgatgcctggcatcttccagacaactaccggggagataggagctatcgcccttgactttaaaccgggcacatcaggttctccaattatcaatcgggaagggaaggtggtcggattatacggcaacggcgtggttaccaaaaatgggggatatgtgagtggtattgcgcaaactaacgccgagcccgatggccctaccccagagctggaagaggaaatgttcaagaaaagaaatctcacaatcatggacttgcatcccgggtccggaaagacgaggaagtacctgcctgcaatagtccgtgaggctattaaacgccggctcagaactctgatccttgccccgaccagggtggtagctgcagaaatggaggaggccctgaagggcttgcccatccgatatcagacaaccgccactaaaagcgaacacacaggtcgggagattgtggatctaatgtgccatgctacctttacgatgcgcctgctctctccagttagagtccctaactacaatttagtgatcatggacgaagcgcacttcactgatcccgcaagcatagccgctagggggtatatttccacacgggtgggaatgggcgaggccgcagccatctttatgaccgctaccccacctggcactgcggaagccttcccccagtcaaacgcaccaattcaggacgaggagcgagacatcccggaaagaagttggaatagcgggaacgagtggataacagattttgtcggaaagaccgtatggttcgtgccttctattaaagctggtaatgacatcgccaactgtctgcgcaagaacggcaagaaagttatccaactttccaggaagacatttgatactgaataccagaaaacgcgtctgaatgactgggatttcgtggtcaccacagacatttcagagatgggggcaaactttaaggccgatcgggtgatcgaccccagaaggtgcctcaaaccagttattttgactgatggacccgagcgcgtgatactggctggccctatgccagtcaccgccgcgagtgcagcccagcgaagaggtcgggtggggaggaatccccagaaggaaaacgaccaatacatcttcacaggccagcctctcaataacgatgaggaccatgctcactggaccgaagccaagatgctgcttgacaatattaacactccggagggaatcatcccagctctattcgaacccgagcgcgagaaaagcgcagccattgatggcgaatatcgtctgaagggggagtccagaaaaacgtttgtagaattgatgcggaggggagacttacctgtgtggctggctcacaaggttgcctctgagggtataaaatacaccgatcgcaagtggtgcttcgacggcgaacgaaataaccagatcctcgaggagaatatggatgtcgaaatttggacaaaagagggggaaagaaagaagctgcggcccaggtggcttgacgcacgcacttattcggatccactggcgctcaaagagtttaaggacttcgccgctggaagaaaaagcatcgccttggatctggtgaccgaaattggcagggtgccttcacatctagcacaccggacacgtaacgctctggacaatctcgtcatgcttcatacctccgagcacggtgggcgcgcctaccgacacgcagttgaggaactgcccgagactatggaaacattattgctgctcggcctgatgatccttctgacgggaggcgccatgctctttttgataagtgggaagggaatcggtaaaacctctattggcctgatctgtgtgattgtaagctccgggatgttatggatggctgatgtgccactacagtggatcgcgtcagccatagtcctggagttctttatgatggtgctccttattcctgagccggaaaagcaaagaactccccaggacaaccagctggcatatgttgtgatcggaattttgacactggctgccatcgtcgccgcaaatgagatgggcctcctggaaaccaccaagagggatcttggtatgtctaaagagccaggggtagtgagccctacaagttacctcgacgttgacctgcatcccgcttccgcctggactttgtatgcggtggctacgaccgtcataacaccaatgctgcggcacactatcgaaaacagcaccgccaatgtgtctttagcagccattgctaaccaagcagtcgtgctaatgggcctggataagggatggcctatctcaaaaatggacctcggcgttccccttctggccttggggtgctactcccaggtgaacccgctgacactcaccgcggctgtactgcttttagtgactcattacgccattatcggaccaggcctgcaggcaaaggccacgcgcgaggctcagaaaagaacagccgcaggtataatgaagaatcctaccgtcgatgggattatgactatcgacctcgatcccgttatctatgacagtaagttcgagaaacaattgggacaggtgatgctgctagtcctgtgtgctgtgcagctccttctgatgaggaccagctgggccttgtgcgaagcgctgacactcgccactggcccaattaccacactgtgggagggttcgcccggcaagttttggaacacgaccatcgcagtatctatggctaatatattccgggggtcctacttagccggagcaggccttgcttttagcattatgaaatcagtggggactggacgaagaggcacaggtagtcagggggaaaccctgggagagaagtggaaaaagaagctcaaccaactatctcgcaaagagttcgatctgtataagaaatccggcatcactgaggttgacaggacagaggccaaggaaggtttgaaacggggcgagaccacgcaccatgccgtgagccgtgggtcagcgaagctgcagtggtttgtcgaaagaaatatggtgattcctgagggaagggtcatcgatctcggctgtgggcgcggaggctggagttactattgcgctggtcttaaaaaggtgaccgaagttcgggggtacacaaagggaggcccgggccacgaggagcccgtaccaatgagcacttatgggtggaacatagtgaaactgatgtccggaaaggacgtcttctacttgcctcccgaaaaatgtgataccctgctctgcgacatcggtgagtctagcccttccccaacagtggaagagtcacgaactattagagttttaaagatggtggagccctggctgaggaataaccagttctgtatcaaagtccttaatccttacatgccaaccgtgattgaacacctggagcgcctacagcggaagtatggcgggatgctcgtaagaaaccccctgtctcgtaatagtacacatgaaatgtactggatctcgaacggaaccggcaatattgtgagctccgttaacatggtctctaggttgctgctcaatcggtttactatgacgcaccgccgaccgacaatcgagaaggatgtggaccttggtgcagggaccagacatgtgaacgccgaacctgagactccaaacatggacgtcataggagagaggattaaacggatcaaggaagaacactcaagcacctggcactatgatgacgaaaatccctacaaaacatgggcttatcatggctcctacgaggttaaggccacgggcagtgcatctagcatgatcaacggggtggtaaaactgttaaccaagccttgggatgtggtcccaatggtgactcaaatggccatgacagacaccactcccttcggacagcagcgcgtttttaaggaaaaagtggatacaagaaccccgaggcctatgcccggtacacgaaaggtcatggagattactgctgagtggctgtggcggaccttgggccgtaataaaaagccaagactctgcacgcgcgaagagttcaccaaaaaggtgaggacaaacgcggccatgggggcagtatttactgaagagaatcaatgggactcagctcgggccgcagttgaagatgaggagttctggaagctggtggacagagaacgcgagctacacaaacttggaaagtgtggctcctgcgtctataacatgatgggtaaaagggaaaagaaactgggggagtttggaaaggccaaaggcagtcgagctatatggtacatgtggctcggcgcccggtacctggagttcgaagcgttggggtttctgaatgaggatcattggttcagcagagaaaactcttattccggagtggagggtgaaggcctccacaaacttgggtacatcctgagggacatttcaaagatccctggaggcgcaatgtatgccgatgacaccgctggttgggacacacgcattactgaggatgacttacataatgaggagaaaatcacccagcagatggatcccgagcaccgtcagctggccaacgcaatatttaagttgacgtaccaaaataaagtggtcaaggttcagcggccaacacccaaagggaccgtgatggacatcattagcagaaaggatcagaggggatcgggccaggtaggcacttatgggctcaacacattcaccaatatggaagctcaactggtgcgccagatggagggagaaggtgtcctatctaaggccgaccttgagaaccctcatctgctcgagaaaaagatcactcagtggctggaaaccaaaggcgtggagcgattgaagcggatggctattagtggggatgactgcgttgtgaaaccaatcgatgacagatttgccaatgcattactggcgctcaacgatatgggaaaggtcaggaaggacataccgcagtggcaaccctccaaaggctggcatgattggcaacaggtgcctttctgtagccaccatttccacgaacttattatgaaggacggtcgcaaactggtagttccatgcagaccccaggacgagctaatcgggcgggccaggatctcacaaggagctggctggtccctgaaggaaacagcctgtctcggcaaagcatacgctcagatgtggaacttgatgtattttcaccgtcgagatctgcgccttgcctctaatgcaatttgcagcgccgtgcctgtccattggataccaacgagtagaaccacttggtccatccacgcgcatcaccagtggatgacaaccgaggacatgctgactgtgtggaaccgggtttggattgaggataatccctggatggaagacaagacacctgtgaccacgtgggaggatgtcccgtacctcgggaagagggaagaccaatggtgtggcagcttaatcggtctgacatctcgcgctacctgggcccagaacattttgactgcaatccaacaggtgagatcactgataggcgatgaggagttcctcgactacatgccaagtatgaaacggtttaggaaggaagaggaatccgagggggccatctggtga

SEQ ID NO: 15243 - RNA, 9873 nt, synthetic construct
  misc_feature 1..9873: note = derived and/or modified CDS sequence (opt3) from DENV-3__FJ639730__SS-prME
  source 1..9873: mol_type = other RNA
accagcctgtgcctcatgatgatgcttcccgcaacactggctttccacttgacttcccgagacggagaacctaggatgatcgtggggaagaacgaacggggaaaatctttactgtttaagacggcatcaggtattaatatgtgtaccctaatagcaatggatctcggcgaaatgtgcgacgatacagtcacttacaaatgtccactgatcgcggaagttgaaccggaagacattgattgctggtgtaaccttaccagtacatgggtgacctatgggacttgcaatcaggctggagaacaccgccgagacaagcgtagcgtcgccctggcaccccacgtgggcatgggtttggatacaagaacccaaacgtggatgtccgccgaaggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaaaagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaattcaaagaacacgagtatgagcttttcctgcatcgttattggaataatcacactgtatctaggcgcggtcgtgcaggctgatatgggttgtgccattaattggaaggggaaggaactcaaatgcggatctggcatcttcgtgaccaacgaggtccacacttggacagagcagtacaagtttcaagcagacagccccaaacggctggccaccgctattgccggtgcatgggaaaatggcgtttgtgggatccgatcaactacccgcatggagaaccttttgtggaagcagatagctaatgaactgaactatatcctctgggagaataacattaaactgacagtggtggtaggagatatcattggcgtcttagaacaggggaagagaacgctgaccccacagcctatggagcttaaatacagttggaagacttggggaaaggccaaaatcgtgacagcggagacccaaaattccagcttcataattgacggccccaacacaccagaatgcccctctgcctcaagggcttggaacgtttgggaggtggaagactatggttttggggtcttcactaccaatatctggttgaagctccgggaggtgtacacgcagagttgtgatcatcgcctgatgagcgcagccattaaagacgaaaaggctgttcacgccgatatgggatactggatcgagtcccagaaaaacggctcttggaagctagagaaggcatcgtttatagaagtgaaaacatgcacctggcctaagagccacactctgtggtccaatggtgtactcgagtcagacatgatcattccaaaaagtctggcgggcccgatctctcagcataaccacagacccgggtatcatacccaaacagccggaccttggcaccttggcaagttggaactggatttcaattactgcgaggggactaccgtcgtgattacagagaactgtggaacgaggggccccagcttacgtaccactacagtgtccggtaaactcatccacgaatggtgctgtcggtcatgcaccctgccccctcttcgatatatgggggaggacggatgttggtacggcatggaaataagaccaattaatgagaaggaagagaacatggtcaagagcctggtttctgctggttccggcaaagtggataattttactatgggggtattgtgcctcgccatcctgttcgaggaagtgatgaggggaaagttcggcaaaaagcatatgatcgcaggggtcctatttacattcgtgctgctcctgagtggacagattacctggcgcgacatggctcacacgcttatcatgattggcagcaacgcctctgatcggatgggtatgggggttacttatttggcactgatagccacctttaaaatccagcccttcttagctctcggatttttcctgagaaaacttacatccagggagaatctgctactcggcgtgggcctggcgatggccaccactttgcaactgccggaagacattgagcagatggcaaacgggatcgctttaggactcatgacactgaaacttattacccagtttgaaacataccagctgtggactgccttggtctcactcacctgtagtaatacgatcttcacactgaccgtggcctggcgcactgctaccctaatactggccggtgttagccttctccctctgtgccaatcgtcctctatgcgaaaaacagattggttgccaatgactgtggccgcgatgggcgtaccacctctgcccttatttatcttcagcctcaaggacaccccaaaacggcgttcatggcctctgaacgagggggtaatggctgtgggacttgttagtattctggcctcctctttgctcagaaatgatgtgcccatggcaggcccactggtcgccggtgggctactgatcgcttgttatgtgattacgggaacaagcgcagaccttaccgtagagaaggccgcggacgtgacttgggaagaggaagctgagcagacaggcgtctcccataacctcatgatcaccgttgatgacgatggcactatgaggataaaagacgatgaaacagagaacattctgaccgtgttgttaaagacggccctgctcatcgtgtcagggatctttccgtacagcattcctgcaactctgcttgtctggcacacctggcagaaacagacacaacgcagtggagtgctgtgggacgttccctctccacccgagacccagaaggccgaattggaggaaggtgtataccggataaagcagcagggcatcttcgggaaaacacaagtgggagtcggcgtgcagaaggagggtgtttttcatactatgtggcacgtgaccagaggggctgtcctaacgcacaatggaaaaaggctggagcctaactgggcctccgtgaagaaagatctcattagctatggcggcgggtggcgactgaatgcacagtggcaaaagggagaagaggtacaggtcatcgctgtggaaccaggtaagaaccccaaaaatttccagacaatgcctggcattttccagactaccacaggggagatcggagccatagcgcttgactttaagccgggcacctcgggttcaccaatcattaacaaagaagggaaggttgtgggattatacggcaatggcgtcgtgactaaaaacgggggatatgtttctggtatcgcccaaaccaatgcagagcccgatggccctacaccagagctggaagaggaaatgttcaagaagcgcaacctcacgattatggacttgcatcccgggagtggaaaaactcggaagtacctgcctgctatcgtgagagaggccataaaaaggcgtctccgcaccctgattcttgctccgacacgggtcgtggcagccgaaatggaggaggccctgaagggcttgcccatcagatatcagaccactgctacaaaatccgaacacaccggtagggagatcgtagatctaatgtgccatgcgacgtttactatgcgactgctcagcccagtgcgggttcctaattacaacttagtcattatggacgaagcacacttcacagatcccgcctctatcgctgcccgcgggtatataagcaccagagtgggaatgggcgaggcagccgctatttttatgaccgcgactccacctggcacagccgaagcattcccccagtccaatgctccaatccaggacgaggagagggacattccggaacggtcatggaacagtgggaatgagtggatcaccgattttgtgggaaagacagtctggttcgtacctagcataaaggccggtaacgacattgcaaactgtctgagaaagaatggcaagaaagtgatccaactttctagaaagacttttgatacggaataccagaaaacccgcctgaacgactgggatttcgttgtgacaactgacatctccgagatgggggccaattttaaggctgatagggtcattgacccccgtcggtgcctcaagccagtgatcttgaccgatggacccgagagagttattctggccggccctatgccagtgacagcggcatcagccgctcagaggcgcggtcgagtcgggagaaacccccagaaagaaaatgaccaatacatattcaccggccagcctctcaacaatgatgaggaccatgcccactggactgaagctaagatgctgcttgacaacatcaatacgccggagggaattatcccagcactattcgaacccgagcgggagaaaagtgccgctatcgatggcgaatataggctgaagggggagagccgcaaaacctttgtggaattgatgcgtagaggagacttacctgtatggctggcccacaaggtggcatccgagggtattaaatacacagatcggaagtggtgcttcgacggcgaaaggaacaatcagatactcgaggagaacatggatgttgaaatctggactaaggagggggaacgcaaaaagctgcgacccagatggcttgacgcgcggacctattctgatccactggccctcaaagagtttaaggacttcgctgccggaaggaaatcgattgcattggatctggtcacagaaatcggccgcgtgcctagccatctagctcacagaaccaggaatgccctggacaacctcgtgatgcttcatacttcagagcacggtgggcgggcataccgtcacgccgtcgaggaactgcccgagacaatggaaacgttattgctgctcggcctgatgattcttctgaccggaggcgctatgctctttttgatctccgggaagggaataggtaagacaagtatcggcctgatttgtgttatcgtgtctagcgggatgttatggatggcggatgtaccactacagtggattgcctccgcaatcgtgctggagttctttatgatggtcctccttatacctgagccggaaaaacaacgcacaccccaggacaatcagctggcttatgtggttattggaatcttgaccctggccgccattgtggcagctaacgagatgggcctcctggaaaccacaaagcgagatcttggtatgtcaaaagagccaggggtcgtatctcctactagctacctcgacgtggacctgcatcccgccagtgcgtggacgttgtatgctgttgccaccacagtgatcactccaatgctgagacacaccatagaaaattccacagcaaacgtcagcttagccgctatcgcaaaccaagccgtggtcctaatgggcctggataagggatggcctatttctaaaatggacctcggcgtgccccttctggcgttggggtgctactcacaggttaatccgctgaccctcactgctgccgtgctgcttttagtaacgcattacgcaatcattggaccaggcctgcaggccaaggctacaagggaggcccagaagcggaccgcagctggtatcatgaaaaaccctactgtggatgggataatgaccattgacctcgatcccgtcatctatgactccaagttcgagaaacaattgggacaggttatgctgctagtgctgtgtgccgtccagctccttctgatgcgcacaagttgggcgttgtgcgaagccctgactctcgcaaccggcccaatcacaacgctgtgggagggtagccccggcaagttttggaataccactattgctgtgtcgatggccaacatcttcagagggtcttacttagcaggagctggccttgccttttccataatgaaaagcgtagggacaggaaggcggggcaccggttcacagggggaaactctgggagagaagtggaagaaaaagctcaatcaactaagtcgaaaagagttcgagctgtataagaaatctggcattacagaggtggatagaaccgaagccaaggagggtttgaaacgcggcgaaacgacccaccatgcggtttccagggggagcgctaagctgcagtggtttgtggagcggaacatggtcatccctgaaggacgtgtgattgacctcggctgtgggagaggaggctggtcatactattgcgcaggtcttaagaaagtcacagaggtgagggggtacactaagggaggcccgggccacgaggaacccgttccaatgagtacctatgggtggaatatcgtaaaactgatgagcggaaaggatgtgttctacttgcctcccgagaaatgtgacacactgctctgcgatataggtgaatcctctcctagcccaactgtcgaggagtcccgcaccatccgggtgttaaagatggttgaaccctggctgcgaaacaatcagttctgtattaaggtgcttaacccttacatgccaacagtcatcgagcacctggaaaaactacagagaaagtatggcgggatgctcgtgaggaatcccctgtcacgcaactctacccatgagatgtactggattagtaatggaactggcaacatcgtatcgagcgtgaatatggtttcccggttgctgctcaacagatttacgatgacacaccgtaggccgaccattgaaaaagacgtcgatcttggtgccgggactcggcatgtgaacgctgagcctgagaccccaaatatggacgtgatcggagaacgcataaagcgaattaaagaggaacactcttcaacatggcactatgacgatgagaacccctacaagacgtgggcctatcatggcagctacgaagtcaaggcaaccggctccgccagttctatgatcaatggggttgtgaaactgttaactaagccttgggacgtagtgccaatggtcacacaaatggctatgaccgatactacacccttcggacagcagagagtgtttaaagagaaggttgacaccaggacaccgcggcctatgcccggtactcgcaaagtgatggagatcaccgcggaatggctgtggagaacgttgggcaggaacaagaagccacgactctgcacccgggaggagttcactaagaaggtccgtactaatgccgcaatgggggctgtgtttaccgaggaaaaccaatgggatagcgccagagcagccgtagaggacgaggagttctggaaactggttgatcgcgagagggaactacacaaacttggaaaatgtggctcatgcgtgtataatatgatgggtaagcgggagaaaaagctgggggagtttggaaaggctaaaggctccagagccatttggtacatgtggctcggcgcgcgctacctggagttcgaggcattggggtttctgaacgaagaccattggttcagtagggagaatagctattctggagtcgaaggtgagggcctccacaaacttgggtacatactgcgagatatctccaaaattcctggaggcgccatgtatgctgacgatacagccggttgggacactcggatcaccgaggacgatttacataacgaagagaagattacgcagcagatggaccccgaacacagacagctggcaaatgctatctttaaattgacataccaaaacaaggtggtgaaggtccagaggccaacccccaaagggactgttatggatataatctcacgcaaggaccagcgtggaagcggccaggtgggcacatatgggctcaataccttcactaacatggaggcccaactggtacggcagatggaaggagagggtgtgctatcgaaagctgatcttgagaatcctcatctgctcgaaaagaaaattacccagtggctggagacaaagggcgtcgaaagattgaagaggatggccatctctggggacgattgcgtggttaaaccaattgacgatcgctttgcaaacgcgttactggccctcaacgacatgggaaaggtgcgaaaagatatcccgcagtggcaacccagtaagggctggcatgactggcagcaggtccctttctgttcccaccatttccacgagcttataatgaaagatggtcggaagctggtggtaccatgcagaccccaggacgaactaattgggagggctcgcatcagccaaggagccggctggtcactgaaggagacggcatgtctcggcaaggcttacgcccagatgtggtccttgatgtattttcacagacgggacctgaggcttgcatctaatgccatctgcagcgcggttcctgtgcattggattccaaccagtcgtactacatggtccatacacgctcatcaccagtggatgaccactgaggatatgctgacagtctggaaccgagtgtggatcgaagacaatccctggatggaggataagacccctgttacgacatgggaagacgtgccgtacctcgggaaacgcgaggatcaatggtgtggcagcttaattggtctgacctctagagccacttgggcacagaacatcttgaccgccattcagcaggtccggtcactgatcggcgacgaggagttcctcgattacatgccaagtatgaagaggtttcgcaaagaggaagagtccgaaggggctatatggtga

SEQ ID NO: 15244 - RNA, 9873 nt, synthetic construct
  misc_feature 1..9873: note = derived and/or modified CDS sequence (opt3) from DENV-3__KF955464__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagagcaaacccacactcgacatcgagctgcagaagaccgaagcaactcaacttgccattctgaggaaattgtgtatcgagggaaagattacaaatatcaccacggatagtcggtgccctacccagggcgaagctacactcccagaggaacaggaccagaactatgtctgtaaacacacttacgttgatcgcggttgggggaatggatgcggcctgttcggcaaggggtccttagtgacctgcgccaagtttcaatgtctggagcccatagagggaaaagtagtgcagtatgaaaacctcaagtacacagtcattatcactgtgcacaccggtgaccagcatcaggttggcaatgacacacaaggggtgaccgtcgagattactcctcaggcatctacggtggaagctgtacttccagagtatggaacactgggcttggaatgcagcccgcgaaccggtctagatttcaacgagatgatcctgctcactatgaaaaataaggcctggatggttcacagacagtggtttttcgacctgccccttccttggacctccggggcgacaaccgagactccaacatggaacaggaaagaactgttggtgacgtttaagaatgcccatgcaaaaaagcaagaggtcgtggtcctcggctcacaggaaggagctatgcacaccgccctgactggcgctacagagatccagaacagtgggggaaccaatattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcacaaaaaaggaggagcccataaacattgaagcagagccgcctttcggcgaatcaaatatcgtgatcggaattggcgacaaagccctcaagatcaactggtataagaaagggagcagtattggaaagatgtttgaggctactgcccgcggtgcaagaaggatggccatactgggcgataccgcttgggacttcgggtctgttggaggcgtgcttaattccctgggtaaaatggtccatcagatctttgggagcgcctacacagcattgttctcgggcgtgtcttggattatgaagatcggaatcggcgtactcctgacttggattgggttaaactccaaaaatacctcaatgagttttagctgcatagtgatcggaattatcacgctgtatctaggcgcggttgtccaggctgatatgggttgtgtgattaactggaaggggaaggaactcaaatgcggaaatggcatcttcgtgacaaacgaggtccacacctggactgagcagtacaagtttcaagccgactcccccaaacggctggcaacagccatagctggtgcctgggaaaatggcgtttgtgggatccgatctaccactcgcatggagaaccttttgtggaagcagattgcaaatgaactgaactatatcctctgggagaataacattaaactgaccgtggtggtaggagatatcataggcgtcttagaacaggggaagagaacactgacgccacagcctatggagcttaaatacagctggaagacctggggaaaggctaaaattgtgactgccgagacacaaaactcaagtttcatcattgacggccccaataccccagaatgcccctccgcgagcagggcctggaacgtttgggaggtggaagactatggttttggggtcttcacaactaatatctggttgaagctccgggaggtgtacacccagtcttgtgatcatcgcctgatgtcagctgcaataaaagacgaaagagccgttcacgctgatatgggatactggatcgagagtcagaagaacggcagctggaaactagagaaggcctcctttattgaagtgaagacgtgcacatggcctaaatctcacaccctgtggtcgaatggtgtactcgagagcgacatgatcattccaaagtccctggcaggcccgatctcacagcataaccacaggcccgggtatcatactcaaaccgcgggaccttggcaccttggcaaattggaactggatttcaattactgcgaggggacaactgtcgtgatagccgagaactgtggaacccgtggcccaagtttacggacaacgaccgtgtctggtaagctcattcacgaatggtgctgtcgaagctgcactctgccccctcttagatatatgggggaggacggatgttggtacggcatggaaatcaggccaatcaatgagaaagaagagaacatggtcaagtccctggtttcagctggtagcggcaaggtggataattttacaatgggggtattgtgcctcgccattctgttcgaggaagtgatgcgcggaaaattcggcaagaaacatatgatcgcaggggtcctatttaccttcgtgctgctcctgtctggacagattacttggcgggacatggctcacacacttataatgatcggctccaacgccagtgatagaatgggtatgggggttacctatttggcactgattgccacgtttaagatccagcccttcttagctctcggatttttcctgaggaaacttactagccgcgagaatctgctactcggcgtgggcctggcgatggccaccacattgcaactgccggaagacattgagcagatggcaaacgggatcgctttaggactcatgaccctgaagcttataactcagtttgaaacataccagctgtggaccgccttggtctctctcacatgttccaatactatcttcaccctgacggtggcctggcgaacagctaccctaattctggcaggtgtttcacttctccctctgtgccaaagtagctcgatgcggaagactgattggttgccaatgaccgtggccgcgatgggcgtcccccctctgcccttatttatcttctccctcaaagacacaccaaagcgtaaatcttggcctctgaacgagggggtaatggctgtgggacttgttagcattctggcctcaagtttgctcagaaacgatgtgcccatggcaggcccactggtcgccggtgggctactgatcgcttgttatgtgataactggaacctccgcagaccttacggtagagaaggccgcggacgtgacatgggaagaggaagctgagcagaccggcgtctctcataatctcatgattactgttgatgacgatggcacaatgaggatcaaagacgatgaaaccgagaacatcctgactgtgttgttaaagacagccctgctcattgtgagcgggatatttccgtactccatccctgcaaccctgcttgtctggcacacgtggcagaaacagactcaacgctcaggagtgctgtgggacgttcccagcccacccgagacccagaaggccgaattggaggaaggtgtataccggattaagcagcagggcatcttcgggaaaacacaagtgggagtcggcgtgcagaaggagggtgtttttcataccatgtggcacgtgacaagaggggctgtcctaactcacaatggaaaaaggctggagcctaactgggccagtgtgaagaaagatctcatttcttatggcggcgggtggcgactgtccgcacagtggcaaaagggagaagaggtacaggtcatcgctgtggaaccaggtaagaatcccaaaaacttccagaccatgcctggcatattccagacgacaactggggagatcggagccattgcgcttgactttaagccgggcaccagcggttcgccaatcattaatcgcgaagggaaagttgtgggattatacggcaacggcgtcgtgacaaagaatgggggatatgtttcaggtatcgcccaaaccaacgcagagcccgatggccctactccagagctggaagaggaaatgttcaaaaagcggaatctcaccataatggacttgcatcccgggtctggaaagacaagaaaatacctgcctgctattgtgagggaggccatcaagcgtcgcctccggacgctgatccttgctccgactagagtcgtggcagccgaaatggaggaggccctgaaaggcttgcccattaggtatcagaccacagctaccaagagtgaacacactggtcgagagatcgtagatctaatgtgccatgcgacatttaccatgcggctgctctccccagtgcgcgttcctaactacaatttaataattatggacgaagcacacttcacggatcccgccagcatcgctgccagagggtatatttctactagggtcggaatgggcgaggcagccgctatctttatgacagcgaccccacctggcaccgccgaagcattcccccagagcaacgctccaatacaggacgaggagcgggacattccggaacgatcctggaattcagggaacgagtggatcactgattttgtgggaaaaacagtgtggttcgtccctagtatcaaggccggtaacgacattgcaaattgtctgagaaagaacggcaaaaaggtaatccaacttagccgcaaaacctttgatacagaataccagaagactaggctgaatgactgggatttcgtggttacgaccgacatttctgagatgggggccaactttaaagctgatcgtgtgatagacccccggagatgcctcaagccagtcatcttgacagatggacccgagagggtgattctggccggccctatgccagttactgcggcatccgccgctcagcgccgaggtagagtggggcggaatccccagaaggaaaacgaccaatacatcttcaccggccagcctctcaataacgatgaggaccatgcccactggacagaagctaaaatgctgcttgacaatatcaacaccccggagggaattataccagcactattcgaacccgagagggagaagtcagccgctatcgatggcgaatatcgcctgaaaggggagagtcgtaagacttttgtcgaattgatgagacggggagacttacctgtgtggctggcccacaaagtagcaagcgagggtattaagtacacggataggaaatggtgcttcgacggcgaacgcaataaccagatcctcgaggagaatatggatgtggaaatttggaccaaggagggggaacgaaagaaactgagaccccggtggcttgacgcgaggacatattccgatccactggccctcaaggagtttaaagacttcgctgccggacgcaagtctatcgcattggatctggttactgaaataggcagagtcccttcgcatctagctcacaggacccggaacgccctggacaatctcgtgatgcttcatacaagcgagcacggtgggcgtgcataccgccacgccgtggaggaactgcccgagaccatggaaactttattgctgctcggcctgatgatccttctgacaggaggcgctatgctctttttgatttcagggaaaggaatcggtaagacgtccattggcctgatctgtgtcatagttagttctgggatgttatggatggcggatgtgccactacagtggattgccagcgcaatcgtactggagttctttatgatggtgctccttattcctgagccggaaaagcaacgaaccccccaggacaaccagctggcttatgtcgtgatcggaatattgactctggccgccatcgttgcagctaatgagatgggcctcctggaaacaaccaaaagagatcttggtatgtccaaggagccaggggtggtctcacctacctcttacctcgacgtagacctgcatcccgccagcgcgtggacattgtatgctgtggccactacggttattaccccaatgctgaggcacacaatcgaaaacagtactgcaaacgtgtccttagccgctattgcaaatcaagccgtcgtgctaatgggcctggataaaggatggcctatcagcaagatggacctcggcgtcccccttctggcgttggggtgctactctcaggtgaacccgctgaccctcacagctgccgttctgcttttagtgacccattacgcaataattggaccaggcctgcaggccaaagctactcgggaggcccagaagcgcacggcagctggtatcatgaagaatcctacagtagatgggatcatgaccattgacctcgatcccgtgatctatgactcaaaattcgagaagcaattgggacaggtcatgctgctagttctgtgtgccgtgcagctccttctgatgagaacttcctgggcgttgtgcgaagccctgaccctcgcaacaggcccaataactaccctgtgggagggtagtcccggcaaattttggaacacaacgattgctgtcagcatggccaatatcttcagggggtcgtacttagcaggagctggccttgccttttctattatgaagtccgtggggaccggacggcgaggcactggtagccagggggaaacactgggagagaaatggaagaagaaactcaaccaactatcaagaaaggaattcgatctgtataaaaagagtggcatcaccgaggtagaccgcactgaggccaaagaaggtttgaagaggggcgagacaacccaccatgcggtgtctcgggggtccgctaaactgcagtggtttgttgaacgtaatatggtgatacctgagggaagagtcatcgatctcggctgtgggaggggaggctggagctactattgcgcaggtcttaagaaggtgacggaagtccgcgggtacaccaaaggaggcccgggccacgaggagcccgtgccaatgtcaacatatgggtggaacattgttaagctgatgagtggaaaagacgtattctacttgcctcccgaaaagtgtgatactctgctctgcgacatcggtgagagctccccttctccaaccgtggaagagagccggacaattcgagtcttaagaatggtggagccctggctgaggaataaccagttctgtatcaaagttcttaatccttacatgccaaacgtgattgaacacctggagcgcctacagcggaagtatggcgggatgctcgtcagaaatcccctgtcccgtaactcaactcatgaaatgtactggatctctaatggaaccggcaacatagtgagttcggtaaacatggtgagcaggttgctgctcaatcggtttacaatgacccaccgccgaccgactattgagaaggatgttgaccttggtgccgggacgagacatgtcaacgctgaacctgagacaccaaatatggacgtgatcggagagaggatcaaacggattaaggaagagcactcctctacctggcactatgatgacgaaaacccctacaaaacttgggcctatcatggctcatacgaggtgaaggcaaccggcagcgcctccagtatgataaatggggtcgttaaactgttaacaaagccttgggatgtggtaccaatggtgacgcaaatggctatgaccgacactacacccttcggacagcagcgcgtctttaaggaaaaagtggataccagaactccgaggcctatgcccggtacacgaaaggttatggagatcaccgcggagtggctgtggcggacattgggccgtaacaaaaagccaagactctgcactcgcgaagagttcaccaaaaaggtgaggacgaatgccgcaatgggggctgtctttaccgaagagaaccaatgggactctgcccgggcagccgtggaagatgaggagttctggaagctggtagacaaagaaagagagctacacaagcttggaaaatgtggcagctgcgtttataatatgatgggtaagcgcgaaaaaaagctgggggagtttggaaaagctaagggctcaagggccatttggtacatgtggctcggcgcgcgatacctggagttcgaagcattggggtttctgaacgaggatcattggttctcccgggaaaatagttatagcggagtggagggtgaaggcctccacaagcttgggtacatcctgagagacatttctaaaatccctggaggcgccatgtatgctgatgacacagccggttgggacactaggataaccgaggatgacttacataacgaggaaaagatcacacagcagatggatcccgagcaccgccagctggcaaatgctatttttaaattgacttaccaaaacaaggtcgtgaaagtgcagcgtccaacccccaaggggacggtcatggacatcatttcccggaaggatcagagaggatcaggccaggttggcacatatgggctcaataccttcactaacatggaagcccaactggtgaggcagatggagggagaaggtgtactaagcgaggctgaccttgagaaccctcacctgctcgaaaaaaagatcacacagtggctggagaccaaaggcgtggaacgcttgaagcgaatggccatatcgggggatgactgcgtcgtgaaaccaattgatgaccggtttgcaaatgcgttactggccctcaacgatatgggaaaggttagaaaggacatcccgcagtggcaaccctctaaaggctggcatgattggcagcaggtgcctttctgtagtcaccatttccacgagcttatcatgaaggacggtaggaaactggtcgtgccatgccgcccccaggacgaactaattgggagagctcggatatcccaaggagccggctggagcctgaaggagactgcatgtctcggcaaagcttacgcccagatgtggtcattgatgtattttcacaggcgtgatctgcgacttgcatccaatgccatctgctctgcggtacctgctcattggattccaaccagccgcacaacgtggagtatccacgcccatcaccagtggatgaccactgaggacatgctgacagtttggaacagagtgtggattgaagataatccctggatggaggacaagacccctgtcactacatgggaagatgtgccgtacctcgggaagcgggaggaccaatggtgtggatccttaatcggtctgaccagcagggcaacgtgggcccagaacatattgacagctatccagcaggttcgctctctgattggcgatgaggaattcctcgactacatgccatcaatgaaaagatttcggaaggaggaagagagtgaaggggccatctggtga

SEQ ID NO: 15245 - RNA, 9873 nt, synthetic construct
  misc_feature 1..9873: note = derived and/or modified CDS sequence (opt3) from DENV-3__FJ639731__SS-prME
  source 1..9873: mol_type = other RNA
accagcctgtgcctcatgatgatgcttcccgcaactctggctttccacttgacttccagggacggagaacctaggatgatcgtggggaagaacgaacggggaaagtctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcaccgccgagacaagcgtagcgtcgccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacggtgttgattaaggtagaatacaagggagaggacgccccctgtaaaatacctttctcaaccgaagatggccaaggtaaggctcacaacgggcgtctgatcacagcgaacccagtcgtgactaaaaaggaggagcccgttaatattgaagcagagccgcctttcggcgaaagcaacatcgtgataggaattggcgacaaagccctcaagatcaattggtataagaaagggagttctatcggaaagatgtttgaggctaccgcccgcggtgcaagaaggatggccattctgggcgatacagcttgggacttcgggtccgtcggaggcgtgcttaacagcctgggtaaaatggtacatcagatctttgggtcggcctacactgcattgttctctggcgtgtcctggattatgaagataggaatcggcgttctcctgacctggattgggttaaattcaaagaacacgagtatgagcttttcctgcatcgtcatcggaattataacactgtatctaggcgcggtggtgcaggctgatatgggttgtgccatcaattggaaggggaaggaactcaaatgcggatctggcattttcgtcaccaacgaggttcacacttggacagagcagtacaagtttcaagcagacagccccaaacggctggccaccgctatcgccggtgcatgggaaaatggcgtgtgtgggattcgatcaactacccgcatggagaaccttttgtggaagcagatcgctaatgaactgaactatatactctgggagaataacatcaaactgacagtggtagtcggagatattatcggcgtgttagaacaggggaagagaacgctgaccccacagcctatggagcttaaatacagttggaagacttggggaaaggccaaaattgttacagcggagacccaaaattccagcttcatcatagacggccccaacacaccagaatgcccctctgcctcaagggcttggaacgtgtgggaggtcgaagactatggttttggggtgttcactaccaatatttggttgaagctccgggaggtttacacgcagagttgtgatcatcgcctgatgagcgcagccatcaaagacgaaagagctgtgcacgccgatatgggatactggattgagtcccagaagaacggctcttggaaactagagaaggcatcgtttatcgaagtaaagacatgcacctggcctaaaagccacactctgtggtccaatggtgtcctcgagtcagacatgataatcccaaagagtctggcgggcccgatttctcagcataaccacaggcccgggtatcatacccaaacagccggaccttggcaccttggcaaattggaactggatttcaattactgcgaggggactaccgtggtgatcacagagaactgtggaacgcgtggccccagcttacggaccactacagtctccggtaagctcattcacgaatggtgctgtcgatcatgcaccctgccccctcttagatatatgggggaggacggatgttggtacggcatggaaatcaggccaataaatgagaaagaagagaacatggttaagagcctggtgtctgctggttccggcaagatggataattttactatgggggtattgtgcctcgccattctgttcgaggaagtgatgcgcggaaaattcggcaagaaacatatgatcgcaggggtcctatttacattcgtgctgctcctgagtggacagatcacctggcgggacatggctcacacgcttattatgatcggcagcaacgcctctgatagaatgggtatgggggttacttatttggcactgattgccacctttaagatacagcccttcttagctctcggatttttcctgaggaaacttacatcccgcgagaatctgctactcggcgtgggcctggcgatggccaccactttgcaactgccggaagacatcgagcagatggcaaacgggattgctttaggactcatgacactgaaacttatcacccagtttgaaacataccagctgtggactgccttggtctcactcacctgtagtaatacgattttcacactgaccgtggcctggcgaactgctaccctaatcctggcgggtgttagccttctccctctgtgccaatcgtcctctatgcggaagacagattggttgccaatgactgtggccgcgatgggcgtaccacctctgcccttatttatattcagcctcaaagacaccccaaagcgtagatcatggcctctgaacgagggggtaatggctgtgggacttgttagtatcctggcctcctctttgctcaggaatgatgtgcccatggcaggcccactggtcgccggtgggctactgattgcttgttatgtgatcacgggaacaagcgcagaccttaccgtagagaaagccgcggacgtgacttgggaagaggaagctgagcagacaggcgtctcccataacctcatgattaccgttgatgacgatggcactatgcgcatcaaggacgatgaaacagagaacatactgaccgtgttgttaaaaacggccctgctcattgtgtcagggatctttccgtacagcatccctgcaactctgcttgtctggcacacctggcagaagcagacacaacggagtggagtgctgtgggacgttccctctccacccgagacccagaaagccgaattggaggaaggtgtatacagaattaagcagcagggcatattcgggaagacacaagtgggagtcggcgtgcagaaagagggtgtttttcatactatgtggcacgtgaccagaggggctgtcctaacgcacaatggaaagcgactggagcctaactgggcctccgtgaaaaaggatctcatcagctatggcggcgggtggcgcctgaatgcacagtggcaaaaaggagaagaggtacaggtcattgctgtggaaccaggtaagaaccccaagaatttccagacaatgcctggcatcttccagactaccacaggggagattggagccatcgcgcttgactttaaaccgggcacctcgggttcaccaataatcaacaaggaagggaaagttgtgggattatacggcaatggcgtcgtgactaagaacgggggatatgtttctggtattgcccaaaccaatgcagagcccgatggccctacaccagagctggaagaggaaatgttcaaaaagcggaacctcacgatcatggacttgcatcccgggagtggaaagactagaaaatacctgcctgctattgtgagggaggccatcaagcgtcgcctccggaccctgatacttgctccgacaagagtcgtggcagccgaaatggaggaggccctgaaaggcttgcccattaggtatcagaccactgctacaaagtccgaacacaccggtcgagagatcgtagatctaatgtgccatgcgacgtttactatgcggctgctcagcccagtgcgcgttcctaattacaacttagtcatcatggacgaagcacacttcacagatcccgcctctattgctgccagagggtatatcagcaccagggtgggaatgggcgaggcagccgctatatttatgaccgcgactccacctggcacagccgaagcattcccccagtccaatgctccaattcaggacgaggagcgggacatcccggaacgatcatggaacagtgggaatgagtggattaccgattttgtgggaaaaacagtctggttcgtacctagcatcaaggccggtaacgacatagcaaactgtctgagaaagaatggcaaaaaggtgattcaactttctcgcaaaacttttgatacggaataccagaagaccaggctgaacgactgggatttcgttgtgacaactgacatctccgagatgggggccaattttaaagctgatcgtgtcatcgacccccggagatgcctcaagccagtgattttgaccgatggacccgagagggttatcctggccggccctatgccagtgacagcggcatcagccgctcagcgccgaggtagagtcgggcggaacccccagaaggaaaatgaccaatacattttcaccggccagcctctcaacaatgatgaggaccatgcccactggactgaagctaaaatgctgcttgacaacataaatacgccggagggaatcattccagcactattcgaacccgagagggagaagagtgccgctatcgatggcgaatatcgcctgaaaggggagagccgtaagacctttgtggaattgatgagacggggagacttacctgtatggctggcccacaaagtggcatccgagggtatcaagtacacagataggaaatggtgcttcgacggcgaacgcaacaatcagattctcgaggagaacatggatgttgaaatatggactaaggagggggaacgaaagaaactgagaccccggtggcttgacgcgaggacctattctgatccactggccctcaaggagtttaaagacttcgctgccggacgcaagtcgatcgcattggatctggtcacagaaattggcagagtgcctagccatctagctcacaggacccggaatgccctggacaacctcgtgatgcttcatacttcagagcacggtgggcgtgcataccgccacgccgtcgaggaactgcccgagacaatggaaacgttattgctgctcggcctgatgatccttctgaccggaggcgctatgctctttttgatttccgggaaaggaatcggtaagacaagtataggcctgatctgtgttattgtgtctagcgggatgttatggatggcggatgtaccactacagtggatcgcctccgcaattgtgctggagttctttatgatggtcctccttatccctgagccggaaaagcaacgaacaccccaggacaatcagctggcttatgtggttataggaattttgaccctggccgccatcgtggcagctaacgagatgggcctcctggaaaccacaaaaagagatcttggtatgtcaaaggagccaggggtcgtatctcctactagctacctcgacgtggacctgcatcccgccagtgcgtggacgttgtatgctgttgccaccacagtgattactccaatgctgaggcacaccatcgaaaattccacagcaaacgtcagcttagccgctatagcaaaccaagccgtggtcctaatgggcctggataaaggatggcctatctctaagatggacctcggcgtgccccttctggcgttggggtgctactcacaggttaatccgctgaccctcactgctgccgtgctgcttttagtaacgcattacgcaattatcggaccaggcctgcaggccaaagctacacgggaggcccagaagcgcaccgcagctggtattatgaagaaccctactgtggatgggatcatgaccatagacctcgatcccgtcatttatgactccaaattcgagaagcaattgggacaggttatgctgctagtgctgtgtgccgtccagctccttctgatgagaacaagttgggcgttgtgcgaagccctgactctcgcaaccggcccaatcacaacgctgtgggagggtagccccggcaaattttggaataccactatcgctgtgtcgatggccaacattttcagggggtcttacttagcaggagctggccttgccttttccatcatgaaaagcgtagggacaggacggcgaggcaccggttcacagggggaaactctgggagagaaatggaagaagaaactcaatcaactaagtagaaaggagttcgatctgtataaaaagtctggcataacagaggtggaccgcaccgaggccaaagaaggtttgaagaggggcgagacgacccaccatgcggtttcccgggggagcgctaaactgcagtggtttgtggaacgtaacatggtcattcctgagggaagagtgatcgatctcggctgtgggaggggaggctggtcatactattgcgcaggtcttaagaaggtcacagaagtgcgcgggtacactaaaggaggcccgggccacgaggagcccgttccaatgagtacctatgggtggaatattgtaaagctgatgagcggaaaagacgtgttctacttgcctcccgaaaagtgtgatacactgctctgcgacatcggtgagtcctctcctagcccaactgtcgaagagtcccggaccatacgagtgttaaaaatggttgagccctggctgagaaacaatcagttctgtatcaaggtgcttaacccttacatgccaacagtcattgaacacctggagaggctacagcgcaagtatggcgggatgctcgtgcggaatcccctgtcaagaaactctacccatgaaatgtactggatcagtaatggaactggcaacattgtatcgagcgtgaatatggtttcccgtttgctgctcaacaggtttacgatgacacaccggcgcccgaccatcgagaaagatgtcgaccttggtgccgggactcgacatgtgaacgctgaacctgagaccccaaatatggacgtgattggagagagaatcaagaggataaaagaagaacactcttcaacatggcactatgatgacgaaaacccctacaagacgtgggcctatcatggcagctacgaggtcaaagcaaccggctccgccagttctatgattaatggggttgtgaagctgttaactaagccttgggatgtagtgccaatggtcacacaaatggctatgaccgacactacacccttcggacagcagcgggtgtttaaagaaaaggttgatacccgcacaccgagacctatgcccggtactaggaaagtgatggagatcaccgcggagtggctgtggcgaacgttgggccggaacaagaaaccacgtctctgcaccagagaagagttcacaaagaaggtccgcactaatgccgcaatgggggctgtgtttaccgaagagaaccaatgggacagcgccagggcagccgtagaagatgaggagttctggaaactggttgaccgggaaagagagctacacaaacttggaaaatgtggctcatgcgtgtataatatgatgggtaagcgcgagaagaagctgggggagtttggaaaagctaagggctccagggccatctggtacatgtggctcggcgcgcgatacctggagttcgaagcattggggtttctgaacgaggatcattggttcagtcgggaaaatagctattctggagtcgagggtgaaggcctccacaaacttgggtacattctgagagacatatccaaaatccctggaggcgccatgtatgctgatgacacagccggttgggacactaggattaccgaggatgacttacataacgaggaaaagatcacgcagcagatggatcccgagcaccgccagctggcaaatgctatttttaaattgacataccaaaacaaggtggtgaaagtccagcgtccaacccccaaggggactgttatggacatcatatcacggaaggatcagagaggaagcggccaggtgggcacatatgggctcaataccttcactaacatggaagcccaactggtaaggcagatggagggagaaggtgtgctatcgaaagctgaccttgagaatcctcatctgctcgagaagaaaatcacccagtggctggaaacaaagggcgtcgagcgcttgaaacgaatggccatttctggggatgactgcgtggttaagccaatcgatgaccggtttgcaaacgcgttactggccctcaacgatatgggaaaggtgagaaaagacattccgcagtggcaacccagtaagggctggcatgattggcagcaggtccctttctgttcccaccatttccacgaacttatcatgaaagacggtaggaagctggtggtaccatgccgcccccaggacgagctaatagggagagctcggattagccaaggagccggctggtcactgaaagaaacggcatgtctcggcaaggcttacgcccagatgtggtccttgatgtattttcacaggcgtgatctgcgacttgcatctaatgccatctgcagcgcggttcctgtgcattggatcccaaccagtcgcactacatggtccattcacgctcatcaccagtggatgaccactgaggacatgctgacagtctggaacagagtgtggatagaggataatccctggatggaagacaagacccctgttacgacatgggaggatgtgccgtacctcgggaaacgggaagaccaatggtgtggcagcttaatcggtctgacctctagggccacttgggcacagaacattttgaccgccatccagcaggtccgctcactgattggcgatgaggagttcctcgactacatgccaagtatgaagagatttcggaaagaagaggaatccgagggggctatctggtga

SEQ ID NO: 15246 - RNA, 9873 nt, synthetic construct
  misc_feature 1..9873: note = derived and/or modified CDS sequence (opt3) from DENV-3__HM181933__SS-prME
  source 1..9873: mol_type = other RNA
accagcctgtgcctcatgatgatgcttcccgcaacactggctttccacttgacttccagagacggcgaacctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcaccgccgagacaagcgtagcgtcgccctggcaccccacgtgggcatgggtttggatacacggacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaaaagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaattcaaagaacacgagtatgagcttttcctgcatcgttattggaataatcacactgtatctaggcgcggtcgtgcaggctgatatgggttgtgccattaattggaaggggaaggaactcaaatgcggatctggcatcttcgtgaccaacgaggtccacacttggacagagcagtacaagtttcaagcagacagccccaaacggctggccaccgctattgccggtgcatgggaaaatggcgtttgtgggatccgatcaactacccgcatggagaaccttttgtggaagcagatagctaatgaactgaactatatcctctgggagaataacattaaactgacagtggtggtaggagatatcattggcgtcttagaacaggggaagagaacgctgaccccacagcctatggagcttaaatacagttggaagacttggggaaaggccaaaatcgtgacagcggagacccaaaattccagcttcataattgacggccccaacacaccagaatgcccctctgcctcaagggcttggaacgtttgggaggtggaagactatggttttggggtcttcactaccaatatctggttgaagctccgggaggtgtacacgcagagttgtgatcatcgcctgatgagcgcagccattaaagacgaaagagctgttcacgccgatatgggatactggatcgagtcccagaagaacggctcttggaaactagagaaggcatcgtttatagaagtgaagacatgcacctggcctaaaagccacactctgtggtccaatggtgtactcgagtcagacatgatcattccaaagagtctggcgggcccgatctctcagcataaccacaggcccgggtatcatacccaaacagccggaccttggcaccttggcaaattggaactggatttcaattactgcgaggggactaccgtcgtgattacagagaactgtggaacgcgtcggcccagcttacgaaccactacagtgtccggcaagctcatccacgaatggtgctgtagatcatgcaccctgccccctcttaggtatatgggtgaggacgggtgttggtacggaatggaaatacgcccaattaatgagaaagaagagaacatggtcaagagcctggtttctgctggctccggtaaggtggataattttactatgggcgtattgtgcctcgccatcctgttcgaggaagtgatgcgggggaaattcggaaagaaacatatgatcgcaggcgtcctatttacattcgtgctgctcctgagtgggcagattacctggagagacatggctcacacgcttatcatgattggaagcaacgcctctgataggatgggcatgggtgttacttatttggcactgatagccacctttaagatccagcccttcttagctctcgggtttttcctgcgcaaacttacatcccgagagaatctgctactcggagtgggcctggcgatggccaccactttgcaactgccggaagacattgagcagatggcaaacggcatcgctttagggctcatgacactgaaacttattacccagtttgaaacataccagctgtggactgccttggtctcactcacctgtagtaatacgatcttcacactgaccgtggcctggcggactgctaccctaatactggcaggagttagccttctccctctgtgccaatcgtcctctatgcgtaagacagattggttgccaatgactgtggccgcgatgggtgtaccacctctgcccttatttatcttcagcctcaaagacaccccaaagagaaggtcatggcctctgaacgagggcgtaatggctgtggggcttgttagtattctggcctcctctttgctccgcaatgatgtgcccatggcaggaccactggtcgccggcggtctactgatcgcttgttatgtgattacggggacaagcgcagaccttaccgtagagaaagccgcggacgtgacttgggaagaggaagctgagcagacaggagtctcccataacctcatgatcaccgttgatgacgatggcactatgcggataaaggacgatgaaacagagaacattctgaccgtgttgttaaaaacggccctgctcatcgtgtcaggcatctttccgtacagcattcctgcaactctgcttgtctggcacacctggcagaagcagacacaaagaagtggggtgctgtgggacgttccctctccacccgagacccagaaagccgaattggaggaaggagtatacaggataaagcagcagggtatcttcggcaagacacaagtgggggtcggagtgcagaaagagggcgtttttcatactatgtggcacgtgacccgaggtgctgtcctaacgcacaatgggaagcgcctggagcctaactgggcctccgtgaaaaaggatctcattagctatggaggcggctggcggctgaatgcacagtggcaaaaaggggaagaggtacaggtcatcgctgtggaaccaggaaagaaccccaagaatttccagacaatgcctggtattttccagactaccacaggcgagatcggggccatagcgcttgactttaaaccgggaacctcgggctcaccaatcattaacagagaaggtaaggttgtggggttatacggaaatggcgtcgtgactaaaaacggcgggtatgtttctggaatcgcccaaaccaatgcagagcccgatggtcctacaccagagctggaagaggaaatgttcaagaaaaggaacctcacgattatggacttgcatcccggcagtgggaagactcgtaagtacctgcctgctatcgtgcgcgaggccataaaacggagactcaggaccctgattcttgctccgacacgagtcgtggcagccgaaatggaggaggccctgaagggattgcccatccggtatcagaccactgctacaaaatccgaacacaccggccgcgagatcgtagatctaatgtgccatgcgacgtttactatgagactgctcagcccagtgagggttcctaattacaacttagtcattatggacgaagcacacttcacagatcccgcctctatcgctgcccggggttatataagcacccgagtggggatgggagaggcagccgctatttttatgaccgcgactccacctggcacagccgaagcattcccccagtccaatgctccaatccaggacgaggagagagacattccggaacgctcatggaacagtggcaatgagtggatcaccgattttgtggggaagacagtctggttcgtacctagcataaaagccggaaacgacattgcaaactgtctgaggaagaatggtaagaaagtgatccaactttctcgtaagacttttgatacggaataccagaaaacccggctgaacgactgggatttcgttgtgacaactgacatctccgagatgggcgccaattttaaggctgatagagtcattgaccccaggcgctgcctcaaaccagtgatcttgaccgatgggcccgagcgagttattctggccggacctatgccagtgacagcggcatcagccgctcagagacggggcagggtcggtcgcaacccccagaaggaaaatgaccaatacatattcaccgggcagcctctcaacaatgatgaggaccatgcccactggactgaagctaagatgctgcttgacaacatcaatacgccggagggcattatcccagcactattcgaacccgagcgtgagaaaagtgccgctatcgatggagaatatagactgaagggcgagagccggaaaacctttgtggaattgatgaggcgcggggacttacctgtatggctggcccacaaggtggcatccgagggaattaaatacacagatcgaaagtggtgcttcgacggtgaaagaaacaatcagatactcgaggagaacatggatgttgaaatctggactaaagagggcgaacggaagaagctgaggccccgctggcttgacgcgagaacctattctgatccactggccctcaaagagtttaaggacttcgctgccgggaggaaatcgattgcattggatctggtcacagaaatcggacgggtgcctagccatctagctcaccgtacccgcaatgccctggacaacctcgtgatgcttcatacttcagagcacggcggtcgagcatacagacacgccgtcgaggaactgcccgagacaatggaaacgttattgctgctcgggctgatgattcttctgaccggcggagctatgctctttttgatctccggcaaggggataggaaaaacaagtatcggtctgatttgtgttatcgtgtctagcggcatgttatggatggcggatgtaccactacagtggattgcctccgcaatcgtgctggagttctttatgatggtcctccttatacctgagccggaaaagcaaaggacaccccaggacaatcagctggcttatgtggttattgggatcttgaccctggccgccattgtggcagctaacgagatgggactcctggaaaccacaaagcgggatcttggcatgtcaaaagagccaggtgtcgtatctcctactagctacctcgacgtggacctgcatcccgccagtgcgtggacgttgtatgctgttgccaccacagtgatcactccaatgctgcgccacaccatagaaaattccacagcaaacgtcagcttagccgctatcgcaaaccaagccgtggtcctaatggggctggataagggctggcctatttctaaaatggacctcggagtgccccttctggcgttgggctgctactcacaggttaatccgctgaccctcactgctgccgtgctgcttttagtaacgcattacgcaatcattgggccaggactgcaggccaaggctacaagagaggcccagaaaaggaccgcagctggcatcatgaagaaccctactgtggatggtataatgaccattgacctcgatcccgtcatctatgactccaagttcgagaaacaattggggcaggttatgctgctagtgctgtgtgccgtccagctccttctgatgcggacaagttgggcgttgtgcgaagccctgactctcgcaaccggaccaatcacaacgctgtgggagggcagccccggtaagttttggaataccactattgctgtgtcgatggccaacatcttccgaggctcttacttagcaggggctggacttgccttttccataatgaaaagcgtaggcacagggagacgcggaaccggctcacagggtgaaactctgggggagaagtggaaaaagaagctcaatcaactaagtaggaaagagttcgatctgtataagaaatctggaattacagaggtggaccggaccgaggccaaggaaggcttgaaacgtggtgagacgacccaccatgcggtttccagaggcagcgctaagctgcagtggtttgtggaaaggaacatggtcatccctgaggggcgcgtgattgatctcggatgtggcagagggggatggtcatactattgcgcaggccttaaaaaggtcacagaagtgcgaggttacactaaagggggaccgggccacgaggagcccgttccaatgagtacctatggctggaatatcgtaaaactgatgagcgggaaggacgtgttctacttgcctcccgaaaaatgtgatacactgctctgcgacataggagagtcctctcctagcccaactgtcgaagagtccagaaccatcagggtgttaaagatggttgagccctggctgcgcaacaatcagttctgtattaaagtgcttaacccttacatgccaacagtcatcgaacacctggagcggctacagagaaagtatggtggcatgctcgtgcgtaatcccctgtcaaggaactctacccatgaaatgtactggattagtaatgggactggaaacatcgtatcgagcgtgaatatggtttcccggttgctgctcaaccgctttacgatgacacaccgaagaccgaccattgagaaggatgtcgaccttggcgccggtactaggcatgtgaacgctgaacctgagaccccaaatatggacgtgatcggggagcggataaaacgcattaaggaagaacactcttcaacatggcactatgatgacgaaaacccctacaaaacgtgggcctatcatggaagctacgaggtcaaggcaaccggctccgccagttctatgatcaatggcgttgtgaaactgttaactaagccttgggatgtagtgccaatggtcacacaaatggctatgaccgacactacacccttcgggcagcagagagtgtttaaggaaaaagttgataccaggacaccgcgacctatgcccggaactcggaaggtgatggagatcaccgcggagtggctgtggcgtacgttgggtagaaacaaaaagccacgcctctgcaccagggaagagttcactaagaaggtccggactaatgccgcaatgggcgctgtgtttaccgaagagaaccaatgggacagcgccagagcagccgtagaagatgaggagttctggaagctggttgaccgcgaaagggagctacacaaacttgggaagtgtggatcatgcgtgtataatatgatgggcaaacgagaaaagaaactgggtgagtttgggaaggctaaaggatcccgggccatttggtacatgtggctcggcgcgagatacctggagttcgaagcattgggctttctgaacgaggatcattggttcagtagggaaaatagctattctggggtcgagggagaaggtctccacaaacttggctacatactgcgcgacatctccaagattcctgggggagccatgtatgctgatgacacagccggctgggacactcgtatcaccgaggatgacttacataacgaggagaaaattacgcagcagatggatcccgagcaccggcagctggcaaatgctatctttaagttgacataccaaaacaaagtggtgaaggtccagagaccaacccccaaaggtactgttatggacataatctcaaggaaggatcagcgcgggagcggacaggtgggcacatatggcctcaataccttcactaacatggaagcccaactggtacgacagatggagggggaaggagtgctatcgaaggctgaccttgagaatcctcatctgctcgagaaaaagattacccagtggctggaaacaaaaggtgtcgagcggttgaagagaatggccatctctggcgatgactgcgtggttaaaccaattgatgacaggtttgcaaacgcgttactggccctcaacgatatggggaaggtgcgcaaggacatcccgcagtggcaacccagtaaaggatggcatgattggcagcaggtccctttctgttcccaccatttccacgaacttataatgaaggacggcagaaaactggtggtaccatgccggccccaggacgagctaattggtagggctcgtatcagccaaggggccggatggtcactgaaggaaacggcatgtctcggcaaggcttacgcccagatgtggtccttgatgtattttcaccgacgcgatctgagacttgcatctaatgccatctgcagcgcggttcctgtgcattggattccaaccagtcggactacatggtccatacacgctcatcaccagtggatgaccactgaggacatgctgacagtctggaacagggtgtggatcgaggataatccctggatggaagacaagacccctgttacgacatgggaggatgtgccgtacctcggcaagcgcgaagaccaatggtgtgggagcttaattggactgacctctagagccacttgggcacagaacatcttgaccgccattcagcaggtccggtcactgatcggtgatgaggagttcctcgactacatgccaagtatgaaaaggtttcgaaaggaagaggaatccgagggcgctatatggtga

SEQ ID NO: 15247 - RNA, 9873 nt, synthetic construct
  misc_feature 1..9873: note = derived and/or modified CDS sequence (opt3) from DENV-3__JF295012__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagagcaaacccacactcgacatcgagctgcagaagaccgaagcaactcaacttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaaaaaggaactgttggtgacctttaaaaatgcccatgcaaagaagcaagaggtcgtggtcctcggctcacaggaaggagctatgcacactgccctgacaggcgctaccgagatccagaacagtgggggaacaagcatcttcgccggtcacttaaaatgtaggctgaagatggataaactagaactcaagggcatgtcttacgcaatgtgcctgaatacttttgtgcttaaaaaggaggtttccgagacccagcatgggacgattttgataaaggtggaatacaaaggagaggacgccccctgtaagatccctttctcaaccgaagatggccaaggtaaagctcacaacgggcggctgattacagcgaacccagtagtcactaagaaagaggagcccgtgaatatcgaagcagagccgcctttcggcgaaagcaacatagttattggaatcggcgacaaggccctcaagatcaattggtataaaaaggggagttctattggaaaaatgtttgaggctaccgcccgtggtgcacgcagaatggccatcctgggcgatacagcttgggacttcgggtccgtgggaggcgtccttaacagcctgggtaagatggtgcatcagatttttgggtcggcctacactgcattgttctctggcgtatcctggataatgaaaatcggaattggcgtgctcctgacctggatcgggttaaattcaaagaacacgagtatgagcttttcctgcatcgttattggaataatcacactgtatctaggcgcggtcgtgcaggctgatatgggttgtgtgattaattggaaggggaaagaactcaagtgcggatctggcatcttcgtcaccaacgaggttcacacttggacagagcagtacaaatttcaagccgacagccccaagaggctggcaaccgccattgctggtgcctgggaaaatggcgtgtgtgggatccggtcaactacccgaatggagaaccttttgtggaaacagatagcaaatgaactgaactatatcctctgggagaataacattaagctgacagtggtagtcggagatatcattggcgtgttagaacaggggaaacgcacgctgaccccacagcctatggagcttaagtacagttggaagacttggggaaaagctaagatcgttacagccgagacccaaaattccagcttcataattgacggccccaacacaccagaatgcccctctgcgtcaagagcctggaacgtgtgggaggtcgaagactatggttttggggtgttcactaccaatatctggttgaaactcagggaggtttacacgcagagttgtgatcatcggctgatgagcgctgcaattaaggacgaacgcgccgtgcacgctgatatgggatactggatcgagtcccagaaaaacggctcttggaagctagagaaggcctcgtttatagaagtaaaaacatgcacctggcctaagagccacactctgtggtccaatggtgtcctcgagtcagacatgatcattccaaaaagtctggcaggcccgatctctcagcataaccacagacccgggtatcatacccaaacagcgggaccttggcaccttggcaagttggaactggatttcaattactgcgaggggactaccgtggtgattacagagaactgtggaacgaggggcccaagcttacgtaccactacagtctccggtaaactcatccacgaatggtgctgtcggtcatgcaccctgccccctcttcgatatatgggggaggacggatgttggtacggcatggaaataagaccaattaatgagaaggaagagaacatggttaagagcctggtgtctgccggttccggcaaagtagataattttactatgggggtgttgtgcctcgctatcctgttcgaggaagtcatgaggggaaagttcggcaaaaagcatatgatcgccggggtgctatttacattcgttctgctcctgagtggacagattacctggcgcgacatggcacacacgcttatcatgattggcagcaacgcttctgatcggatgggtatgggggtgacttatttggccctgatagcaacctttaaaatccagcccttcttagccctcggatttttcctgagaaagcttacatccagggagaatctgctactcggcgtcggcctggctatggcgaccactttgcaactgccggaagacattgagcagatggccaacgggatcgcattaggactcatgacactgaagcttattacccagtttgaaacataccagctgtggactgctttggtgtcactcacctgtagtaatacgatcttcacactgaccgttgcctggcgcactgccaccctaatactggctggtgtgagccttctccctctgtgccaatcgtcctctatgcgaaaaacagattggttgccaatgactgtcgcagccatgggcgtaccccctctgcccttatttatcttcagcctcaaggacaccccaaaacggcgttcatggcctctgaacgagggggtgatggcggttggacttgtgagtattctggcttcctctttgctcagaaatgatgtccccatggccggcccactggtggcaggtgggctactgatcgcctgttatgtaattacgggaacaagcgctgaccttaccgtggagaaggcagccgacgtcacttgggaagaggaagcggagcagacaggcgtttcccataacctcatgatcaccgtggatgacgatggcactatgaggataaaagacgatgaaacagagaacattctgaccgtgttgttaaagacggctctgctcatcgtctcagggatctttccgtacagcattcctgccactctgcttgtgtggcacacctggcagaaacagacacaacgcagtggagttctgtgggacgtaccctctccacccgagacccagaaggcagaattggaggaaggtgtgtaccggataaagcagcagggcatcttcgggaaaacacaagtcggagtgggcgttcagaaggagggtgtgtttcatactatgtggcacgtcaccagaggggccgtgctaacgcacaatggaaaaaggctggagcctaactgggcttccgtaaagaaagatctcattagctatggcggcgggtggcgactgtcggcccagtggcaaaagggagaagaggtccaggtgatcgcagttgaaccaggtaagaatcccaaaaacttccagacaatgcctggcattttccagactaccacaggggagatcggagctatagcccttgactttaagccgggcacctcaggttctccaatcattaatcgcgaagggaaagtggtcggattatacggcaacggcgtggttactaagaatgggggatatgtgagtggtatcgcgcaaaccaacgccgagcccgatggccctacaccagagctggaagaggaaatgttcaaaaagcggaatctcacgattatggacttgcatcccgggtccggaaagactagaaaatacctgcctgcaatcgtcagggaggctataaagcgtcgcctccggaccctgattcttgccccgacaagagtggtagctgcagaaatggaggaggccctgaaaggcttgcccatcaggtatcagaccactgccacaaagagcgaacacaccggtcgagagatcgtggatctaatgtgccatgctacgtttactatgcggctgctctctccagttcgcgtccctaactacaatttagtgattatggacgaagcgcacttcacagatcccgcaagcatcgccgctagagggtatatatccaccagggtgggaatgggcgaggccgcagccatttttatgaccgctactccacctggcacagcggacgccttcccccagtcaaacgcaccaatccaggacgaagagcgggatattccggagcgaagttggaatagcgggaacgaatggatcaccgactttgctggaaaaacagtctggttcgtaccttctataaaggccggtaatgatattgcaaactgtctgagaaagaacggcaaaaaggtgatccaactttcccgcaaaacttttgacacggagtaccagaagaccaaactgaatgattgggacttcgttgtgacaactgatatctcagaaatgggggccaactttaaggctgacagggtcattgatccccgtcggtgcctcaagccagtgatcttgaccgacggacccgagagagttattctggccggccctatgccagtgacagcggcaagtgccgctcagaggcgcggtcgagtcgggagaaatccccagaaagagaacgatcaatacatattcaccggccagcctctcaataacgacgaagaccatgcccactggactgaggctaagatgctgcttgataatatcaacacgccggaaggaattatcccagcactattcgagcccgaacgggagaaaagcgccgctatcgacggcgagtataggctgaagggggaatcccgcaaaacctttgtggagttgatgcgtagaggagatttacctgtatggctggcccacaaggtggcatctgaaggtattaaatacacagaccggaagtggtgcttcgatggcgagaggaataaccagatactcgaagagaatatggacgttgagatctggactaaggaaggggagcgcaaaaagctgcgacccagatggcttgatgcgcggacctattcggacccactggccctcaaagaatttaaggatttcgctgccggaaggaaaagcattgcattggacctggtcacagagatcggccgcgtgccttcacatctagctcacagaaccaggaacgccctggataatctcgtgatgcttcatacttccgaacacggtgggcgggcataccgtcacgccgtcgaggagctgcccgaaacaatggagacgttattgctgctcggcctgatgattcttctgaccggaggcgctatgctctttttgatcagtgggaagggaataggtaagacttctatcggcctgatttgtgttatcgtgagctccgggatgttatggatggcggacgtaccactacagtggattgcctcagcaatcgtgctggaattctttatgatggtcctccttatacctgagccggagaaacaacgcacaccccaggataaccagctggcttatgtggttattggaatcttgaccctggccgccattgtggcagctaatgaaatgggcctcctggagaccacaaagcgagaccttggtatgtctaaagaaccaggggtcgtaagccctactagttacctcgacgtggatctgcatcccgcctccgcgtggacgttgtatgctgttgccaccacagtgatcactccaatgctgagacacaccatagagaacagcacagcaaatgtctctttagccgctatcgcaaaccaagccgtggtcctaatgggcctggacaagggatggcctatttcaaaaatggatctcggcgtgccccttctggcgttggggtgctactcccaggttaacccgctgaccctcactgctgccgtgctgcttttagtaacgcattacgcaatcattggaccaggcctgcaggccaaggctacaagggaagcccagaagcggaccgcagctggtatcatgaaaaatcctactgtggacgggataatgaccattgatctcgaccccgtcatctatgatagtaagttcgagaaacaattgggacaggttatgctgctagtgctgtgtgccgtccagctccttctgatgcgcacaagctgggcgttgtgcgaggccctgactctcgcaaccggcccaatcacaacgctgtgggaaggttcgcccggcaagttttggaacaccactattgctgtgtctatggccaatatcttcagagggtcctacttagcaggagctggccttgcctttagcataatgaaatcagtagggacaggaaggcggggcaccggtagtcagggggagactctgggagaaaagtggaagaaaaagctcaaccaactatctcgaaaagagttcgacctgtataagaaatccggcattacagaagtggatagaaccgaggccaaggagggtttgaaacgcggcgaaacgacccaccatgcggttagcagggggtcagctaagctgcagtggtttgtggagcggaatatggtcatccctgaaggacgtgtgattgacctcggctgtgggagaggaggctggagttactattgcgcaggtcttaagaaagtcacagaggtgagggggtacactaagggaggcccgggccacgaagagcccgttccaatgagcacctatgggtggaacatcgtaaaactgatgtccggaaaggatgtgttctacttgcctcccgagaaatgtgacacactgctctgcgatataggtgaatctagcccttccccaactgtcgaggaatcacgcaccatccgggtgttaaagatggttgagccctggctgcgaaataaccagttctgtattaaggtgcttaatccttacatgccaacagtcatcgagcacctggaaagactacagaggaaatatggcgggatgctcgtgcgcaaccccctgtctcggaatagtacccatgagatgtactggatttcgaacggaactggcaatatcgtaagctccgtgaacatggtttctagattgctgctcaatcgttttacgatgacacacaggcggccgaccattgaaaaggacgtcgaccttggtgccgggactcgccatgtgaacgctgagcctgaaaccccaaacatggatgtgatcggagagcgaataaaaagaattaaggaggaacactcaagcacatggcactatgacgatgagaatccctacaaaacgtgggcctatcatggctcctacgaagtcaaggcaaccggcagtgcctctagcatgatcaacggggttgtgaagctgttaactaaaccttgggacgtagtgccaatggtcacacaaatggctatgaccgatactacacccttcggacagcagagggtgtttaaggagaaagttgacacccggacaccgcgccctatgcccggtactagaaaggtgatggaaatcaccgcggagtggctgtggaggacgttgggccgaaataaaaagccacggctctgcacccgtgaggaattcacaaagaaagtcagaactaacgccgcaatgggggctgtgtttaccgaggaaaatcaatgggattcagcccgcgcagccgtagaggacgaagagttctggaagctggttgatagggagcgggaactacacaaacttggaaagtgtggctcctgcgtgtataacatgatgggtaaaagagagaagaaactgggggaatttggaaaggctaagggcagtcgcgccatttggtacatgtggctcggcgcgaggtacctggagttcgaggcattggggtttctgaatgaagaccattggttcagccgagagaactcttattccggagtcgaaggtgagggcctccacaaacttgggtacatactgcgggatatctcaaagattcctggaggcgccatgtatgctgacgacacagccggttgggatactagaatcaccgaagacgatttacataatgaggagaaaattacgcagcagatggaccccgaacacaggcagctggcaaacgctatctttaagttgacataccaaaataaagtggtgaaggtccagcgcccaacccccaaggggactgttatggatataatcagccgtaaagaccagcggggatcgggccaggtgggcacatatgggctcaacaccttcactaatatggaggcccaactggtaagacagatggaaggagagggtgtgctatctaaggctgatcttgaaaaccctcacctgctcgagaaaaagattacccagtggctggagacaaaaggcgtcgaaaggttgaagcgcatggccatcagtggggacgattgcgtggttaagccaattgacgatcgatttgcaaatgcgttactggccctcaacgacatgggaaaagtgcggaaggatatcccgcagtggcaaccctccaaaggctggcatgactggcagcaggtccctttctgtagccaccatttccacgagcttataatgaaggacggtagaaaactggtggtaccatgcaggccccaggatgaactaattgggcgcgctagaatctcacaaggagccggctggtccctgaaggagacggcatgtctcggcaaggcttacgcccagatgtggtctttgatgtattttcaccggagggacctgcgtcttgcaagcaacgccatctgcagtgcggttcctgtgcattggattccaacctcccgaactacatggagcatacacgctcatcaccagtggatgaccactgaagatatgctgacagtctggaatcgcgtgtggatcgaggacaacccctggatggaggataaaacccctgttacgacatgggaagacgtgccgtacctcgggaagagagaggatcaatggtgtggatctttaattggtctgacctcacgggccacttgggcacagaatatcttgaccgccattcagcaggtcaggagtctgatcggcgacgaagagttcctcgattacatgccatccatgaaacgctttagaaaggaggaagagagcgaaggggctatatggtga

SEQ ID NO: 15248 - RNA, 9873 nt, synthetic construct
  misc_feature 1..9873: note = derived and/or modified CDS sequence (opt3) from DENV-3__FJ898463__SS-prME
  source 1..9873: mol_type = other RNA
accagcctgtgcctcatgatgatccttcccgcagctctggcattccacttgacatccagggacggagaacctaggatgattgtggggaagaacgaacggggaaaatctttactgtttaagactgcatcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagaacaccgccgagacaagcgtagcgtcgcccttgcaccccatgtgggcatgggtctggatacaaggacccagacgtggatgtccactgaaggggcctggaggcaggtcgaaaaagtggagacctgggctttgcggcaccctggattcacaattctcgcactgtttctggcccattacatcggcacttctctcacccagaaggttgtgatattcatcttactgatgcttgtcacaccatcgatgaccatgcgctgtgtgggcgtagggaacagagactttgttgaaggattgtcaggtgctacgtgggtggatgtcgtgctggagcacggcgggtgcgtgactacaatggccaagaataaacccaccctagacattgagctccagaagactgaagcgacacagctggcaacccttaggaaactgtgtatcgagggaaagattacgaacatcaccacagatagccggtgccctactcagggcgaagccgtcttgccagaggaacaggaccagaattatgtttgtaaacacacctacgtggatcgcggttgggggaacggatgcggcctcttcggcaaggggagtctggtaacatgcgctaagtttcaatgtttagagcccatagagggaaaagtggtccagtatgaaaatctgaagtacactgtgattatcaccgttcatacaggtgaccagcaccaggtgggcaacgagacccaaggggtcactgccgaaattacgcctcaggcatccacaaccgaggctatcctcccagaatatggaactcttggcctggagtgctctccgcgaaccggtttggacttcaatgagatgatcctactgacaatgaaaaacaaggcctggatggtgcatagacagtggtttttcgatctccccctgccttggaccagcggggcgactacagaaacgccaacctggaataggaaagagcttctggtaacttttaagaacgcccacgccaagaagcaagaagttgtggtcttgggctcccaggagggagctatgcacacagccctcaccggcgctacagaaattcaaaattcagggggaacaagtatattcgccggtcatctgaagtgtcggttaaaaatggacaagctggagctaaaaggcatgagctacgcaatgtgcaccaacacgtttgtgctcaagaaagaggtctctgaaacccagcacgggacaatcctgattaaggtggagtacaagggagaagatgccccctgtaaaatccctttctccactgaggacggccaaggtaaggctcataacgggcgtcttataaccgcgaatccagttgtgactaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgcctctagggcttggaacgtgtgggaagttgaggactatggttttggggtgttcacgacaaatatttggctgaaacttcgggaagtctacacccagttgtgtgaccaccgcctcatgtcagcagccgtgaaggatgagagagctgttcacgccgacatgggatactggatcgagagtcagaaaaacggcagctggaagctggaaaaagcatccctaatagaggtgaagacttgcacctggcctaagtctcatacactgtggtcgaatggtgtactcgaaagcgatatgatcattccaaaatccctggcgggcccgatctcacagcacaaccataggcccgggtatcacactcaaaccgccggaccttggcaccttggcaagttggagctggactttaattactgcgaggggacaacggtcgtgattaccgaaaactgtggaactcgtggcccaagtttacggacaaccactgtgtctggtaaactcatccatgagtggtgctgtcgaagctgcacactgccccctcttagatatatgggggaagatggatgttggtacggcatggagataaggccaatttccgaaaaggaggagaatatggtcaaatcactggttagcgctggttctggcaaggtggacaacttcaccatgggggtattgtgcctcgccatcctgtttgaagaggtgatgcgcggaaagttcggcaaaaagcacatgatcgcaggggtcttctttacgttcgtgctactgctctccggacagattacttggcgggatatggctcataccctgatcatgattggcagtaatgccagcgacagaatgggtatgggggttacatatcttgcattgatagccacctttaaaatccagcccttcctggctttaggatttttcctcaggaagctgacttctcgcgaaaaccttctgctaggcgtgggcctcgcgatggccacaaccctgcaattgccggaggatattgaacagatggcaaatgggatcgctctgggattaatggccctcaaactgattacacagtttgagacttaccagctttggaccgccctgatctccttgacgtgttcaaacacaatgttcaccctcactgtcgcttggcgaaccgcaacactgatactagccggtgtgagtctgcttcctgtttgccaaagctcgtccatgcggaagactgactggctcccaatggcggtggctgccatgggcgtaccccctctgcccttgtttatcttctctctgaaggataccttaaaacgtagaagctggccactcaatgagggggtaatggcagtgggactggtttcaattcttgccagttccctgttgaggaacgacgtgcctatggctggccccctcgtcgccggtgggctgctaatcgcctgttatgtgattacgggaacatctgcggatctgaccgtagaaaaggctgccgacatcacttgggaggaagaggcagaacagacaggcgtgagccacaaccttatgataaccgtcgacgatgacggcactatgcgcattaaagatgacgagacagagaatatcctcaccgttctgttgaagacggccttactgatcgtgtccggggtgtttccatactcaattccggctactctcctggtctggcatacctggcagaaacagacacaacggagcggagtgctttgggatgttcctagtcccccagaaacccagaaggccgagctggaagagggtgtatacagaataaaacagcagggcatcttcgggaagacacaagtgggagtcggcgtgcagaaggagggtgtttttcacactatgtggcacgtgaccagaggggcagtcttgacgtataacggaaaacgactagaacccaattgggcttctgtgaagaaagacctgatttcctacggcggcgggtggcgcctcagcgcccagtggcaaaagggagaggaagtacaggtcatcgcggtggagcctggtaaaaacccaaagaatttccagacaatgcccggcactttccagaccacaaccggggaaattggagccatcgcactggattttaagcctggcacttcgggttcaccgataatcaaccgggaggggaaagttgtgggactttatggcaatggcgtcgtgaccaagaacgggggatacgtttctggtattgctcaaacaaatgccgagccagacggccccacgcctgaattagaggaagagatgttcaaaaagagaaacctgactatcatggatctccatccagggagtggaaaaaccaggaagtatttgcccgctattgtgcgtgaagcaatcaagcgccggctgagaacactcatactggcccctaccagggtcgtggccgctgagatggaggaagcgcttaaaggcctgccgattcgataccagactacagcaaccaagtccgagcacacgggtcgggaaatcgtagacttgatgtgccatgccacttttacaatgcgcctactgagccccgtgagagttccaaattataacctcatcattatggatgaggctcacttcaccgaccctgcctctatcgcagccagggggtacataagcacccgggtcggaatgggcgaagctgcggccatttttatgactgcaacacccccaggcaccgctgatgccttccctcagtccaatgcacccatccaggacgaggagcgagacattccagaaagatcatggaacagtgggaatgagtggatcacagattttgccggaaaaactgtgtggttcgtgccgagcataaaggctggtaacgacattgccaactgtttacgcaaaaatggcaagaaggtcatccaactgtctaggaaaacgtttgataccgaataccagaagacaaaacttaacgactgggatttcgtagtgactaccgacatctccgagatgggggcgaattttaaggcagatcgtgttattgaccctcggagatgcctgaaacccgtgatcctcacagatggaccagagagggtcattttggccggccccatgcctgtgaccgctgcctcagctgcacagcgccgaggtagagttgggcggaacagtcagaaggaaaatgaccaatatatattcactggccagccactgaacaatgatgaggaccatgcccactggacggaagctaagatgctcctggacaacatcaatacccccgagggaattatccctgcccttttcgaaccggagagggagaaaagcgcagcgatcgatggcgaataccgcctaaagggggagtcccgtaaaacatttgtggaactgatgagacggggagacttgccagtctggttagcccacaaggtggcttctgagggtattaaatatactgataggaagtggtgcttcgacggccagcgcaacaatcagatactggaagagaacatggatgtagagatctggaccaaagaaggggagaagaagaaactccgacccagatggctggacgcccggacatactcggatcctcttgcactgaaggaatttaaagacttcgctgccggaagaaagagcattgcactcgatttggtgaccgagatcggccgcgttccctcacatctggcccacagaactaggaatgctctagacaacctggtcatgctccatacatccgaacacggtgggcgggcgtatcgtcacgccgtggaggagcttccagaaacgatggagaccctgttattgctgggcctcatgattctgcttactggaggcgcaatgctgtttctcatcagtgggaaaggaataggtaagacatctatcggcttgatttgtgtgatcgctagctccgggatgctgtggatggccgaaattcctttacaatggatcgcctcagcaatagtcctagagttctttatgatggttctgctcattcccgagccagaaaagcagcgcacccctcaggataatcaacttgcttacgtggtaatcggcattctgaccttggccgcgatcatagctgccaacgagatgggcctgctcgaaacaactaaacgagacctgggtatgtctaaggagccgggggtggtcagccccacgagttatcttgatgtggacctccatccagcatccgcctggaccctgtacgctgttgcaacaactgtgatcacccctatgttgagacacacaattgaaaatagcaccgccaacgtctctctggcggctatcgccaaccaggcagtagtgttaatgggcctagacaaaggatggcccatttcaaagatggatctgggcgttccactccttgccctggggtgctactcccaggtgaatcctttgactctgacggctgccgtcctcctgcttatcacacattatgcaataattggacccggcttacaggctaaagccaccagggaggcgcaaaagcggactgccgcaggtatcatgaagaacccgaccgtggacgggatcatgacaattgatctggacccagtcatctacgatagtaaattcgagaagcagctcggacaggtgatgttgctggttctatgtgctgtgcagctgctccttatgcgcactagctgggccctgtgcgaagcattgaccctggctacaggccctataacgaccctctgggagggttcgcccggcaaattttggaatactacaattgccgtatctatggccaacatcttcagagggtcctatctggcgggagctggcttagcatttagcattatgaagtcagtggggaccggaaaaaggggcactggtagtcaaggggaaacacttggagagaagtggaagaaaaagctgaatcagctctctcggaaagagttcgacctatacaagaaatccggcatcaccgaggtcgatcgaacggaggccaaggaaggtctgaaaagaggcgagaccacacaccatgctgttagccgcgggtcagccaagttgcagtggtttgtggaaaggaacatggtcataccagagggacgggtgatcgacctgggctgtgggcgtggaggctggagttattactgcgcaggtctcaagaaagtaactgaagtgagagggtataccaagggaggccccggccacgaggagcctgttccgatgagcacatacgggtggaatattgtgaaacttatgtccggaaaggatgtcttctacctgcccccagaaaaatgtgacactttgctgtgcgatatcggtgagtctagcccttcccccaccgtggaagagtcaaggacaattcgcgtcctcaagatggtggagccttggttaaagaacaatcagttctgtatcaaagttctgaacccatatatgcccaccgtaattgaacaccttgagcggctgcaacgaaagcatggcgggatgctagtgagaaatcctctctctaggaacagtactcacgaaatgtactggatctcgaatggaacgggcaacatagtcgccagcgtgaatatggtttcccgcctgttgctgaaccggtttacaatgacccatagacgtccaactattgagaaagacgtggatctcggtgctgggaccaggcacgtcaacgcggaacccgagacaccgaatatggacgtgatcggagagcggatcaagcgcattaaagaagaacacaactctacgtggcattatgacgatgaaaatccttacaagacctgggcctatcacggctcatacgaggtaaaggcaactggcagcgcttccagtatgataaacggggtggttaaacttctgacaaagccatgggacgtcgtgcccatggtgacccagatggccatgactgatacaacccctttcggacagcaacgagtctttaaagaaaaggttgacacaagaactccaaggtctatgcccggtacccggcgcgtgatgggcatcacggcagagtggttatggaccacactggggagaaataaaaagccgaggttgtgcactcgagaggagttcaccaagaaagtacggacaaacgccgctatgggagccgtgtttactgaggaaaatcagtgggatagcgcgaaggcagccgtcgaggacgaagatttctggaaactcgtggaccgtgagagagagctgcataagctaggcaaatgtggttcatgcgtttataacatgatggggaagcgcgagaagaaacttggagagtttggcaaagctaaaggctccagggccatttggtacatgtggctgggggcacggtacctcgagttcgaggctctgggatttttgaatgaggatcactggttcagtagagaaaacagctattctggtgtggagggcgaagggctgcataagctcggatacatccttcgcgacatttccaaaatccctggcggtgccatgtatgctgatgacaccgccgggtgggacacgaggataacagaggatgacctgcacaatgaagagaagatcacccagcagatggatcccgagcaccgacaattagcaaacgcgatttttaaactgacttaccagaataaggtcgtgaaggtacagcggccaacacctaccggaactgttatggacatcatttcaagaaaagatcagaggggcagcggccaagtggggacctatggattgaacacattcacgaatatggaagcccagctcatccgccagatggagggtgaaggcgtcctgtcgaaggctgacctagagaacccccatcttccagagaaaaagataacccagtggctggagactaaaggggtggagcgtctcaagcggatggccatttctggagatgactgcgtggtcaagcccatcgatgacagatttgcaaacgctctgttggccttaaatgatatgggcaaagttaggaaggacatccctcaatggcagccaagtaaaggttggcacgattggcaacaggtgccgttctgttcccatcacttccacgaactgattatgaaggacgggcgcaaactcgtagtgccctgccgacctcaagacgagcttataggacgggcaagaatcagccagggcgccggctggtcactgagggaaacagcgtgtctagggaaggcttacgcccagatgtggtccctgatgtattttcatcgcagagatctccggttggcatctaacgccatttgcagcgctgtcccagtgcactgggttcccaccagtaggactacatggtccatccatgcccaccatcaatggatgaccacggaggacatgctgacagtgtggaatcgtgtctggattgaagataacccttggatggaggacaagaccccagtgactacctgggagaatgtaccctaccttggaaaacgagaagatcagtggtgtggtagcctgatcggcctcacatctcgcgcaacttgggctcagaacatacctaccgccatccagcaagttagatcattaattgggaatgaggagttcctggactacatgccgagtatgaagcggtttaggaaagaggaggaatccgagggagcgatctggtga

SEQ ID NO: 15249 - RNA, 9873 nt, synthetic construct
  misc_feature 1..9873: note = derived and/or modified CDS sequence (opt3) from DENV-3__GQ868616__SS-prME
  source 1..9873: mol_type = other RNA
accagcctgtgcctcatgatgatccttcccgcagctctggcattccacttgacttccagggacggagaacctaggatgattgtggggaagaacgaacggggaaaatctttactgtttaagactgcatcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagaacaccgccgagacaagcgtagcgtcgcccttgcaccccatgtgggcatgggtctggatacaagaacccagacgtggatgtccactgaaggggcctggaggcaggtcgaaaaagtggaaacctgggctttgcggcaccctggattcacaattctcgcactgtttctggcccattacatcggcacttctctcacccagaaggttgtgatattcatcttactgatgcttgtcacaccatcgatgaccatgcgctgtgtgggcgtagggaacagagactttgttgaaggattgtcaggtgctacgtgggtggatgtcgtgctggagcacggcgggtgcgtgactacaatggccaagaataaacccaccctagacattgagctccagaagactgaagcgacacagctggcaacccttaggaaactgtgtatcgagggaaagattacgaacatcaccacagatagccggtgccctactcagggcgaagccgtcttgccagaggaacaggaccagaattatgtttgtaaacacacctacgtggatcgcggttgggggaacggatgcggcctcttcggcaaggggagtctggtaacatgcgctaagtttcaatgtttagagcccatagagggaaaagtggtccagtatgaaaatctgaagtacactgtgattatcaccgttcatacaggtgaccagcaccaggtgggcaacgagacccaaggggtcactgccgaaattacgcctcaggcatccacaaccgaggctatcctcccagaatatggaactcttggcctggagtgctctccgcgaaccggtttggacttcaatgagatgatcctactgacaatgaaaaacaaggcctggatggtgcatagacagtggtttttcgatctccccctgccttggaccagcggggcgactacagaaacgccaacctggaataggaaagagcttctggtaacttttaagaacgcccacgccaagaagcaagaagttgtggtcttgggctcccaggagggagctatgcacacagccctcaccggcgctacagaaattcaaaattcagggggaacaagtatattcgccggtcatctgaagtgtcggttaaaaatggacaagctggagctaaaaggcatgagctacgcaatgtgcaccaacacgtttgtgctcaagaaagaggtctctgaaacccagcacgggacaatcctgattaaggtggagtacaagggagaagatgccccctgtaaaatccctttctccactgaggacggccaaggtaaggctcataacgggcgtcttataaccgcgaatccagttgtgactaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgcctctagggcttggaacgtgtgggaagttgaggactatggttttggggtgttcacgacaaatatttggctgaaacttcgggaagtctacacccagttgtgtgaccaccgcctcatgtcagcagccgtgaaggatgagagagctgttcacgccgacatgggatactggatcgagagtcagaaaaacggcagctggaagctggaaaaagcatccctaatagaggtgaagacttgcacctggcctaagtctcatacactgtggtcgaatggtgtactcgaaagcgatatgatcattccaaaatccctggcgggcccgatctcacagcacaaccataggcccgggtatcacactcaaaccgccggaccttggcaccttggcaagttggagctggactttaattactgcgaggggacaacggtcgtgattaccgaaaactgtggaactcgtggcccaagtttacggacaaccactgtgtctggtaaactcatccatgagtggtgctgtcgaagctgcacactgccccctcttagatatatgggggaagatggatgttggtacggcatggagataaggccaatttccgaaaaggaggagaatatggtcaaatcactggttagcgctggttctggcaaggtggacaacttcaccatgggggtattgtgcctcgccatcctgtttgaagaggtgatgcgcggaaagttcggcaaaaagcacatgatcgcaggggtcttctttacgttcgtgctactgctctccggacagattacttggcgggatatggctcataccctgatcatgattggcagtaatgccagcgacagaatgggtatgggggttacatatcttgcattgatagccacctttaaaatccagcccttcctggctttaggatttttcctcaggaagctgacttctcgcgaaaaccttctgctaggcgtgggcctcgcgatggccacaaccctgcaattgccggaggatattgaacagatggcaaatgggatcgctctgggattaatggccctcaaactgattacacagtttgagacttaccagctttggaccgccctgatctccttgacgtgttcaaacacaatgttcaccctcactgtcgcttggcgaaccgcaacactgatactagccggtgtgagtctgcttcctgtttgccaaagctcgtccatgcggaagactgactggctcccaatggcggtggctgccatgggcgtaccccctctgcccttgtttatcttctctctgaaggataccttaaaacgtagaagctggccactcaatgagggggtaatggcagtgggactggtttcaattcttgccagttccctgttgaggaacgacgtgcctatggctggccccctcgtcgccggtgggctgctaatcgcctgttatgtgattacgggaacatctgcggatctgaccgtagaaaaggctgccgacatcacttgggaggaagaggcagaacagacaggcgtgagccacaaccttatgataaccgtcgacgatgacggcactatgcgcattaaagatgacgagacagagaatatcctcaccgttctgttgaagacggccttactgatcgtgtccggggtgtttccatactcaattccggctactctcctggtctggcatacctggcagaaacagacacaacggagcggagtgctttgggatgttcctagtcccccagaaacccagaaggccgagctggaagagggtgtatacagaataaaacagcagggcatcttcgggaagacacaagtgggagtcggcgtgcagaaggagggtgtttttcacactatgtggcacgtgaccagaggggcagtcttgacgtataacggaaaacgactagaacccaattgggcttctgtgaagaaagacctgatttcctacggcggcgggtggcgcctcagcgcccagtggcaaaagggagaggaagtacaggtcatcgcggtggagcctggtaaaaacccaaagaatttccagacaatgcccggcactttccagaccacaaccggggaaattggagccatcgcactggattttaagcctggcacttcgggttcaccgataatcaaccgggaggggaaagttgtgggactttatggcaatggcgtcgtgaccaagaacgggggatacgtttctggtattgctcaaacaaatgccgagccagacggccccacgcctgaattagaggaagagatgttcaaaaagagaaacctgactatcatggatctccatccagggagtggaaaaaccaggaagtatttgcccgctattgtgcgtgaagcaatcaagcgccggctgagaacactcatactggcccctaccagggtcgtggccgctgagatggaggaagcgcttaaaggcctgccgattcgataccagactacagcaaccaagtccgagcacacgggtcgggaaatcgtagacttgatgtgccatgccacttttacaatgcgcctactgagccccgtgagagttccaaattataacctcatcattatggatgaggctcacttcaccgaccctgcctctatcgcagccagggggtacataagcacccgggtcggaatgggcgaagctgcggccatttttatgactgcaacacccccaggcaccgctgatgccttccctcagtccaatgcacccatccaggacgaggagcgagacattccagaaagatcatggaacagtgggaatgagtggatcacagattttgccggaaaaactgtgtggttcgtgccgagcataaaggctggtaacgacattgccaactgtttacgcaaaaatggcaagaaggtcatccaactgtctaggaaaacgtttgataccgaataccagaagacaaaacttaacgactgggatttcgtagtgactaccgacatctccgagatgggggcgaattttaaggcagatcgtgttattgaccctcggagatgcctgaaacccgtgatcctcacagatggaccagagagggtcattttggccggccccatgcctgtgaccgctgcctcagctgcacagcgccgaggtagagttgggcggaacagtcagaaggaaaatgaccaatatatattcactggccagccactgaacaatgatgaggaccatgcccactggacggaagctaagatgctcctggacaacatcaatacccccgagggaattatccctgcccttttcgaaccggagagggagaaaagcgcagcgatcgatggcgaataccgcctaaagggggagtcccgtaaaacatttgtggaactgatgagacggggagacttgccagtctggttagcccacaaggtggcttctgagggtattaaatatactgataggaagtggtgcttcgacggccagcgcaacaatcagatactggaagagaacatggatgtagagatctggaccaaagaaggggagaagaagaaactccgacccagatggctggacgcccggacatactcggatcctcttgcactgaaggaatttaaagacttcgctgccggaagaaagagcattgcactcgatttggtgaccgagatcggccgcgttccctcacatctggcccacagaactaggaatgctctagacaacctggtcatgctccatacatccgaacacggtgggcgggcgtatcgtcacgccgtggaggagcttccagaaacgatggagaccctgttattgctgggcctcatgattctgcttactggaggcgcaatgctgtttctcatcagtgggaaaggaataggtaagacatctatcggcttgatttgtgtgatcgctagctccgggatgctgtggatggccgaaattcctttacaatggatcgcctcagcaatagtcctagagttctttatgatggttctgctcattcccgagccagaaaagcagcgcacccctcaggataatcaacttgcttacgtggtaatcggcattctgaccttggccgcgatcatagctgccaacgagatgggcctgctcgaaacaactaaacgagacctgggtatgtctaaggagccgggggtggtcagccccacgagttatcttgatgtggacctccatccagcatccgcctggaccctgtacgctgttgcaacaactgtgatcacccctatgttgagacacacaattgaaaatagcaccgccaacgtctctctggcggctatcgccaaccaggcagtagtgttaatgggcctagacaaaggatggcccatttcaaagatggatctgggcgttccactccttgccctggggtgctactcccaggtgaatcctttgactctgacggctgccgtcctcctgcttatcacacattatgcaataattggacccggcttacaggctaaagccaccagggaggcgcaaaagcggactgccgcaggtatcatgaagaacccgaccgtggacgggatcatgacaattgctctggatccagtcatctacgacagtaaattcgagaagcagctcggacaggtgatgttgctggttctatgtgccgtgcagctgctccttatgcgcactagctgggcactgtgcgaggctttgaccctggccacaggccctataacgaccctctgggagggttcgcccggcaaattttggaatactacaattgccgtatctatggcgaacatcttcagagggtcctatctggctggagcaggcttagcctttagcattatgaagtcagtggggaccggaaaaaggggcactggtagtcaaggggaaacacttggagagaagtggaagaaaaagctgaatcagctctctcggaaagagttcgatctatacaagaaatccggcatcaccgaggtcgaccgaacggaggctaaggaaggtctgaaaagaggcgagaccacacaccatgccgttagccgcgggtcagcaaagttgcagtggtttgtggaaaggaacatggtcataccagagggacgggtgatcgatctgggctgtgggcgtggaggctggagttattactgcgccggtctcaagaaagtaactgaagtgagagggtataccaagggaggccccggccacgaggagcctgttccgatgagcacatacgggtggaatattgtgaaacttatgtccggaaaggacgtcttctacctgcccccagaaaaatgtgatactttgctgtgcgacatcggtgagtctagcccttcccccaccgtggaagagtcaaggacaattcgcgtcctcaagatggtggagccttggttaaagaacaatcagttctgtatcaaagttctgaacccatatatgcccaccgtaattgaacaccttgagcggctgcaacgaaagcatggcgggatgctagtgagaaatcctctctctaggaacagtactcacgaaatgtactggatctcgaatggaacgggcaacatagtcgctagcgtgaatatggtttcccgcctgttgctgaaccggtttacaatgacccatagacgtccaactattgagaaagatgtggacctcggtgcggggaccaggcacgtcaacgccgaacccgagacaccgaatatggatgtgatcggagagcggatcaagcgcattaaagaagaacacaactctacgtggcattatgacgacgaaaatccttacaagacctgggcatatcacggctcatacgaggtaaaggctactggcagcgcctccagtatgataaacggggtggttaaacttctgacaaagccatgggatgtcgtgcccatggtgacccagatggcaatgactgacacaacccctttcggacagcaacgagtctttaaagaaaaggttgatacaagaactccaaggtctatgcccggtacccggcgcgtgatgggcatcacgccggagtggttatggagacctctggggaggaataaaaagccccgattgtgcccacgggaggagttcaccaagaaagtacgtacaaacgcccctatgggagctgtgtttactgaggaaacccagtgggccagcgcgaaggcagccgtcgaggacgaagatttctggaaactcgtggacagagagcgcgagctgcataagctaggcaaatgtggttcatgcgtttataatatgatggggaagagggagaagaaacttggagagtttggcaaagctaaaggctcccgggccatttggtacatgtggctgggggcaagatacctcgagttcgaggctctgggatttttgaacgaggatcactggttcagtcgcgaaaatagctattctggtgtggagggcgaagggctgcccaagctcggatacatccttagggacatttccaaaatcccaggcggtgccatgtatgctgatgacacagccgggtgggatactcgaataaccgaggacgacctgcataacgaagagaagatcacgcagcagatggatcccgagcaccggcaattagcaaatgcgatttttaaactgacataccagaacaaggtcgtgaaggtacagagacctaccccaactggaacagttatggacatcatttcaaggaaagatcagcgcggcagcggccaagtggggacctatggattgaatactttcaccaacatggaagcccagctcatccgtcagatggagggtgaaggcgtcctgtcgaaggctgacctagagaatccgcaccttcccgagaaaaagataacacagtggctggagacgaaaggggtggagcggctcaagagaatggccatttctggagatgactgcgtggtcaagcctatcgatgacaggtttgcaaacgctctgttggccttaaacgatatgggcaaagttcgcaaggacatcccacaatggcagcccagtaaaggttggcatgattggcaacaggtgcctttctgttcccaccatttccacgaactgattatgaaggacgggcgaaaactcgtagtgccatgccggccccaagatgagcttataggaagggcaaggatcagccagggcgccggctggtcactgcgcgaaaccgcgtgtctagggaaggcttacgcccagatgtggtccctgatgtattttcacagacgggacctcaggttggcatctaatgccatttgcagcgctgtccctgtgcattgggttccgacaagtcgtacaacctggtccatccacgcccatcaccaatggatgactacagaggacatgctgaccgtgtggaaccgagtctggattgaagataatccatggatggaggacaagacgcccgtgacaacctgggagaacgtaccttaccttggaaaacgcgaagatcagtggtgtggtagcctgatcggcctcacttctagagcaacctgggctcagaatatacccacagccatccagcaagttcggtcattaattgggaacgaggagttcctggactacatgccaagtatgaagaggtttcgcaaagaggaggaatccgagggagcgatctggtga

SEQ ID NO: 15250 - RNA, 9873 nt, synthetic construct
  misc_feature 1..9873: note = derived and/or modified CDS sequence (opt3) from DENV-3__GQ199887__SS-prME
  source 1..9873: mol_type = other RNA
accagcctgtgcctcatgatgatccttcccgcagctctggcattccacttgacatccagggacggcgagcctaggatgattgtggggaagaacgaacggggaaagtctttactgtttaagactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaggtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataagcccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagtccatagagggaaaagtggtccagtatgaaaatctgaagtacacagtgattatcactgttcataccggtgaccagcaccaggtgggcaacgagacacaaggggtcaccgcagaaattactccccaggcttctacgacagaggccatcctccctgaatatggaacccttggcctggagtgcagcccacgaactggtttggacttcaatgagatgatcctactgaccatgaaaaacaaggcgtggatggtgcatagacagtggtttttcgatctcccgctgccctggacatccggggccaccactgaaacacctacgtggaataggaaagagcttctggtaacctttaagaacgcacacgctaaaaagcaagaagttgtggtcttgggctcacaggagggagccatgcacactgctctcacaggcgccaccgaaattcagaatagtgggggaacaagcatattcgcaggtcatctgaagtgtcggttaaaaatggacaagctggagctaaaaggcatgtcttacgccatgtgcactaacacctttgtgctcaagaaagaggtctccgaaacgcagcacgggaccatcctggtgaaggttgagtacaagggagaagatgctccatgtaaaattcccttctcaacagaggacggccaaggtaaggcgcataacgggcgtcttatcactgcaaatcctgtggtaaccaaaaaggaggaaccagtcaacatagaggccgaacccccgttcggcgagagcaatattgtgatcggaatcggcgataacgctttgaaaattaattggtataagaaggggagttctatcggaaaaatgtttgaagccacagcacgcggtgccagaaggatggctattctgggcgacactgcctgggatttcgggtccgttggaggcgtgctcaacagcctgggtaagatggtccaccagatatttgggtcggcatacaccgcgcttttctctggcgtgtcctgggtaatgaaaatcggaattggcgtgctgttgacgtggatcgggctcaattcaaagaacacaagtatgagcttttcctgcatcgctattggaataatcaccctgtatttaggcgccgttgtccaggcagacatgggttgtgtgattaattggaaagggaaggagctgaagtgcggatctggcatcttcgtgactaacgaggtccatacatggaccgaacagtacaaatttcaagccgatagccctaagcggctagctactgccattgccggtgcttgggagaatggcgtttgtgggatccgatcaaccacacgcatggaaaacctcctgtggaaacagatagccaatgagcttaactatatcttgtgggaaaataacattaagctgacggtggtggtaggagacaccatcggcgtcctcgagcaggggaaaagaactctgacaccccagccaatggagttaaagtacagttggaaaacctggggaaaggcgaagattgtgacagccgaaatccaaaactccagcttcataattgatggccctaatactcccgagtgcccatctgcttcaagggcatggaacgtttgggaagtggaggactatggttttggggtcttcaccacgaatatctggctgaaacttcgggaagtgtacacacagttgtgtgaccaccgcctcatgagtgccgctgttaaggatgagagagccgtgcacgcagacatgggatactggattgagagccagaaaaacggctcctggaagctggaaaaagcgtcttttatcgaggtaaagacctgcacttggcccaagtcgcataccctatggagcaatggtgtcctggaatccgatatgataatccctaaatcactcgccggcccaattagtcagcacaactataggccggggtaccatacacaaactgctggaccctggcacctgggcaaacttgagttggacttcaattattgcgaggggaccacagtggtgatcacggaaaactgtggaacccgtggcccttctctgcggactacaaccgtcagcggtaaattaattcacgagtggtgctgtcgatcctgcactctcccacccctgagatacatgggggaagatggatgttggtatggcatggagatcaggcctatatcagaaaaggaggagaatatggttaaaagccttgcctctgcaggttccggcaaggtggacaactttacaatgggggtactgtgcttggctattctcttcgaagaggtgatgcgcggaaagttcggcaaaaagcatatgatcgccggggtctttttcacctttgtgctgctactgagtggacagatcacgtggcgggatatggcacacactctcattatgatcggcagcaatgcctctgacagaatgggtatgggggttacctacctggctcttattgcgacattcaaaatacagccatttttggccctgggattctttttaaggaagctcacctcccgcgaaaacctgcttctgggcgtgggcctagcaatggctactacactccaactgcccgaggatatcgaacagatggccaatgggattgccttgggactgatggctttaaaactcatcacccagttcgagacatatcagctgtggactgcacttgtctcactgacctgtagtaacacgatgtttacattgaccgtggcctggcgaactgcgaccctcattctggctggtgttagcctactgccggtgtgccaatcgtcctctatgcggaagacagactggcttcctatgactgtcgccgcaatgggcgtaccacccctccctctgttcatctttagcttgaaggataccctgaaacgtagatcatggcccttaaatgagggggtgatggccgttggactcgtgagtatactggcttcctctcttctgaggaacgacgtcccaatggcaggccctttggtggccggtgggctcctgatcgcgtgttacgtaattacgggaacaagcgctgatctaaccgtggaaaaggccgcagacgtcacttgggaggaagaggccgaacagacaggcgtttcccataacctgatgatcaccgtggacgatgacggcactatgcgcattaaagatgacgagacagagaatatccttaccgtgctcctgaagacggctttgttaatagtctcagggattttcccctacagcatcccagccactctgctcgtgtggcacacctggcagaaacagacacaacggagtggagttctgtgggatgtaccgtctcctcccgaaacccagaaggcagagcttgaagagggtgtgtatagaatcaaacagcagggcattctggggaagacacaagtcggagtgggcgttcagaaggagggtgtgtttcatactatgtggcacgtcaccagaggggctgtgttgacgcacaacggaaaacgactagaaccaaattgggcctccgtaaagaaagacctgataagctacggcggcgggtggcgcctctcggcgcagtggcaaaagggagaggaagtccaggtgatcgccgttgagcccggtaaaaaccctaagaatttccagacaatgccaggcactttccagaccacaaccggggaaattggagcaatcgctctggattttaagcccggcacttcaggttctcctattatcaaccgggaggggaaagtggtcggactttatggcaatggcgtggttaccaagaacgggggatacgtgagtggtatagcccaaacaaatgctgagccggacggcccaacgcccgaattagaggaagagatgttcagaaaaaggaacctgactatcatggatctccatcctgggtccggaaagacccgtaaatatttgccagcaattgtccgcgaagccatcaagcggagactgaggacactcattctggcccccacccgagtggtagctgcggagatggaggaagcacttaagggcctgcctatccggtaccagactacagccaccaaaagcgagcacacgggtcgcgaaatagtggacttgatgtgccatgctacttttacaatgagactactgtctccggttagggtccccaattataacctcattatcatggatgaggcccacttcaccgacccagcaagcatcgccgctcgggggtacatttccacccgagtgggaatgggcgaagcggccgcaatctttatgactgctacacctcccggcaccgccgatgcattcccacagtcaaatgcccctatacaggacgaggagagagacattcccgaacgcagttggaacagcgggaatgagtggatcacagattttgctggaaagactgtgtggttcgtcccatctattaaagccggtaacgacatcgcgaactgtttaaggaagaatggcaaaaaggtaatacaactgtcccgtaagacgtttgataccgaataccagaaaacaaaacttaacgactgggatttcgtggttactaccgacatttcagagatgggggcaaattttaaagccgatcgggtgatcgacccgagaaggtgcctgaagcctgtcatcctcacagatggacccgagcgcgtgattttggctggcccaatgcccgttaccgccgctagtgcagcccagcgaagaggtcgggtggggaggaaccctcagaaagaaaatgaccaatatatcttcactggccagccactgaacaatgatgaggaccatgctcactggacggaagccaagatgctcctggacaacattaatacccccgagggaataatccctgcacttttcgaaccggagcgcgaaaagagcgcggccattgatggcgaataccgtctaaaaggggagtccagaaagacatttgtcgaactgatgcggaggggagacttgccagtgtggttagctcacaaagtagcctctgagggtatcaagtatactgatcgcaaatggtgcttcgacggccagcgaaacaatcagatcctggaagagaacatggatgtggagatttggaccaaggaaggggagaaaaagaagctcagaccccggtggctggacgcaaggacatactcggatcctcttgctctgaaagaatttaaggacttcgccgcaggacgcaaaagcatagccctcgatttggttaccgagatcggcagagtcccctcacatctggctcacaggactcggaatgcgctagacaacctggtgatgctccatacatccgaacacggtgggcgtgcctatcgccacgcagtggaggagcttccagaaacgatggagaccctgttattgctgggcctcatgattctgcttactggaggcgtcatgctgtttctcatcagtgggaagggaattggtaaaacatctatcggcttgatatgtgttatcgctagctccgggatgctgtggatggccgatgtgcctttacaatggattgcctcagcaatcgtactagagttctttatgatggtgctgctcattcccgagccagagaagcagcgaacccctcaggacaatcaacttgcttacgtcgtgatcggaatactgaccttggccgcgattatcgctgccaacgaaatgggcctgctcgagacaactaagagagatctgggtatgtctaaagaaccgggggttgtgagccccacgagttatcttgacgtcgacctccatccagcatccgcctggaccctgtacgctgtagcaacaactgtgattacccctatgttgaggcacacaatcgagaatagcaccgccaacgtttctctggcggctatagccaaccaggcagtggtcttaatgggcctagataagggatggcccatctcaaaaatggacctgggcgtgccactccttgccctggggtgctactcccaggtcaatcctttgactctgacggctgccgtgctcctgcttattacacattatgcaatcattggacccggcttacaggctaaggccacccgggaagcgcaaaaacgcactgccgcaggtatcatgaagaacccgaccgttgatgggataatgacaattgacctggatccagtgatctacgacagtaagttcgagaaacagctcggacaggtaatgttgctggtgctatgtgctgtccagctgctccttatgagaactagctgggccctgtgcgaggcattgaccctggctacaggccctatcacgaccctctgggaaggttcgcccggcaagttttggaatactacaattgccgtttctatggccaacatcttcagggggtcctatctggcgggagctggcttagcatttagcataatgaaatcagtggggaccggaaagcggggcactggtagtcaaggggagacacttggagaaaaatggaagaagaaactgaatcagctctctcgaaaggagttcgatctatacaaaaagtccggcattaccgaagtcgacagaacggaggccaaagagggtctgaagcgcggcgaaaccacacaccatgctgtgagcagggggtcagccaaattgcagtggtttgtagagcggaacatggtgatcccagaaggacgtgttattgatctgggctgtgggagaggaggctggagttattactgcgcaggtctcaagaaggtgactgaggtcagggggtataccaaaggaggccccggccacgaagaacctgtgccgatgagcacatacgggtggaatatcgtcaaacttatgtccggaaaagacgtgttctacctgcccccagagaagtgtgatactttgctgtgcgacataggtgaatctagcccttcccccaccgttgaggaatcacgcacaatccgggtactcaaaatggtggagccttggttaaagaacaatcagttctgtattaaggtcctgaacccatatatgcccaccgtgatcgagcaccttgaacgactgcaaagaaaacatggcgggatgctagttaggaatcctctctctcgcaacagtactcacgagatgtactggatttcgaatggaacgggcaacatcgtgagctccgtcaatatggtgtctcggctgttgctgaacagatttacaatgacccatcgtaggccaactattgaacgggatgtagacctcggtgccgggacccgccacgtgaacgctgagcccgaaatcccgaatatggacgttataggagagcgaattaagagaatcaaagaggaacacaactcaacatggcattatgatgacgagaatccttacaagacgtgggcgtatcacggcagctacgaagtcaaagccaccggctccgcaagttctatgatcaacggggtggtgaaacttctgactaagccatgggatgtcgttcccatggtgacacagatggctatgaccgacactacacctttcggacagcaaagggtatttaaagagaaggtggatacccggacaccacgccccatgccgggtactagaaaagtcatggaaattaccgccgagtggttatggaggacgctgggccgaaataagcggcctcgtttgtgcaccagagaggagttcactaagaaggtgcgcactaacgcagccatgggggctgtttttaccgaggaaaatcagtgggacagcgccaaggcggcagtggaggatgaagagttctggaaactcgtcgacagggagcgggaactgcataagctaggaaaatgtggctcatgcgtgtataacatgatgggtaagagagagaagaaacttggggaatttggaaaagccaaaggctcccgcgctatatggtacatgtggctgggcgccaggtacctcgagttcgaggcactggggtttttgaatgaagatcactggttcagtcgagagaacagctattctggagtagaaggtgagggcctgcataagctcgggtacatccttcgggacatttccaaaatccccggaggcgctatgtatgccgatgacacagctggttgggacactagaattaccgaagatgacctgcacaatgaggagaagatcacgcagcagatggatccagaacacaggcaattagccaacgcaatatttaaactgacataccagaataaggttgtgaaagtccagcgccctacccccactgggacagtgatggacatcatttcacgtaaggatcagcggggaagcggccaagtgggcacctatgggttgaacactttcaccaatatggaggcgcagctcgtcagacagatggaaggagagggtgttctgtcgaaggccgacctagaaaacccacatcttctggagaaaaagatcacacagtggctcgagacgaaaggcgtggaaaggctgaagcgcatggctatttctggggatgactgcgtagtgaaacccatcgatgaccgatttgccaacgcattgttagctctgaatgatatgggaaaggtccggaaggacatacctcaatggcagccaagtaaaggctggcacgattggcaacaggtgccgttctgttcccatcacttccacgagctcattatgaaggacggtagaaaacttgttgtgccctgcaggcctcaagacgaactgatcgggcgcgccagaatcagccagggagcaggctggtcactacgggagaccgcctgtctgggcaaggcgtacgctcagatgtggtccctcatgtattttcataggcgtgatttgcgactggcctctaacgcaatttgcagcgccgtcccagtgcactgggtacccacaagtcgcacaacctggtccatacatgctcaccatcaatggatgactacagaagacatgcttaccgtttggaatagagtgtggatcgaggataacccttggatggaggacaaaacgccagtcacaacctgggaaaatgtgccctacctggggaagcgggaggatcagtggtgtggaagcctcattggtttaacttctagggccacctgggcacagaacatccctacagctattcagcaagttcgctcactgatcggcaatgaagagttcttggactacatgccgagtatgaagagatttcggaaagaggaagagtccgaaggggccatatggtga

SEQ ID NO: 15251 - RNA, 9873 nt, synthetic construct
  misc_feature 1..9873: note = derived and/or modified CDS sequence (opt3) from DENV-3__GQ199888__SS-prME
  source 1..9873: mol_type = other RNA
accagcctgtgcctcatgatgatccttcccgcagctctggcattccacttgacctccagggacggcgagcctaggatgattgtggggaagaacgaacggggaaagtctttactgtttaagactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaggtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataagcccacactagacattgagctccagaagaccgaagcaactcaactggccacacttaggaagctgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagtccatagagggaaaagtggtccagtatgaaaatctgaagtacacagtgattatcactgttcataccggtgaccagcaccaggtgggcaacgagacacaaggggtcaccgcagaaattactccccaggcttctacgacagaggccatcctccctgaatatggaacccttggcctggagtgcagcccacgaactggtttggacttcaatgagatgatcctactgaccatgaaaaacaaggcgtggatggtgcatagacagtggtttttcgatctcccgctgccctggacatccggggccaccactgaaacacctacgtggaataggaaagagcttctggtaacctttaagaacgcacacgctaaaaagcaagaagttgtggtcttgggctcacaggagggagccatgcacactgctctcacaggcgccaccgaaattcagaatagtgggggaacaagcatattcgcaggtcatctgaagtgtcggttaaaaatggacaagctggagctaaaaggcatgtcttacgccatgtgcactaacacctttgtgctcaagaaagaggtctccgaaacgcagcacgggaccatcctggtgaaggttgagtacaagggagaagatgctccatgtaaaattcccttctcaacagaggacggccaaggtaaggcgcataacgggcgtcttatcactgcaaatcctgtggtaaccaaaaaggaggaaccagtcaacatagaggccgaacccccgttcggcgagagcaatattgtgatcggaacaggcgataacgctttgaaaatcaattggtataagaaggggagttctattggaaaaatgtttgaagccactgcacgcggtgccagaaggatggctatcctgggcgacaccgcctgggatttcgggtccgttggaggcgtgctcaacagcctgggtaagatggtccaccagatttttgggtcggcatacacggcgcttttctctggcgtgtcctgggtaatgaaaataggaatcggcgtgctgttgacatggattgggctcaattcaaagaacaccagtatgagcttttcctgcatcgctatcggaattataactctgtatttaggcgccgttgtccaggcagacatgggttgtgtgatcaattggaaagggaaggagctgaagtgcggatctggcattttcgtgacaaacgaggtccatacctggactgaacagtacaaatttcaagccgatagccctaagcggctagctaccgccatcgccggtgcttgggagaatggcgtttgtgggattcgatcaacaacgcgcatggaaaacctcctgtggaaacagatcgccaatgagcttaactatatattgtgggaaaataacatcaagctgaccgtggtggtaggagacactattggcgtcctcgagcaggggaaaagaacactgacaccccagccaatggagttaaagtacagttggaaaacatggggaaaggcgaagatcgtgactgccgaaattcaaaactccagcttcatcatagatggccctaatacccccgagtgcccatctgcttcaagggcatggaacgtttgggaagtggaggactatggttttggggtcttcacgacaaatatttggctgaaacttcgggaagtgtacacccagttgtgtgaccaccgcctcatgagtgccgctgttaaggatgagagagccgtgcacgcagacatgggatactggatcgagagccagaaaaacggctcctggaagctggaaaaagcgtcttttattgaggtaaagacttgcacctggcccaagtcgcatacactatggagcaatggtgtcctggaatccgatatgatcatacctaaatcactcgccggcccaatcagtcagcacaactataggccggggtaccatactcaaaccgctggaccctggcacctgggcaaacttgagttggacttcaattattgcgaggggacaacggtggtgattaccgaaaactgtggaactcgtggcccttctctgcggacaaccactgtcagcggtaaattaatccacgagtggtgctgtcgatcctgcacactcccacccctgagatacatgggggaagatggatgttggtatggcatggagattaggcctatctcagaaaaggaggagaatatggttaaaagccttgcctctgcaggttccggcaaggtggacaactttaccatgggggtactgtgcttggctatactcttcgaagaggtgatgcgcggaaagttcggcaaaaagcatatgattgccggggtctttttcacgtttgtgctgctactgagtggacagatcacttggcgggatatggcacacaccctcatcatgattggcagcaatgcctctgacagaatgggtatgggggttacatacctggctcttatcgcgaccttcaaaattcagccatttttggccctgggattctttttaaggaagctcacttcccgcgaaaacctgcttctgggcgtgggcctagcaatggctacaaccctccaactgcccgaggatatagaacagatggccaatgggatcgccttgggactgatggctttaaaactcattacacagttcgagacttatcagctgtggaccgcacttgtctcactgacgtgtagtaacacaatgtttaccttgactgtggcctggcgaaccgcgacactcatcctggctggtgttagcctactgccggtgtgccaatcgtcctctatgcggaagactgactggcttcctatgaccgtcgccgcaatgggcgtaccacccctccctctgttcatttttagcttgaaggatacgctgaaacgtagatcatggcccttaaatgagggggtgatggccgttggactcgtgagtatcctggcttcctctcttctgaggaacgacgtcccaatggcaggccctttggtggccggtgggctcctgatagcgtgttacgtaatcacaggaaccagcgctgatctaactgtggaaaaggccgcagacgtcacatgggaggaagaggccgaacagaccggcgtttcccataacctgatgattactgtggacgatgacggcacaatgcgcatcaaagatgacgagaccgagaatattcttacggtgctcctgaagactgctttgttaatcgtctcagggatattcccctacagcattccagccaccctgctcgtgtggcacacatggcagaaacagacccaacggagtggagttctgtgggatgtaccgtctcctcccgaaacacagaaggcagagcttgaagagggtgtgtatagaatcaaacagcagggcatcctggggaagactcaagtcggagtgggcgttcagaaggagggtgtgtttcataccatgtggcacgtcacgagaggggctgtgttgacacacaacggaaaacgactagaaccaaattgggcctccgtaaagaaagacctgattagctacggcggcgggtggcgcctctcggcgcagtggcaaaagggagaggaagtccaggtgatagccgttgagcccggtaaaaaccctaagaatttccagactatgccaggcaccttccagacaaccactggggaaatcggagcaattgctctggattttaagcccggcacctcaggttctcctatcattaaccgggaggggaaagtggtcggactttatggcaatggcgtggttacaaagaacgggggatacgtgagtggtatcgcccaaacgaatgctgagccggacggcccaactcccgaattagaggaagagatgttcagaaaaaggaacctgaccataatggatctccatcctgggtccggaaagacacgtaaatatttgccagcaatcgtccgcgaagccattaagcggagactgaggaccctcatcctggcccccactcgagtggtagctgcggagatggaggaagcacttaagggcctgcctattcggtaccagacaaccgccacgaaaagcgagcacactggtcgcgaaatcgtggacttgatgtgccatgctacatttaccatgagactactgtctccggttagggtccccaattataacctcataattatggatgaggcccacttcaccgacccagcaagcatcgccgctcgggggtacatctccactcgagtgggaatgggcgaagcggccgcaatttttatgacagctacccctcccggcacagccgatgcattcccacagtcaaatgcccctatccaggacgaggagagagacatacccgaacgcagttggaacagcgggaatgagtggattactgattttgctggaaagacggtgtggttcgtcccatctatcaaagccggtaacgacattgcgaactgtttaaggaagaatggcaaaaaggtaatccaactgtcccgtaagacctttgatacagaataccagaaaactaaacttaacgactgggatttcgtggttaccacagacatatcagagatgggggcaaattttaaagccgatcgggtgattgacccgagaaggtgcctgaagcctgtcatcctcaccgatggacccgagcgcgtgatcttggctggcccaatgcccgttactgccgctagtgcagcccagcgaagaggtcgggtggggaggaaccctcagaaagaaaatgaccaatatattttcacgggccagccactgaacaatgatgaggaccatgctcactggaccgaagccaagatgctcctggacaacatcaatacacccgagggaattatacctgcacttttcgaaccggagcgcgaaaagagcgcggccatcgatggcgaataccgtctaaaaggggagtccagaaagacttttgtcgaactgatgcggaggggagacttgccagtgtggttagctcacaaagtagcctctgagggtattaagtataccgatcgcaaatggtgcttcgacggccagcgaaacaatcagatcctggaagagaacatggatgtggagatctggacaaaggaaggggagaaaaagaagctcagaccccggtggctggacgcaaggacctactcggatcctcttgctctgaaagaatttaaggacttcgccgcaggacgcaaaagcattgccctcgatttggttactgagataggcagagtcccctcacatctggctcacaggacacggaatgcgctagacaacctggtgatgctccatacgtccgaacacggtgggcgtgcctatcgccacgcagtggaggagcttccagaaaccatggagactctgttattgctgggcctcatgatcctgcttacaggaggcgctatgctgtttctcattagtgggaagggaatcggtaaaacctctattggcttgatctgtgtcatagccagctccgggatgctgtggatggccgatgttcctttacaatggatcgcatcagctattgtgctagagttctttatgatggtactgctcatccccgagccagagaagcagcgaacccctcaggacaatcaacttgcctacgtggtcattggaatcctgacattggcggctataattgccgcaaacgaaatgggcctgctcgagactacgaagagagatctgggtatgtctaaagaaccgggggtggttagccccaccagttatcttgacgtggacctccatccagcctccgcttggacactgtacgcagtcgccactaccgtaatcacacctatgttgaggcacaccattgagaatagcactgcgaacgtgtctctggctgccatcgcaaaccaggccgttgtgttaatgggcctagataagggatggcccatatcaaaaatggacctgggcgtcccactccttgctctggggtgctactcccaggtgaatcctttgacgctgacagccgcagtcctcctgcttatcacccattatgctattatcggacccggcttacaggccaaggcgactcgggaagcccaaaaacgcaccgcagctggtattatgaagaacccgacagtggatgggatcatgactatagacctggatccagttatttacgacagtaagttcgagaaacagctcggacaggtgatgttgctggtactatgtgccgtgcagctgctccttatgagaaccagctgggcactgtgcgaggctttgacactggccacgggccctatcaccactctctgggaaggttcgcccggcaagttttggaatacaaccatcgccgtctctatggcgaacattttcagggggtcctatctggctggagcaggcttagcctttagcatcatgaaatcagttgggactggaaagcggggcacaggtagtcaaggggagacccttggagaaaaatggaagaagaaactgaatcagctctctcgaaaggagttcgatctatacaaaaagtccggcataacggaagtggacagaaccgaggctaaagagggtctgaagcgcggcgaaacaactcaccatgccgtcagcagggggtcagcaaaattgcagtggtttgtggagcggaacatggtaattccagaaggacgtgtgatcgatctgggctgtgggagaggaggctggagttattactgcgccggtctcaagaaggttaccgaggtgagggggtatacaaaaggaggccccggccacgaagaacctgtcccgatgagcacttacgggtggaatattgtgaaacttatgtccggaaaagacgtcttctacctgcccccagagaagtgtgataccttgctgtgcgacatcggtgaatctagcccttcccccacagtggaggaatcacgcaccatacgggttctcaaaatggtagagccttggttaaagaacaatcagttctgtatcaaggtgctgaacccatatatgcccactgtcattgagcaccttgaacgactgcaaagaaaacatggcgggatgctagtgaggaatcctctctctcgcaacagtacgcacgagatgtactggatctcgaatggaacaggcaacattgttagctccgtgaatatggtctctcggctgttgctgaacagatttaccatgactcatcgtaggccaaccatcgaacgggatgtggacctcggtgctgggacacgccacgtaaacgcggagcccgaaattccgaatatggacgtgatcggagagcgaataaagagaattaaagaggaacacaactcaacgtggcattatgatgacgagaatccttacaagacctgggcctatcacggcagctacgaagttaaagcaactggctccgctagttctatgatcaacggggtcgtgaaacttctgacaaagccatgggatgtggtccccatggttacccagatggccatgactgacacaacccctttcggacagcaaagggtgtttaaagagaaggtagatacacggactccacgccccatgccgggtaccagaaaagtgatggaaatcacggcagagtggttatggaggaccctgggccgaaataagcggcctcgtttgtgcacaagagaggagttcactaaaaaggtccgcaccaacgccgctatgggggccgtgtttacagaggaaaatcagtgggacagcgcgaaggcagccgttgaggatgaagagttctggaaactcgtggacagggagcgggaactgcataagctaggaaaatgtggctcatgcgtctataacatgatgggtaagagagagaagaaacttggggaatttggaaaagctaaaggctcccgcgccatttggtacatgtggctgggcgcaaggtacctcgagttcgaggctctggggtttttgaatgaagatcactggttcagtcgagagaacagctattctggagtggaaggtgagggcctgcataagctcgggtacatacttcgggacatctccaaaattcccggaggcgccatgtatgctgatgacactgccggttgggacaccagaatcacggaagatgacctgcacaatgaggagaagattacacagcagatggatccagaacacaggcaattagcaaacgcgatctttaaactgacctaccagaataaggtagttaaagtgcagcgccctactcccacagggaccgtcatggacataatctcacgtaaggatcagcggggaagcggccaagtgggcacttatgggttgaacaccttcacaaatatggaggcccagctcgtgagacagatggaaggagaggacgtcctgtcgaaggctgatctagaaaacccacatcttctggagaaaaagattacgcagtggctcgagaccaaaggtgttgaaaggctgaagcgcatggccatctctggcgacgattgcgtggtaaaacccattgacgatcgatttgcaaacgctttgttagccctgaatgacatggggaaggtgcggaaggatatccctcaatggcagccaagtaaaggatggcacgactggcagcaggtcccgttctgttcccatcacttccacgagctcataatgaaggacggcagaaaacttgtggttccctgcaggcctcaagatgaactgattggtcgcgcaagaatcagccagggggccggatggtcactacgggagactgcgtgtctgggcaaggcttacgcccagatgtggtccctcatgtattttcataggcgtgacttgcgactggcatctaacgccatctgcagcgctgtgccagtccactgggtgcccacaagtcgcaccacttggtccattcatgcccaccatcaatggatgacaaccgaagatatgcttacggtatggaatagagtttggatagaggacaacccttggatggaggataaaacaccagtgaccacttgggaaaatgtcccctacctgggcaagcgggaggaccagtggtgtgggagcctcatcggattaacctctagggcaacatgggctcagaacattcctactgccatccagcaagtgcgctcactgattggtaatgaagagttcttggattacatgccgagtatgaagagatttcggaaagaggaagagtccgaaggcgcgatctggtga

SEQ ID NO: 15252 - RNA, 9873 nt, synthetic construct
  misc_feature 1..9873: note = derived and/or modified CDS sequence (opt3) from DENV-3__GQ252674__SS-prME
  source 1..9873: mol_type = other RNA
accagcctgtgcctcatgatgatccttcccgcagctctggcattccacttgacatccagggacggcgaacctaggatgattgtggggaagaacgaacggggaaagtctttactgtttaagactgcatcaggtataaatatgtgtacgctaatcgcgatggatctcggcgaaatgtgcgacgataccgtcacctacaaatgtccacatattactgaagttgaaccggaagacatcgattgctggtgtaacctgaccagtacatgggtgacctatgggacttgcaatcaggctggagagcaccgccgagacaagcgtagcgtcgcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcattgggaacagagactttgtagaaggattgtcaggtgccacctgggttgatgtggtcctggagcacggcgggtgcgtgacgactatggcgaagaataaacccacactagacatcgagctccagaagaccgaagcaactcagctggccacacttaggaaactgtgtattgagggaaagatcaccaacataacgaccgatagccggtgccctacacagggcgaagctgtgttgccagaggaacaggaccagaattatgtctgtaaacacacttacgttgatcgcggttgggggaacggatgcggcctcttcggcaaggggagtctggtgacctgcgccaagtttcaatgtttagagcccattgagggaaaagtagtgcagtatgaaaatctgaagtacacagtcatcattactgtgcataccggtgaccagcaccaggttggcaacgagacacaaggggtgaccgcagaaatcactcctcaggcttccacgacagaggccatcctcccagaatatggaacccttggcctggagtgctctccgcgaactggtttggacttcaatgagatgattctactgaccatgaaaaacaaggcgtggatggtccatagacagtggtttttcgatctccccctgccttggacaagcggggccaccactgaaacaccaacgtggaataggaaagagcttctggtgacctttaagaacgcacacgctaaaaagcaagaagtagttgtgttgggctcccaggagggagccatgcacactgctctcacaggcgccaccgaaatacaaaattcagggggaacaagtatcttcgcaggtcatctgaagtgtcggttaaaaatggacaagctggagctaaaaggcatgagctacgccatgtgcactaacacctttgtcctcaagaaagaggtgtctgaaacgcagcacgggaccattctgatcaaggtcgagtacaagggagaagatgctccctgtaaaatacctttctccacagaggacggccaaggtaaggcgcataacgggcgtcttattactgcaaatccagtggttaccaaaaaggaggaacccgtgaacatcgaggccgaaccgcctttcggcgagtcaaatatcgtaattggaatcggcgataacgctttgaaaattaattggtataagaaggggagcagtataggaaaaatgtttgaagccacagcacgcggtgccagaaggatggctatcctgggcgacactgcctgggatttcgggtctgtcggaggcgtgctcaactccctgggtaagatggttcaccagatttttgggagcgcatacaccgcgcttttctcgggcgtgtcttgggtcatgaaaatcggaatcggcgtgctgttgacgtggattgggctcaattccaagaacacatcaatgagttttagctgcatagctatcggaattatcaccctgtatttaggcgccgtagtgcaggcagacatgggttgtgttattaattggaaagggaaggagctgaagtgcggatccggcatcttcgtcactaacgaggtgcatacatggaccgaacagtacaaatttcaagccgattctcccaagcggctagctactgccatagccggtgcttgggagaatggcgtgtgtgggatccgaagcaccacacgcatggaaaacctcctgtggaaacagattgccaatgagcttaactatatcttgtgggaaaataacattaagctgacggtcgttgtgggagacaccatcggcgtgctcgagcaggggaaaagaactctgacaccacagcctatggagttaaagtactcatggaaaacctggggaaaggcgaagatagtaacagccgaaactcaaaacagttccttcattatcgatggccccaataccccagagtgccccagcgcttctagggcatggaacgtctgggaagtggaggactatggttttggggttttcacgacaaatatttggctgaaacttcgggacgtgtacacccagttgtgtgatcaccgcctcatgtcagccgctgtcaaggacgaaagagccgtgcacgcagatatgggatactggatcgagagtcagaaaaacggcagctggaagctggagaaagcgtccctaatagaagttaagacttgcacctggcctaagtctcatacactgtggtcgaatggtgtgctcgagagcgacatgatcattccaaaatccctggccggcccgatctcacagcacaactataggcccgggtaccatactcaaaccgctggaccttggcaccttggcaagttggaactggattttaattattgcgaggggacaacggtagtcattaccgagaactgtggaactcgtggcccaagtttacggacaaccactgtgtctggtaaactcatccacgaatggtgctgtcgaagctgcacactgccccctcttagatacatgggggaggacggatgttggtatggcatggaaataaggccaatttccgagaaggaagagaatatggtgaaatcactggtcagcgccggttctggcaaggttgataacttcaccatgggggtgttgtgcctcgcaatcctgtttgaggaagtaatgcgcggaaagttcggcaaaaagcatatgatcgctggggtgctattcacgtttgtcctgctcctgtccggacagattacttggcgggacatggcccacacccttatcatgattggcagtaatgcaagcgatagaatgggtatgggggtgacatacttggccctgatagctaccttcaaaatccagccctttttagcgctcggattctttctgaggaaacttacttctcgcgagaacctgctactcggcgttggcctggccatggcaacaaccttgcaactgccggaagacattgagcagatggctaatgggatcgccttaggactcatggccctgaaacttattacacagttcgaaacttatcagctgtggaccgctttggtgtccctcacgtgttcaaacacaatcctgaccctaactgtcgcatggcgaaccgccacactgatacttgcgggtgtgagtctcctgcctgtttgccaaagctcgtccatgcggaagactgattggttgccaatgaccgtggctgccatgggcgtaccccctctgcccttatttatcttctctctcaaggacacgctgaaacgtagaagctggccacttaatgagggggtaatggcagtgggactggtttcaattttggccagttccctcctgaggaacgatgtgcctatggctggccccctagtcgccggtgggctgcttatcgcctgttacgtgattacaggaacctctgcggacctcactgtagagaacgctgccgacgtgacatgggaagaggaagcagagcagaccggcgtcagccataatctgatgatcactgttgatgacgatggcacaatgcgcataaaggacgatgaaaccgagaacattttgacggtgttactgaaaactgccctcctgatcgtgtccgggatctttccatactcaattccggctacccttctggtctggcacacatggcagaagcagacccaacggagcggagtgttgtgggacgttcctagtcccccagagacacagaaagccgaactagaggaaggtgtatatagaataaagcagcagggcatcttcgggaaaactcaagtgggagtcggcgtgcagaaggagggtgtttttcataccatgtggcacgtgacgagaggggcagtcctgacacacaatggaaagcgactcgagcccaactgggcttctgtgaaaaaggatctgatttcctacggcggcgggtggcgccttagcgcccagtggcaacggggagaagaggtacaggtcatcgcggtggaacctggtaaaaatccaaagaacttccagactatgcccggcacctttcagacaaccactggggagattggagccatcgcattagacttcaaacctggcacctcgggttcaccgataatcaatagagaagggaaggttgtgggactgtatggcaacggcgtcgtgacaaagaatgggggatacgtttctggtattgctcaaacgaacgccgagccagatggccccactcctgagctcgaagaggaaatgttcaaaaagaggaatttgaccatcatggacctgcatccagggagtggaaaaacacgtaagtatctccccgctattgtgcgcgaggcaatcaaacggagactgaggacccttatactggcccctactcgagtcgtggccgctgaaatggaggaggcgttgaagggcctaccgattcggtaccagacaaccgcaacgaagtccgaacacactggtcgcgagatcgtagatctgatgtgccatgccacatttaccatgagactcttaagccccgtgagggttccaaactataatctgatcattatggacgaagctcacttcaccgatcctgcctctatcgcagcccgggggtacataagcactcgagtcggaatgggcgaggctgcggccatttttatgacagcaacacccccaggcacagctgacgccttccctcagtccaacgcacccatccaggacgaagagagagatattccagagcgctcatggaatagtgggaacgaatggatcactgactttgccggaaaaacggtgtggttcgtgccgagcataaaggctggtaacgatattgccaattgtcttaggaaaaacggcaagaaagtcatccaactgtctcgtaagacctttgacacagagtaccagaagactaaactcaatgattgggacttcgtagtgaccacagatatctccgaaatgggggcgaactttaaggcagaccgggttattgatcctagaaggtgcttgaaacccgtgatcctgaccgacggaccagagcgcgtcattctcgccggccccatacctgtgactgctgcctcagctgcacagcgaagaggtcgggttgggaggaatccacagaaggagaacgatcaatatatcttcacgggccagcccctgaataacgacgaagaccatgcccactggaccgaggctaaaatgcttctagataatattaacacacctgaaggaatcatcccggccctgtttgagccagaacgcgagaagagtgcagcgattgacggcgagtaccgtttgaagggggaaagcagaaaaactttcgtggagttaatgcggaggggagatctgcccgtctggctcgcccacaaggtggcttccgaaggtataaaatataccgaccgcaagtggtgcttcgatggccagcgaaataaccagatcctggaggaaaatatggacgtagagatttggacaaaagagggggaaaagaagaaacttagacctcggtggctggatgccaggacctactctgaccccctcgcattgaaagagtttaaagatttcgctgccggacgcaagtcgatcgcactggacctagtgactgaaattggcagagttccaagccatctggcccacaggacacggaacgctctcgataatcttgtcatgctgcatacgtcagagcacggtgggcgtgcgtatcgccacgccgtggaagagttacctgagaccatggaaactttgctgctcctgggccttatgatcctgctcacaggaggcgcaatgttgtttctgatatccgggaaaggaatcggtaagaccagtattggcttaatctgtgtgattgcttctagcgggatgctatggatggccgagatccccctgcaatggatagcctccgcaattgtcctcgagttctttatgatggttcttctgatcccagagcctgagaaacagcgaaccccgcaggacaaccaattggcttacgtggtaattggaatcctgacactcgccgcgataatcgctgccaatgaaatgggcctgcttgagactacgaagagagatctcggtatgtcaaaggaacccggggtggtctctccaaccagctatctggacgtggacttgcatcctgcaagtgcctggacactgtacgctgttgcaactaccgtgattacacccatgttaaggcacaccatcgagaactccactgccaacgtcagcctagcggctattgccaatcaggcagtagtgctgatgggcctcgataaaggatggccaatctctaagatggaccttggcgttcctctgttggccctggggtgctactcacaggtgaaccccctcacgctgacagctgccgtccttttactgataacccattatgcaattatcggaccgggcctccaggctaaagccactcgggaagcgcaaaagcgcaccgccgcaggtatcatgaaaaatccaacagtggatgggattatgactatcgacttggatcctgtcatatacgactccaagttcgagaagcagctgggacaggtgatgctactggttctctgtgctgtgcagcttctgttgatgagaaccagttgggccctgtgcgaggcactcacactggctacgggccccattaccactttatgggaaggtagcccaggcaaattttggaacacaaccatcgccgtatcgatggccaatattttcagggggtcttatcttgcgggagctggcctggcattttccatcatgaaaagcgtggggactggaaaacggggcacaggttcacaaggggagaccctcggagaaaagtggaaaaagaagctaaaccagctgagtcgaaaagagttcgatttgtacaagaaatctggcataacggaagtcgacagaaccgaggccaaggagggtctgaaacgcggcgaaatcacacaccatgctgtttccagggggagcgccaagctccagtggtttgtggagcggaatatggtcattcccgaaggacgtgtgatcgatcttggctgtgggagaggaggctggtcatattactgcgcaggtctgaaaaaggtaactgaggtgagggggtataccaagggaggccctggccacgaagaaccggttcccatgagtacatacgggtggaacattgtgaaattgatgagcggaaaggacgtcttctacctgccacctgagaaatgtgatactctcttatgcgacatcggtgaatcctctcccagccctaccgtggaggaatcccgcacaattcgggtcctgaagatggtggagccatggcttaaaaataaccagttttgtatcaaggttctgaatccctatatgcctaccgtaatagagcacctagaacgactccaaagaaagcatggcgggatgctggtgaggaacccattgtcacgcaattctactcacgagatgtactggattagtaacggaacgggcaatatcgtctcgagcgtgaacatggtttcccggctgctccttaacagattcacaatgacccatcgtaggcccactatcgaaaaagatgtggacctgggtgccgggacccggcacgtcaatgctgagccggaaacacctaacatggacgtgattggagagcgcataaagcgaatcaaagaggaacacaattctacgtggcattatgatgacgagaacccatacaagacctgggcgtatcacggctcatacgaagtaaaagccactggcagcgcatccagtatgattaatggggtggttaagttactgacaaagccctgggatgtcgtgcctatggtgacccagatggctatgactgacacaaccccattcggacagcaaagagtctttaaagagaaggttgatacaaggactccccggtctatgccgggtacccgcaaagtgatgggcatcacggccgaatggttgtggagaaccctcgggaggaacaagcgacctcggctgtgcacacgtgaggagttcactaaaaaggtaagaaccaatgcagccatgggagctgtgtttacagaagagaaccagtgggacagcgccaaggcggcagtcgaagatgaggagttctggaagctagtggaccgcgagagggagcttcataagctgggcaaatgtggttcatgcgtttataatatgatggggaagcgggagaagaagctcggagagtttggcaaagccaagggctccagagctatttggtacatgtggctgggggcccgctacttggagttcgaggcactgggatttctcaacgaggatcactggttcagtagggacaatagctattctggtgtggaaggcgaggggcttcataagctgggatacatcttacgagatatatccaaaatccccggcggtgctatgtatgccgacgacactgctgggtgggatacccggattacggaagacgatctgcacaacgaggaaaagatcacacagcagatggacccagagcacagacaattggccaatgcaatttttaaactcacctaccagaacaaggtcgtgaaagtacagaggcctactcccacaggaaccgttatggatatcatatcacgcaaggaccagcgtggcagcggccaagtggggacttatggactgaataccttcacaaacatggaggtccagctagtgcggcagatggaaggtgagggcgtgctttcgaaggcggatctggaaaacccacatctccccgagaaaaagattacgcagtggctggaaaccaaaggggtcgagagattgaagaggatggccatctctggagacgattgcgttgtgaaacctatcgacgatcgctttgctaatgccttactggcactcaacgacatgggcaaggtacgaaaggatattccacaatggcagccgagtaaaggttggcacgactggcaacaggtgcccttctgttcccatcactttcacgagcttataatgaaggacgggcggaaactggtcgtgccttgcagaccacaagatgaactaatcggaagggctcgcattagccagggcgccggctggtcactgagagagactgcatgtctcgggaaggcctacgcgcagatgtggtccttgatgtatttccatcggagggacctgcgtcttgcttctaatgccatctgcagcgcagttcccgtgcactgggtccctacaagtcgaaccacttggtccattcatgcccaccatcaatggatgacaaccgaagatatgctgacggtgtggaaccgcgtatggatcgaggacaatccatggatggaaaacaaaacacccgttaccacttgggagaatgtgccttacctcggaaagagagaggatcagtggtgtggtagcttaataggcctgacctctcgggctacatgggcccagaacatcccgactgcaattcagcaagtcaggtcattgatcgggaatgaagagttcctggactacatgccaagtatgaagcgctttagaaaagaagaggagtccgaaggagctatttggtga

SEQ ID NO: 15253 - RNA, 9873 nt, synthetic construct
  misc_feature 1..9873: note = derived and/or modified CDS sequence (opt3) from DENV-3__GQ199889__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgattcttgtcaccccatcgatggccatgcgctgtgtgggcgtagggaacagagactttgttgaaggattgtcaggtgcgacatgggtggatgtcgtgctggagcacggcgggtgcgtgaccacgatggcaaagaataaacccactctagacatcgagctccagaagacagaagccacccaactggctactcttaggaaactgtgtattgagggaaagatcacaaacataaccacggatagccggtgccctacccagggcgaagccattttgccagaggaacaggaccagaattatgtctgtaaacacacatacgttgatcgcggttgggggaacggatgcggcctcttcggcaaggggagtctggtgacttgcgcaaagtttcaatgtttagagtccatcgagggaaaagtagtgcagtatgaaaatctgaagtacaccgtcattatcacagtgcatactggtgaccagcaccaggttggcaacgagacccaaggggtgacagctgaaatcaccccccaggcctctactacggaggcgattctccctgaatatggaacacttggcctggagtgcagcccacgaaccggtttggacttcaatgagatgatactactgactatgaaaaacaaggcctggatggtccatagacagtggtttttcgatctcccgctgccctggacctccggggcaacaaccgaaactcctacatggaataggaaagagcttctggtgacgtttaagaacgctcacgccaaaaagcaagaagtagttgtgttgggctcacaggagggagctatgcacaccgccctcactggcgcaacagaaatccagaatagtgggggaaccagcattttcgccggtcatctgaagtgtcggttaaaaatggacaagctggagctaaaaggcatgtcttacgctatgtgcacaaacacttttgtcctcaagaaagaggtgtccgaaacccagcacgggacgatcctgataaaggtcgagtacaagggagaagatgcgccatgtaaaattcccttctcaaccgaggacggccaaggtaaggcacataacgggcgtcttatcacagccaatcctgtggttactaaaaaggaggaaccagtgaacatcgaggctgaacccccgttcggcgagagcaatattgtaatcggaattggcgataacgccttgaaaataaattggtataagaaggggagttctatcggaaaaatgtttgaagcaaccgcccgcggtgctagaaggatggccattctgggcgacacagcatgggatttcgggtccgtcggaggcgtgctcaacagcctgggtaagatggttcaccagatctttgggtcggcgtacactgctcttttctctggcgtgtcctgggtcatgaaaatcggaattggcgtgctgttgacctggatagggctcaattcaaagaacacgagtatgagcttttcctgcatcgccattggaatcattacactgtatttaggcgcagtagtgcaggccgacaccggttgtgttatcaattggaaagggaaggagctgaagtgcggatctggcatattcgtcactaacgaggtgcatacatggaccgaacagtacaaatttcaagctgatagccctaagcggctagccactgcaatcgctggtgcctgggagaatggcgtgtgtgggattcgatcaaccacacgcatggaaaacctcctgtggaaacagatcgcgaatgagcttaactatattttgtgggaaaataacatcaagctgacggtcgttgtgggagacaccataggcgtgctcgagcaggggaaaagaactctgacaccccagccaatggagttaaagtacagttggaaaacctggggaaaggccaagattgtaacagctgaaatccaaaactccagcttcattatcgatggccctaatactcccgagtgcccatctgcatcaagggcctggaacgtctgggaagtggaggactatggttttggggttttcaccacgaatatatggctgaaacttcgggaagtgtacacacagttgtgtgaccaccgcctcatgagtgctgccgtcaaggatgagagagcagtgcacgcggacatgggatactggatcgagagccagaaaaacggctcctggaagctggaaaaagcctcttttattgaggttaagacctgcacttggcccaagtcgcataccctatggagcaatggtgtgctggaatccgatatgatcattcctaaatcactcgctggcccaatcagtcagcacaactataggccggggtaccatacacaaactgccggaccctggcacctgggcaagcttgagttggacttcaattattgcgaggggaccacagtagtcataacggaaaactgtggaacccgtggcccttctctgcggactacaaccgtgagcggtaaattaattcacgagtggtgctgtcgatcctgcactctcccacccctgagatacatgggggaagatggatgttggtatggcatggagatcaggcctatctcagaaaaggaggagaatatggtgaaaagccttgcatctgctggttccggcaaggtcgacaactttacaatgggggttctgtgcttggccattctcttcgaagaggtgatgcgcggaaagttcggcaaaaagcatatgatcgcaggggtatttttcacctttgtgctgctactgagtggacagattacgtggcgggatatggcccacactctcataatgatcggcagcaatgcttctgacagaatgggtatgggggtcacctacctggcgcttattgccacattcaaaatccagccatttttggcactgggattctttttaaggaagctcacctcccgcgaaaacctgcttctgggcgtgggcctagctatggccactacactccaactgcccgaggatattgaacagatggccaatgggatcgctttgggactgatggcattaaaactcataacccagttcgagacatatcagctgtggactgcccttatctcactgacctgtagtaacacgatgtttacattgaccgttgcgtggcgaactgctaccctcattctggccggtgtgagcctactgccggtctgccaatcgtcctctatgcggaagacagactggcttcctatgactgtggcagccatgggcgttccacccctccctctgttcatctttagcttgaaggataccctgaaacgtagatcatggcccttaaatgagggggtgatggctgtcggactcgtaagtattctggcatcctctcttctgaggaacgacgtgccaatggccggccctttggttgcgggtgggatgctcatcgcttgttacgtgataacgggaacaagcgccgatctgaccgtcgaaaaggcagccgacgtgacttgggaggaagaggctgaacagacaggcgtatcccataacctaatgattaccgtggacgatgacggcactatgcgcatcaaagatgacgagacagagaatatcctgaccgtccttctcaagacggccctgttgattgtttcagggatattcccctacagcatcccagcaactttactggtgtggcacacctggcagaaacagacacaacggagtggagtgctctgggatgtcccgtctcctcccgaaacccagaaggctgagctggaagagggtgtgtatagaattaaacagcagggcatccttgggaagacacaagttggagtaggcgtgcagaaggagggtgtctttcatactatgtggcacgtgaccaggggggccgttctgacgcacaacggaaaacgattggaaccaaattgggcgtccgtgaagaaagacctaattagctacggcggcgggtggcgcctgtcggcccagtggcaaaagggagaggaagtccaggtgatcgcagtagagcccggtaaaaaccctaagaatttccagacaatgccaggcactttccagaccacaaccggggaaataggagctatcgccctcgattttaagcccggcacttcaggttctcctattatcaaccgggaggggaaagtcgtgggactgtatggcaatggcgttgtgaccaagaacgggggatacgtcagtggtattgctcaaacatccgcagagccggacggcccaacgcccgaacttgaggaagagatgttcagaaaaaggaatttaactatcatggatctgcatcctgggagcggaaagacccgtaaatatctcccagccatagtgcgcgaagccattaagcggagattgaggacactgatcctcgctcccacccgagttgtggcggcagagatggaggaagccctgaagggccttcctatccggtaccagactacagctaccaaatctgagcacacgggtcgcgaaattgtcgacctgatgtgccatgccacttttacaatgagattgctaagcccggtgagggtacccaactataatctgatcataatggatgaggcacacttcaccgacccagcctccattgctgcgcgggggtacatctcaacccgagtgggaatgggcgaagccgcagctatttttatgactgccacacctcccggcaccgcagatgccttcccacagagtaacgctcctatccaggacgaggagagagacatacccgaacgcagctggaattctgggaacgagtggattacagattttgccggaaagactgtttggttcgtcccatccatcaaagcgggtaatgacatcgcaaactgtctcaggaagaacggcaaaaaggtgattcaattatcacgtaagacgtttgataccgaataccagaaaacaaagctgaatgactgggatttcgtggtcactaccgacatcagtgagatgggggccaactttaaagctgatcgggtaattgacccgagaaggtgccttaagcctgtgatactgacagatggacccgagcgcgttatcctcgccggcccaatgcccgtgaccgctgcaagcgccgctcagcgaagaggtcgggtcgggaggaatcctcagaaagaaaacgaccaatatattttcactggccagccattgaataacgatgaggaccatgcccactggacggaagcaaagatgctgctcgacaatatcaacacccccgagggaatcattcctgcgctgttcgaaccggagcgcgagaagtccgccgctatagatggcgaataccgtcttaaaggggagtctagaaagacatttgtggaactaatgcggaggggagacctgccagtttggttggcccacaaagtggcatcggagggtatcaagtatactgatcgcaaatggtgcttcgacggccagcgaaataaccagattttagaagagaatatggatgtcgagatctggaccaaggaaggggagaaaaagaagctgagaccccggtggctcgacgctaggacatacagcgatcctctggcccttaaagaatttaaggacttcgcagccggacgcaaatcaattgctctggatctcgtgaccgagatcggcagagtaccctcccatttggcgcacaggactcggaacgccctggacaatctagtgatgctgcatacaagtgaacacggtgggcgtgcatatcgccacgctgttgaggagctcccagaaacgatggagacccttctgttattgggcctgatgatactcctgactggaggcgccatgctttttctgatctctgggaagggaattggtaaaacaagcatcggcctcatttgtgtcatcgcctcctcagggatgttgtggatggcagatgtgcctctgcaatggatagcttctgccattgtgttagaattctttatgatggtcctactgatccccgagccagagaagcagcgaacccctcaggacaaccaactcgcgtacgttgtgattggaatccttaccctggctgccataatcgcagccaatgaaatgggcttgctggagacaactaagagagatctcggtatgagcaaagaaccgggggtagtgagtcccacgtcctatctggacgtcgaccttcatccagctagcgcatggaccctctacgccgtggcgacaactgttattacccctatgctgaggcacacaatcgagaactctaccgctaatgtgtcattggccgcaattgccaaccaggctgtcgtactgatgggcttagataagggatggcccatctccaaaatggacctaggcgtgccactgctcgcccttgggtgctacagtcaggttaaccctctgactttgacggcagctgtgctgctcctgataacacattatgccattatcggacccggccttcaggcgaaggccacccgggaagcacaaaaacgcactgctgccggtatcatgaagaatccgaccgtcgatgggattatgacaatcgacttagatccagtgatatacgacagcaagttcgagaaacagctgggacaggtcatgctcttggtgctgtgtgcagttcagctactgctcatgagaacttcgtgggctctttgcgaggccctgaccttggccacaggccctattacgaccctgtgggaaggttctcccggcaagttttggaacactacaatcgcggtgtccatggctaatattttcagggggagctatctcgcaggagccggcctggctttttcaatcatgaaaagtgtagggaccggaaagcggggcactggttctcaaggggagacattaggagaaaaatggaagaagaaacttaaccagctgtcccgaaaggagttcgatctctacaaaaagagcggcataaccgaagtggacagaacggaggccaaagagggtctaaagcgcggcgaaaccacaaggcacgcagtctcacgggggagtgccaaactgcagtggtttgttgagcgtaatatggtgatcccagaaggaagagtcattgatttgggctgtgggaggggaggctggagctattactgcgctggtctgaagaaggtgactgaggtacgcgggtataccaaaggaggccccggccatgaagagcctgtgccgatgtccacatacgggtggaacatcgttaagctcatgtctggaaaagacgtgttctaccttcccccagagaagtgtgatactctgttgtgcgacattggtgaaagctccccttcacccaccgtcgaggaatctcggacaatccgagtgctgaaaatggtcgagccttggctcaagaataaccagttctgtattaaggtgttaaatccatatatgcccaccgttatcgagcacctggaaagacttcaaaggaaacacggcgggatgctggtacgcaaccctctaagtcggaattcgactcatgagatgtactggataagcaacggaacgggcaatattgtgtcctctgtcaacatggtgtcaagactcctgttgaatcgttttacaatgacccacaggcggccaactatcgaacgcgatgttgacctgggtgcggggacccgacatgtgaacgccgagcccgaaatcccgaacatggacgtcattggagagagaataaagaggatcaaagaggaacacaatagcacatggcactatgatgacgagaacccttacaagacgtgggcatatcatggctcctacgaagtgaaagctaccggcagtgcctctagcatgattaatggggtagtgaagctccttactaagccatgggatgttgtccccatggtgacacagatggcaatgaccgacactacacctttcggacagcaacgggtgtttaaagagaaggtcgatacccgcacaccaagacccatgccgggtactaggaaagttatggaaatcaccgccgagtggctgtggcgaacgttaggccggaacaagcgtcctagactgtgcacccgcgaggaattcacaaaaaaggtgaggactaatgctgccatgggggcggtatttaccgaggaaaaccagtgggactcagcaaaggccgctgtggaggatgaagagttctggaaattggtcgaccgggagagagaactccacaagctgggaaaatgtggctcctgcgtgtataatatgatgggtaagcgcgagaaaaagctaggggaatttggaaaagccaagggcagtagggcaatttggtacatgtggcttggcgctcgatacctggagttcgaggccctcgggtttctgaacgaagatcattggttcagccgggagaattcttattccggagttgaaggtgagggcttgcacaagctggggtacatcctcagagacatatcaaaaatccccggaggcgctatgtatgccgatgacacagcaggttgggacactaggattaccgaagatgaccttcataacgaggagaagatcacgcagcagatggatccagaacaccgccaactggcgaatgccatttttaaattaacataccagaacaaggtggtcaaagtgcagcgtcctacccccactgggacagtaatggacatcataagccggaaggatcagagaggatcgggccaagttggcacctatgggctgaatactttcaccaacatggaggctcagttggtgaggcagatggaaggagagggtgtcctctctaaggccgacctggaaaatccacacctacttgagaaaaagattacacagtggctggagacgaaaggcgtggaacgcctcaagcgaatggcaatcagtggggatgactgcgtggtcaaacccatcgatgaccggtttgctaacgccctgttggcattaaacgatatgggaaaggttagaaaggacattcctcaatggcagccatccaaaggctggcatgattggcagcaggtgccgttctgtagccaccatttccacgagctgataatgaaggacggtaggaaactcgtagtgccctgccgccctcaagacgaacttatcgggagagcccggatttcacagggagcgggctggtccctgagggagaccgcttgtctaggcaaggcctacgcacagatgtggtctctgatgtattttcaccgtcgagatctccgcttggccagcaatgctatctgcagtgccgtcccagtgcattgggttcccacttccagaacaacctggagcattcacgcacatcaccaatggatgactacagaagacatgctgaccgtgtggaaccgggtctggatcgaggataatccttggatggaggacaaaacgccagtgacaacctgggaaaacgtaccctaccttgggaagagggaggatcagtggtgtggatctctgataggtctcacttcacgcgctacctgggcccagaatatccctacagcgattcagcaagttagaagtttaatcggcaacgaagagttcctggactacatgccgtccatgaagcggtttaggaaagaggaagagagcgaaggggctatttggtga

SEQ ID NO: 15254 - RNA, 9873 nt, synthetic construct
  misc_feature 1..9873: note = derived and/or modified CDS sequence (opt3) from DENV-3__FJ882571__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacaccattggcgtactcgagcaggggaaaagaactctgacaccacagcctatggagttaaagtactcatggaaaacctggggaaaggcgaagatcgtcacagccgaaactcaaaacagttccttcataattgatggccccaataccccagagtgccccagcgcttctagggcatggaacgtgtgggaagttgaggactatggttttggggtgttcacgacaaatatctggctgaaacttcgggacgtctacacccagttgtgtgatcaccgcctcatgtcagccgctgtgaaggacgaaagagccgttcacgcagatatgggatactggattgagagtcagaaaaacggcagctggaagctggagaaagcgtccctaatcgaagtgaagacttgcacctggcctaagtctcatacactgtggtcgaatggtgtactcgagagcgacatgataatcccaaaatccctggccggcccgatttcacagcacaactataggcccgggtaccatactcaaaccgctggaccttggcaccttggcaagttggaactggattttaattattgcgaggggacaacggtcgtgatcaccgagaactgtggaactcgtggcccaagtttacggacaaccactgtgtctggtaaactcattcacgaatggtgctgtcgaagctgcacactgccccctcttagatacatgggggaggacggatgttggtatggcatggaaatcaggccaatatccgagaaggaagagaatatggtcaaatcactggttagcgccggttctggcaaggtggataacttcaccatgggggtattgtgcctcgcaattctgtttgaggaagtgatgcgcggaaagttcggcaaaaagcatatgatcgctggggtcctattcacgtttgtgctgctcctgtccggacagatcacttggcgggacatggcccacacccttattatgatcggcagtaatgcaagcgatagaatgggtatgggggttacatacttggccctgattgctaccttcaaaatacagccctttttagcgctcggattctttctgaggaagcttacttctcgcgagaacctgctactcggcgtgggcctggccatggcaacaaccttgcaactgccggaagacatcgagcagatggctaatgggattgccttaggactcatggccctgaaacttatcacacagttcgaaacttatcagctgtggaccgctttggtctccctcacgtgttcaaacacaattctgaccctaactgtggcatggcgaaccgccacactgatccttgcgggtgttagtctcctgcctgtgtgccaaagctcgtccatgcggaagactgattggttgccaatgaccgtcgctgccatgggcgtaccccctctgcccttatttatattctctctcaaggacacgctgaaacgtagaagctggccacttaatgagggggtgatggcagttggactggtgtcaatcttggccagttccctcctgaggaacgatgtccctatggctggccccctagtggcaggtgggctgcttattgcctgttacgtaatcacaggaacctctgcggacctcattgtggagaaggctgccgacgtcacttgggaagaggaagcagagcagacaggcgttagccataacctgatgatcaccgtggatgacgatggcactatgcgcataaaagacgatgaaacagagaatattttgaccgtgttactgaagacggccctcctgatcgtctccgggatctttccatactcaattccggctactcttctggtgtggcacacctggcagaaacagacacaacggagcggagttttgtgggacgtacctagtcccccagagacccagaaggccgaactagaggaaggtgtgtatagaataaaacagcagggcatcctggggaagacacaagtcggagtgggcgttcagaaggagggtgtgttccatactatgtggcacgtcaccaggggggcagtgctcacgcacaacggaaaacgactggagcccaattgggcttctgtaaagaaagatcttatttcctacggcggcgggtggcgcttaagcgcccagtggcaaaagggagaagaggtccaggtgatcgcggttgaacctggtaaaaacccaaagaattttcagacaatgcccggcactttccagaccacaaccggggagattggagccatcgcactggactttaagcctggcacttcgggttcaccgataatcaaccgggaagggaaagtggtcggactctatggcaatggcgtggttaccaagaacgggggatacgtgtctggtattgctcaaacaaatgccgagccagatggccccacgcctgagttggaagaggaaatgttcaaaaagagaaacctgactatcatggacctccatccagggagtggaaaaaccaggaagtatctgcccgctattgtccgtgaggcaatcaagcgccggcttagaacactgatattggcccctaccagggtggtagccgctgaaatggaggaggcgctaaaaggcctgccgattcgataccagactacagcaaccaagtccgaacacacgggtcgggagatcgtggatctcatgtgccatgccactttcacaatgcgcttactgagccccgttagagtcccaaattataaccttatcattatggacgaagctcactttaccgatcctgcctctatcgcagccagggggtacataagcacccgggtgggaatgggcgaggctgcggccattttcatgactgcaacacccccaggcaccgctgacgcctttcctcagtccaatgcacccatccaggacgaagagcgagatattccagagagatcatggaacagtgggaatgaatggatcacagacttcgccggaaaaactgtgtggtttgtcccgagcataaaggctggtaacgatattgccaactgtctgcgcaaaaatggcaagaaggtaatccaactctctaggaaaacgttcgacaccgagtaccagaagacaaaattgaacgattgggactttgtggttactaccgatatctccgaaatgggggcgaatttcaaggcagaccgtgtgattgatcctcggagatgcctgaaacccgtcatcctcacagacggaccagagagggtgattctggccggccccatgcctgttaccgctgcctcagctgcacagcgccgaggtagagtggggcggaacccacagaaggagaatgatcaatatatatttactggccagccccttaacaatgacgaagaccatgcccactggacggaggctaagatgctactggataacatcaatacccctgaaggaattatcccggccttgttcgagccagaaagggagaaaagtgcagcgatcgacggcgagtaccgcttaaagggggaaagccgtaaaacatttgtcgagctgatgagacggggagatctccccgtgtggctggcccacaaggtagcttccgaaggtattaaatatactgacaggaagtggtgcttcgatggccagcgcaacaatcagatacttgaggaaaacatggacgtggagatctggaccaaagagggggaaaagaagaaactgcgacctagatggctcgatgcccggacatactctgaccccttggcactgaaggagttcaaagattttgctgccggaaggaagtcgattgcactagacctggttaccgaaatcggccgcgtcccaagccatctcgcccacagaactaggaatgctcttgataacctggtgatgttacatacatcagagcacggtgggcgggcgtatcgtcacgccgtggaagagttgcctgagacgatggaaaccctgctcctgcttggcctgatgattctcttgactggaggcgcaatgctgttcttaatctccgggaaaggaataggtaagacaagtatcggcctaatttgtgtcatcgcttctagcgggatgctgtggatggccgagattcccctccaatggatcgcctccgcaatagttcttgaatttttcatgatggtgctgttgattccagagcctgagaagcagcgcaccccgcaggacaatcaactggcttacgtagtgatcggaattctcaccctggccgcgatcatagctgccaacgaaatgggccttctcgagacaactaaacgagatctgggtatgtcaaaggaacccggggtcgtgtctccaacgagctatttggacgttgacctgcatcctgcaagtgcctggaccttatacgctgtggcaacaactgtcatcacccccatgctaagacacacaattgagaattccaccgccaacgtaagcctggcggctatcgccaaccaggcagtggttctcatgggccttgataaaggatggccaatttctaagatggacctgggcgtgcctttgctggccctcgggtgctactcacaggtcaatcccctgactcttacggctgccgtgttactgctcatcacacattatgcaataattggaccgggcttgcaggctaaagccaccagggaagcgcaaaagcggactgccgcaggtatcatgaagaacccaaccgtcgatgggatcatgacaattgacctggatcctgtgatctacgactccaaatttgagaagcagctaggacaggttatgctgctcgtgctttgtgctgtacagctgttgctgatgcgcactagttgggccctctgcgaggcactgaccttagctacaggccccataacgaccctttgggaaggtagcccaggcaaattctggaatactacaattgccgtgtcgatggccaacatctttagagggtcttatctggcgggagctggcctcgcattctccattatgaagagcgtcgggaccggaaaaaggggcactggttcacaaggggagacactaggagaaaagtggaagaaaaagctgaatcagttgagtcggaaagagtttgatctgtacaagaaatctggcatcaccgaagttgaccgaacggaggccaaggagggtctcaaaagaggcgaaataacccaccatgctgtgtcccgcgggagcgccaagcttcagtggttcgtcgagaggaacatggtgatccccgaaggacgggtaattgatctgggctgtgggcgtggaggctggtcatattactgcgcaggtttgaagaaagtgacagaggttagagggtatactaagggaggccctggccacgaagagccggtgcccatgagtacctacgggtggaatatcgtcaaactgatgagcggaaaggacgtgttttacctcccacctgagaaatgtgatacattactgtgcgacattggtgaatcctctcccagccctactgtcgaggaatccaggaccatccgcgtgcttaagatggttgagccatggctgaagaacaatcagttctgtattaaagtactaaacccctatatgcctacagtgatcgagcacctcgaacggctgcaacgaaagcatggcgggatgttggtcagaaatccactgtcaaggaactctacccacgagatgtactggataagtaatggaactggcaacattgtgtcgagcgttaatatggtgtcccgcctccttctgaaccggtttacgatgacacatagacgtcccaccatcgaaaaagatgtcgacttaggtgccgggactaggcacgtgaacgctgagccggaaacccctaatatggacgtaatcggagagcggattaagcgcataaaagaggaacacaactctacatggcattatgatgacgagaatccatacaagacgtgggcgtatcacggctcatacgaagtgaaggccaccggcagcgcatccagtatgatcaacggggttgtcaaactgttgactaagccctgggatgtggtgcctatggtcacacagatggctatgaccgacactacaccattcggacagcaacgagttttcaaagagaaggtggataccagaacacccaggccgatgcctggtactcggaaagtaatgggcattaccgccgaatggctctggcgcacgctggggagaaataagaggccccgactatgcacccgggaggagtttacaaagaaagtgcgtactaacgcagccatgggagctgtcttcaccgaagagaatcagtgggactctgccaaggcggcagtggaagatgaggaattttggaaacttgttgacagagagcgcgagctgcataagctcggcaaatgtggtagctgcgtgtataacatgatggggaagagggaaaaaaagctgggagagttcggcaaggccaaaggctcacgggctatctggtacatgtggttgggggccagatacctggaatttgaggcactcggattccttaatgaggatcactggttttcccgcgacaacagttatagcggtgtcgaaggcgaggggctgcataagttaggatacattctgagggatatctctaaaataccaggcggtgctatgtatgccgacgacacagctgggtgggatactcgaatcaccgaagacgatttgcacaatgaggaaaagattacgcagcagatggaccctgagcaccggcaactcgccaacgcaatcttcaaactgacataccagaataaggtggtaaaggttcagagacccaccccaactggaacagtgatggatattatctccaggaaagaccagcgcggctcaggccaagtcgggacctatggactaaacacttttaccaatatggaggtgcagcttgtgcgtcagatggaaggtgagggcgtcctgagcaaggcggatctcgaaaacccccatctgcctgagaaaaagataacacagtggttggaaacgaaaggggttgagcggttaaagagaatggccatttcgggagacgattgcgtggtaaagccaatcgacgataggttcgctaacgccctgctcgcacttaatgacatgggcaaagtgcgcaaggatatcccgcaatggcagccctctaaaggtatgcacgactggcagcaggtccctttttgtagtcatcacttccacgagctgattatgaaggacgggcgaaaactagtggttccatgccggccccaagatgaactgataggaagagctaggatctcccagggcgccggctggagcctccgcgagaccgcatgtttggggaaggcctacgcgcagatgtggtcactgatgtattttcatagacgggaccttaggctggcttccaacgccatttgctctgcagtgcctgtccactgggtgccaactagccgtacaacctggagtatccatgcccaccatcaatggatgactacagaagatatgctcgctgtatggaatcgagtttggattgaggacaacccctggatggaagataagacccctgtgacgacatgggaggacgtcccgtacttaggaaaacgcgaggatcagtggtgtggttccctgatcggcttgaccagcagagccacttgggcacagaatatactgaccgctatccagcaagtgcggtctctcattgggaacgaagagttccttgactacatgccatcaatgaagaggttccgcaaagaagaggagagtgaaggagccatctggtga

SEQ ID NO: 15255 - RNA, 9873 nt, synthetic construct
  misc_feature 1..9873: note = derived and/or modified CDS sequence (opt3) from DENV-3__FJ882572__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagtccatagagggaaaagtggtccagtatgaaaatctgaagtacacagtgattatcactgttcataccggtgaccagcaccaggtgggcaacgagacacaaggggtcaccgcagaaattactccccaggcttctacgacagaggccatcctccctgaatatggaacccttggcctggagtgcagcccacgaactggtttggacttcaatgagatgatcctactgaccatgaaaaacaaggcgtggatggtgcatagacagtggtttttcgatctcccgctgccctggacatccggggccaccactgaaacacctacgtggaataggaaagagcttctggtaacctttaagaacgcacacgctaaaaagcaagaagttgtggtcttgggctcacaggagggagccatgcacactgctctcacaggcgccaccgaaattcagaatagtgggggaacaagcatattcgcaggtcatctgaagtgtcggttaaaaatggacaagctggagctaaaaggcatgtcttacgccatgtgcactaacacctttgtgctcaagaaagaggtctccgaaacgcagcacgggaccatcctgattaaggtggagtacaagggagaagatgctccatgtaaaatccccttctcaacagaggacggccaaggtaaggcgcataacgggcgtcttataactgcaaatcctgttgtgaccaaaaaggaggaaccagtaaacattgaggccgaacccccgttcggcgagagcaatatcgtcatcggaattggcgataacgctttgaaaatcaattggtataagaaggggagttctattggaaaaatgtttgaagccacagcacgcggtgccagaaggatggctatactgggcgacactgcctgggatttcgggtccgtgggaggcgttctcaacagcctgggtaagatggtgcaccagatctttgggtcggcatacaccgcgcttttctctggcgtctcctgggtgatgaaaattggaatcggcgtactgttgacgtggatcgggctcaattcaaagaacacaagtatgagcttttcctgcattgctataggaatcattaccctgtatttaggcgccgtggttcaggcagacactggttgtgtcatcaattggaaagggaaggagctgaagtgcggatctggcattttcgtgacaaacgaggtgcatacctggactgaacagtacaaatttcaagccgatagccctaagcggctagctaccgccatcgcaggtgcttgggagaatggcgtctgtgggatacgatcaacaacgcgcatggaaaacctcctgtggaaacagatcgccaatgagcttaactatattttgtgggaaaataacatcaagctgaccgttgtggtgggagacactattggcgtactcgagcaggggaaaagaacactgaccccccagccaatggagttaaagtacagttggaaaacatggggaaaggcgaagatcgtcactgccgaaatacaaaactccagcttcattatcgatggccctaatacccccgagtgcccatctgcttcaagggcatggaacgtgtgggaagttgaggactatggttttggggtgttcacgacaaatatttggctgaaacttcgggaagtctacacccagttgtgtgaccaccgcctcatgagtgccgctgtgaaggatgagagagccgttcacgcagacatgggatactggatcgagagccagaaaaacggctcctggaagctggaaaaagcgtcttttatagaggtgaagacttgcacctggcccaagtcgcatacactatggagcaatggtgtactggaatccgatatgatcattcctaaatcactcgccggcccaatcagtcagcacaactataggccggggtaccatactcaaaccgctggaccctggcacctgggcaagcttgagttggacttcaattattgcgaggggacaacggtcgtgattaccgaaaactgtggaactcgtggcccttctctgcggacaaccactgtgagcggtaaattaatccacgagtggtgctgtcgatcctgcacactcccacccctgagatacatgggggaagatggatgttggtatggcatggagataaggcctatttcagaaaaggaggagaatatggtcaaaagccttgcctctgcaggttccggcaaggttgacaactttaccatgggggtgctgtgcttggctatcctcttcgaagaggtaatgcgcggaaagttcggcaaaaagcatatgatcgccggggtgtttttcacgtttgtcctgctactgagtggacagattacttggcgggatatggcacacaccctcatcatgattggcagcaatgcctctgacagaatgggtatgggggtgacatacctggctcttatagcgaccttcaaaatccagccatttttggccctgggattctttttaaggaagctcacttcccgcgaaaacctgcttctgggcgttggcctagcaatggctacaaccctccaactgcccgaggatattgaacagatggccaatgggatcgccttgggactgatggctttaaaactcattacacagttcgagacttatcagctgtggaccgcacttatctcactgacgtgtagtaacacaatgtttaccttgactgtggcctggcgaaccgcgacactcatactggctggtgtcagcctactgccggtgtgccaatcgtcctctatgcggaagactgactggcttcctatgaccgttgccgcaatgggcgtgccacccctccctctgttcatctttagcttgaaggatacgctgaaacgtagatcatggcccttaaatgagggggtcatggccgtaggactcgtgagtattctggcttcctctcttctgaggaacgacgttccaatggcaggccctttggtggccggtgggatgctcatcgcgtgttacgtcattacaggaaccagcgctgatctgactgtggaaaaggccgcagacgtaacatgggaggaagaggccgaacagaccggcgtgtcccataacctaatgatcactgtcgacgatgacggcacaatgcgcataaaagatgacgagaccgagaatattctgacggttcttctcaagactgctctgttgatcgtgtcagggatcttcccctacagcattccagccaccttactggtgtggcacacatggcagaaacagacccaacggagtggagtcctctgggatgtgccgtctcctcccgaaacacagaaggcagagctggaagagggtgtttatagaataaaacagcagggcatccttgggaagactcaagtaggagtgggcgtccagaaggagggtgtgtttcataccatgtggcacgttacgaggggggctgtgctgacacacaacggaaaacgattggaaccaaattgggcctccgtcaagaaagacctaattagctacggcggcgggtggcgcctgtcggcgcagtggcaaaagggagaggaagtgcaggtaatcgccgtcgagcccggtaaaaaccctaagaatttccagactatgccaggcaccttccagacaaccactggggaaattggagcaatcgctctcgattttaagcccggcacctcaggttctcctataatcaaccgggaggggaaagtggttggactgtatggcaatggcgtggtcacaaagaacgggggatacgtgagtggtattgcccaaacgtccgctgagccggacggcccaactcccgaacttgaggaagagatgttcagaaaaaggaatttaaccatcatggatctgcatcctgggagcggaaagacacgtaaatatctcccagcaattgttcgcgaagccatcaagcggagattgaggaccctgatactcgcccccactcgagtggtcgctgcggagatggaggaagcactgaagggccttcctattcggtaccagacaaccgccacgaaatctgagcacactggtcgcgaaatcgtggacctgatgtgccatgctacatttaccatgagattgctaagcccggtaagggtgcccaactataatctgatcattatggatgaggcccacttcaccgacccagcatccatcgccgctcgggggtacatatcaactcgagttggaatgggcgaagcggccgcaatttttatgacagctacccctcccggcacagccgatgcattcccacagagtaacgcccctatccaggacgaggagagagacattcccgaacgcagctggaattctgggaacgagtggatcactgattttgctggaaagacggtctggttcgtgccatccataaaagccggtaatgacattgcgaactgtctcaggaagaacggcaaaaaggtgatccaattatcacgtaagacctttgatacagaataccagaaaactaagctgaatgactgggatttcgtcgtaaccacagacatcagtgagatgggggcaaactttaaagccgatcgggtgattgacccgagaaggtgccttaagcctgttatcctgaccgatggacccgagcgcgtgattctcgctggcccaatgcccgtcactgccgctagcgcagcccagcgaagaggtcgggtggggaggaatcctcagaaagaaaacgaccaatatatattcacgggccagccattgaataacgatgaggaccatgctcactggaccgaagccaagatgctgctcgacaatatcaacacacccgagggaattatccctgcactgttcgaaccggagcgcgagaagtccgcggccatcgatggcgaataccgtcttaaaggggagtctagaaagacttttgttgaactaatgcggaggggagacctgccagtgtggttggctcacaaagtcgcctcggagggtattaagtataccgatcgcaaatggtgcttcgacggccagcgaaataaccagatattagaagagaatatggatgtggagatctggacaaaggaaggggagaaaaagaagctgagaccccggtggctcgacgcaaggacctacagcgatcctctggctcttaaagaatttaaggacttcgccgcaggacgcaaatcaattgccctggatctcgtaactgagatcggcagagtgccctcccatttggctcacaggacacggaacgcgctggacaatctagttatgctgcatacgagtgaacacggtgggcgtgcctatcgccacgcagtcgaggagctcccagaaaccatggagactcttctgttattgggcctgatgattctcctgacaggaggcgctatgctttttctgatctctgggaagggaataggtaaaaccagcatcggcctcatttgtgtgatcgcctcctcagggatgttgtggatggccgatgtgcctctgcaatggattgcatctgctatcgtcttagaattctttatgatggttctactgatacccgagccagagaagcagcgaacccctcaggacaaccaactcgcctacgtggtaattggaatccttacactggcggctattatcgccgcaaatgaaatgggcttgctggagactacgaagagagatctcggtatgagcaaagaaccgggggtggtcagtcccacctcctatctggacgtggaccttcatccagccagcgcttggacactctacgcagttgccactaccgtgataacacctatgctgaggcacaccatcgagaactctactgcgaatgtctcattggctgccattgcaaaccaggccgtagtgctgatgggcttagataagggatggcccatctccaaaatggacctaggcgttccactgctcgctcttgggtgctacagtcaggtgaaccctctgacgttgacagccgcagtcctgctcctgattacccattatgctatcataggacccggccttcaggccaaggcgactcgggaagcccaaaaacgcaccgcagctggtattatgaagaatccgacagtggatgggatcatgactatcgacttagatccagtcatttacgacagcaagttcgagaaacagctgggacaggtgatgctcttggttctgtgtgccgtgcagctactgctcatgagaacctcgtgggcactttgcgaggctctgacattggccacgggccctatcaccactctgtgggaaggttctcccggcaagttttggaacacaaccatagccgtatccatggcgaatattttcagggggagctatctcgctggagcaggcctggccttttcaatcatgaaaagtgtggggactggaaagcggggcacaggttctcaaggggagaccttaggagaaaaatggaagaagaaacttaaccagctgtcccgaaaggagttcgatctctacaaaaagagcggcattacggaagtcgacagaaccgaggctaaagagggtctaaagcgcggcgaaacaactcaccatgccgtttcaagggggagtgcaaaactgcagtggtttgtggagcggaatatggtcatcccagaaggacgtgtgatagatttgggctgtgggagaggaggctggagctattactgcgccggtctgaagaaggtaaccgaggtgagggggtatacaaaaggaggccccggccacgaagagcctgttccgatgtccacttacgggtggaacatcgtgaagctcatgtctggaaaagacgtcttctaccttcccccagagaagtgtgataccctgttgtgcgacattggtgaaagctccccttcacccacagtggaggaatctcgcaccatccgggtcctgaaaatggtggagccttggctcaagaataaccagttctgtattaaggttttaaatccatatatgcccactgtaatcgagcacctggaacgacttcaaagaaaacatggcgggatgctggtgaggaaccctctaagtcgcaattcgacgcacgagatgtactggattagcaacggaacaggcaatatcgtctcctctgtgaacatggtttcacggctcctgttgaatagatttaccatgactcatcgtaggccaaccatagaacgggatgtggacctgggtgctgggacacgccacgtcaacgcggagcccgaaattccgaacatggacgtgatcggagagcgaatcaagagaattaaagaggaacacaatagcacgtggcattatgatgacgagaacccttacaagacctgggcctatcacggctcctacgaagtaaaagcaactggcagtgcttctagcatgataaatggggtggttaagctccttacaaagccatgggatgtcgtgcccatggtgacccagatggccatgactgacacaacccctttcggacagcaaagggtctttaaagagaaggttgatacacggactccacgccccatgccgggtaccagaaaagtgatggaaatcacggcagagtggctgtggaggaccttaggccgaaacaagcggcctcgtctgtgcacaagagaggaattcactaaaaaggtacgcaccaatgccgctatgggggccgtgtttacagaggaaaaccagtgggactcagcgaaggcagccgtcgaggatgaagagttctggaaattggtggacagggagcgggaactccataagctgggaaaatgtggctcctgcgtttataatatgatgggtaagagagagaaaaagctaggggaatttggaaaagctaagggcagtcgcgccatttggtacatgtggcttggcgcaaggtacctggagttcgaggctctcgggtttctgaacgaagatcactggttcagccgagagaattcttattccggagtggaaggtgagggcttgcataagctggggtacatcctccgggacatttcaaaaatccccggaggcgccatgtatgctgatgacactgccggttgggacaccagaataacggaagatgaccttcacaacgaggagaagatcacacagcagatggatccagaacacaggcaactggcaaatgcgatttttaaattaacctaccagaacaaggtcgtgaaagtacagcgccctactcccacagggaccgttatggacatcattagccgtaaggatcagcggggatcgggccaagtgggcacttatgggctgaataccttcacaaacatggaggcccagttggtcagacagatggaaggagagggtgtgctctctaaggctgacctggaaaatccacatctacttgagaaaaagatcacgcagtggctggagaccaaaggcgtggaaaggctcaagcgcatggccataagtggggatgactgcgtcgttaaacccattgatgaccgatttgcaaacgctctgttggccttaaacgatatgggaaaggtgcggaaggacatccctcaatggcagccatccaaaggctggcacgattggcagcaggtaccgttctgtagccatcacttccacgagctgatcatgaaggacggtagaaaactcgtggtcccctgcaggcctcaagacgaacttattgggcgcgcaagaatatcacagggagccggctggtccctgcgggagactgcgtgtctaggcaaggcttacgcccagatgtggtctctgatgtattttcataggcgtgatctccgattggcaagcaatgccatctgcagtgctgtgccagttcactgggtgcccacatcccgcaccacttggagcattcatgcccaccatcaatggatgacaaccgaagacatgctgacggtctggaacagagtgtggatcgaggataatccttggatggaggacaaaacaccagtaaccacttgggaaaacgttccctaccttgggaagcgggaggatcagtggtgtggatctctgattggtctcacctcaagggcaacatgggctcagaatatccctactgccatacagcaagtgcgcagtttaatcggcaacgaagagttcctggactacatgccgtccatgaagagatttcggaaagaggaagagagcgaaggggcgatttggtga

SEQ ID NO: 15256 - RNA, 9873 nt, synthetic construct
  misc_feature 1..9873: note = derived and/or modified CDS sequence (opt3) from DENV-3__FJ882573__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttgggccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgcgccctgtaaaatccctttctccaccgaggacggccaaggtaaggcacataacgggcgtcttataacagccaatccagttgtgactaaaaaggaggaacccgtaaacattgaggctgaaccgcctttcggcgagtcaaatatcgtcatcggaattggcgataacgccttgaaaatcaattggtataagaaggggagcagtattggaaaaatgtttgaagcaaccgcccgcggtgctagaaggatggccatactgggcgacacagcatgggatttcgggtctgtgggaggcgttctcaactccctgggtaagatggtgcaccagatctttgggagcgcgtacactgctcttttctcgggcgtctcttgggtgatgaaaattggaatcggcgtactgttgacctggatcgggctcaattccaagaacacgcccatgtcatttagttgcattgccataggaatcattacactgtatttaggcgcagtggttcaggccgacatgggttgtgtcatcaattggaaagggaaggagctgaagtgcggaagcggcattttcgtgaccaacgaggtgcatacttggacagaacagtacaaatttcaagctgattccccaaagcggctagccaccgcaatcgctggtgcctgggagaatggcgtctgtgggatacgatctactacccgcatggaaaacctcctgtggaaacagatcgcgaatgagcttaactatattttgtgggaaaataacatcaagctgacagttgtggtgggagacacgaccggcgtactcgagcaggggaaaagaactctgacacctcagcccatggagttaaagtacagctggaaaacctggggaaaggccaagattgtcacagctgaaactcaaaactcaagtttcatcatagatggcccaaatacccccgagtgcccttccgcaagcagggcctggaacgtgtgggaagttgaggactatggttttggggtgttcacgacaaatatttggctgaaacttcgggaagtctacacccagttgtgtgaccaccgcctcatgtctgctgccgtgaaggatgagagagcagttcacgcggacatgggatactggatcgagtcacagaaaaacggcagttggaagctggaaaaagccagcctaattgaggtgaagacttgcacctggccaaagtcccatacactgtggtctaatggtgtactcgaatcggatatgatcataccgaaaagcctggctggccccatctcccagcacaactataggcctgggtaccatactcaaaccgccggaccatggcaccttggcaagttggagctggactttaattattgcgaggggacaacggtcgtgattaccgaaaactgtggaactcgtggcccctcattacggacaaccactgtgagtggtaaactcatccacgagtggtgctgtcgatcttgcacactgcctccacttagatacatgggggaagatggatgttggtatggcatggagattaggcccatcagcgaaaaggaggagaatatggtcaaatccctggtttcagcaggtagcggcaaggtggacaacttcaccatgggggtattgtgcctcgctatactgtttgaagaggtgatgcgcggaaagttcggcaaaaagcatatgattgccggggtcttctttacgttcgtgctactgctctctggacagatcacttggcgggatatggcacacaccctgatcatgattggctccaatgccagtgacagaatgggtatgggggttacataccttgctttgatcgcgacctttaaaattcagccgttcctggccttaggatttttcctcaggaagctgactagccgcgaaaaccttctgctaggcgtgggcctcgcaatggctacaaccctgcaattgcctgaggatatagaacagatggccaatgggatcgccctgggattaatggctctcaaactgattacacagtttgagacttatcagctttggaccgcactggtctctttgacgtgttccaacacaatcttcaccctcactgtggcctggcgaaccgcgacactgattctagctggtgtttcactgcttccagtgtgccaaagtagctcgatgcggaagactgactggctccccatgaccgtcgccgcaatgggcgtacctcccctgccattgtttatcttctccctgaaggatacgttaaaacgtagatcttggcctctcaatgagggggtgatggccgttggactggtgagcatacttgcttcaagtctgttgaggaacgacgtccccatggcaggcccactcgtggccggtgggctgctaatcgcgtgttacgtaattacaggaacctccgctgatctgactgtggaaaaggccgcagacgtcacatgggaggaagaggccgaacagaccggcgtttctcataaccttatgatcactgtggacgatgacggcacaatgcgcattaaagatgacgagaccgagaatatcctcacggtgctgttgaagactgctttactgatagtcagcgggatttttccgtactccatccctgccaccctcctggtgtggcacacatggcagaaacagacccaacggtcaggagttctttgggatgtacccagcccacccgaaacacagaaggcagagctggaagagggtgtgtatagaatcaaacagcagggcattttggggaagactcaagtcggagtgggcgttcagaaggagggtgtgttccataccatgtggcacgtcacgaggggggctgtgctaacacacaacggaaaacgactggaacctaattgggccagtgtaaagaaagacctcatatcttacggcggcgggtggcgcctgtccgcgcagtggcaaaagggagaggaagtccaggtgatcgccgttgagccaggtaaaaaccccaagaattttcagactatgcctggcaccttccagacaaccactggggaaattggagcaatcgctcttgatttcaagccgggcaccagcggttcgccaattatcaaccgggaggggaaagtggtcggattatatggcaatggcgtggttacaaagaacgggggatacgtgtcaggtatagcccaaacgaatgctgagcccgacggccctactccagaactggaggaagagatgtttaaaaagagaaacctcaccatcatggatttgcatcccgggtctggaaaaacaaggaagtatctgcctgcaattgtccgtgaagccatcaagcgccggctcagaaccctgattcttgccccgactagggtggtagctgcggagatggaggaagcactgaaaggcttgcccatccgataccagacaaccgccacgaagagtgagcacactggtcgggaaatagtggacctaatgtgccatgctacattcaccatgcgcctgctctccccagttagagtccctaattataacttaattatcatggatgaggcccactttaccgaccccgcaagcatcgccgctagggggtacatttctactcgggtgggaatgggcgaagcggccgcaatcttcatgacagctaccccacctggcacagccgatgcatttccccagagcaatgccccaatacaggacgaggagcgagacattccggaaagatcctggaactcagggaatgagtggatcactgatttcgctggaaaaacggtgtggtttgtccctagtattaaggccggtaacgacatcgcgaactgtctgcgcaaaaatggcaagaaggtaatacaacttagcaggaaaaccttcgatacagaataccagaagactaaactgaacgactgggattttgtggttaccacagacatttctgagatgggggcaaatttcaaggccgatcgtgtgatcgacccccggagatgcctcaaaccagtcatcttgaccgatggacccgagagggtgattctggctggccctatgccagttactgccgcttccgcagcccagcgccgaggtagagtggggcggaacccccagaaggaaaatgaccaatatatctttacgggccagcctctcaacaatgatgaggaccatgctcactggaccgaagccaagatgctgcttgacaacattaatacaccggagggaataatcccagcactattcgaacccgagagggagaaatcagcggccattgatggcgaataccgcctgaagggggagagtcgtaaaactttcgtcgaattgatgagacggggagacttacctgtgtggctggctcacaaggtagccagcgagggtatcaaatataccgataggaagtggtgctttgacggccagcgcaacaatcagatcctcgaagagaacatggatgtggagatttggacaaaagaaggggagaagaagaaactgcgacccagatggcttgacgcacggacctactccgatccactggctctcaaggaattcaaagactttgccgcaggaaggaagtctatagccttggatctggttactgagatcggccgcgtcccttcgcatctagctcacagaacaaggaatgcgctggacaacctcgtgatgcttcatacgagcgaacacggtgggcgggcctatcgtcacgcagtggaggagctgcccgaaaccatggagactttattgctgctcggcctgatgattcttctgacaggaggcgctatgctcttcttgatctcagggaaaggaattggtaagacctccatcggcctgatatgtgtcatcgccagttctgggatgttatggatggccgaagttccactacaatggattgcaagcgctatcgtgctggagtttttcatgatggtactccttattcctgagccggaaaagcagcgcaccccccaggataatcaactggcctacgtggtcatcggaatattgacactggcggctatgattgccgcaaacgagatgggcctcctggaaactacgaaacgagaccttggtatgtccaaggagccaggggtggtttcacctacctcttatctcgatgtggacctgcatcccgccagcgcttggacattgtacgcagtcgccactaccgtaatcacaccaatgctgagacacaccattgaaaatagtactgcgaacgtgtccttagctgccatcgcaaaccaggccgttgtgctaatgggcctggacaaaggatggcctataagcaagatggatctcggcgtcccccttctggctttggggtgctactctcaggtgaatccgctgacgctcacagccgcagtcctgcttttaatcacccattatgctattatcggaccaggcctgcaggccaaagcgactagggaggcccaaaagcggaccgcagctggtattatgaagaaccctacagtggacgggatcatgactatagatctcgaccccgttatttacgattcaaaatttgagaagcagttgggacaggtgatgctgctagtactgtgtgccgtgcagctccttctgatgcgcacctcctgggcattgtgcgaagctctgacactcgccacgggcccaatcaccactctgtgggagggtagtcccggcaaattctggaatacaaccatcgccgtcagcatggcgaacatttttagagggtcgtatttagctggagcaggccttgccttctctatcatgaagtccgttgggactggaaaaaggggcacaggtagccaaggggaaaccctgggagagaagtggaagaaaaagctcaatcagctatcacggaaagaatttgacctgtacaagaaaagtggcataacggaggtggatcgaaccgaggctaaggaaggtttgaaaagaggcgagattacacaccatgccgtctctcgcgggtccgcaaagctgcagtggttcgtggaaaggaacatggtagtgcctgagggacgggttatcgacctcggctgtgggcgtggaggctggagctattactgcgccggtcttaagaaagtgactgaagtcagagggtataccaagggaggcccgggccacgaggagcccgtgccaatgtcaacatacgggtggaatattgtcaaactgatgagtggaaaggatgtgttttacttgcctcccgaaaaatgtgacactctgctctgcgatatcggtgagagctccccttctccaaccgttgaagagagcaggacaatacgcgtattaaagatggtggagccctggctgaagaacaatcagttctgtatcaaagtccttaacccttatatgccaaccgtgattgaacacctggagcggctacaacgaaagcatggcgggatgctcgttagaaatcccctgtccaggaactcaactcacgaaatgtactggatctctaatggaacgggcaacattgtgagttcggtcaatatggtgagccgcttgctgctcaaccggttcacaatgacccatagacgtccgactatcgagaaagacgtagatcttggtgctgggaccaggcacgtgaacgcggaacctgagacaccaaatatggacgttattggagagcgggtcaagcgcatcaaagaagagcacaactccacgtggcattatgacgatgaaaatccctacaagacctgggcctatcacggctcttacgaggtgaaggcaactggctcagctagctccatgataaacggggtggtcaaactgttaacaaagccttgggacgttgtgccaatggtaacccagatggccatgactgatacaaccccctttggacagcaacgagtgttcaaagaaaaggtcgacacaagaactccgaggcctatgcccggtacccggaaagtgatggagattacggcagagtggctgtggcgcaccttgggcagaaataagaggccacgactctgcacacgggaagagtttactaagaaagttcgtaccaacgccgctatgggggccgtgttcacagaagagaatcagtgggatagtgcgaaggcagccgtcgaagacgaggagttttggaaactggtggatagagaacgcgagctacataagcttggaaaatgtggctcttgcgtatataacatgatgggtaagagggaaaaaaagctgggggagttcggaaaggctaaaggcagccgggccatctggtacatgtggctcggcgcaagatacctggagtttgaagctttggggttcctgaatgaggaccactggttttcacgcgaaaactcctatagtggagttgagggtgaaggcctccataagcttgggtacatcctgagggatattagcaaaatacctggaggcgccatgtatgctgacgatactgccggttgggacacccgaatcacggaggacgatttacacaatgaggaaaagattatccagcagatggaccccgagcaccggcaactggcaaacgcgattttcaaattgacataccagaataaggtggtcaaggtgcagagaccaacccccactgggacagtgatggatatcatatctaggaaagaccagcgcggatccggccaagtcggcacctatgggctcaacacttttaccaatatggaagcccagctggttcgtcagatggagggagaaggtgtgctaacaaaggctgatcttgagaaccctcatctgctcgagaaaaagatcacgcagtggctggaagccaaaggcgtagagcggttgaagagaatggcaatttcaggggacgattgcgtggtcaagccaatcgacgataggttcgctaacgccttactggcactcaatgacatgggaaaagtgcgcaaggatattccgcaatggcagcccagcaaaggctggcacgactggcagcaggttcctttttgttcgcatcacttccacgaacttatcatgaaggatggtcgaaaactggtggtcccatgccggccccaagacgagctaatagggagagccaggatttctcagggagcgggctggagtctgcgcgaaaccgcttgtctcggcaaggcctacgcacagatgtggtccttgatgtatttccatagacgggacctgaggcttgccagcaacgctatctgctcagccgtgcctgtacactgggttccaacttcccgtacaacctggtctatccatgcacaccatcaatggatgactacagaggatatgctgaccgtgtggaatcgagtctggattgaggaaaacccctggatggaggacaagacgcctgtgacaacctgggaaaatgttccgtacctcgggaaacgcgaggatcagtggtgtggaagcttaataggtctgactagtagagctacctgggcccagaacatcccaacagcgattcagcaagtgcggtccttgatcggcaatgaggaatttctggactacatgcccagcatgaagaggttccgcaaagaggaagagtctgaaggggctatttggtga

SEQ ID NO: 15257 - RNA, 9873 nt, synthetic construct
  misc_feature 1..9873: note = derived and/or modified CDS sequence (opt3) from DENV-3__FJ898440__SS-prME
  source 1..9873: mol_type = other RNA
accagcctgtgcctcatgatgatccttcccgcagctctggcattccacttgacatccagggacggcgaacctaggatgattgtggggaagaacgaacggggaaagtctttactgtttaagactgcatcaggtataaatatgtgtacgttaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccatcacggaggccatcctcccagaatatggaacacttggcctggagtgctctccgcgaaccggtttggacttcaatgagatggtgctactgactatgaaaaacaaggcgtggatggtacatagacagtggtttttcgatctccccctgccttggaccagcggggccacaaccgaaactccaatttggaataggaaagagcttctggttacatttaagaacgcacacgctaaaaagcaagaagtggtcgtgttgggctcccaggagggagccatgcacacggctctcaccggcgccactgaaatacaaaattcagggggaacaagtatcttcgcaggtcatctgaagtgtcggttaaaaatggacaagctggagctaaaaggcatgagctacgccatgtgcaccaacacatttgtcctcaagaaagaggtgtctgaaactcagcacgggaccattctgatcaaggttgagtacaagggagaagatgctccctgtaaaatacctttctccacggaggacggccaaggtaaggcgcataacgggcgtcttattaccgcaaatccagtggtaactaagaaggaggaacccgtcaacatcgaggccgaaccgcctttcggcgagtcaaatatcgtgattggaatcggcgataacgctttgaaaattaattggtataagaaggggagcagtataggaaaaatgtttgaagccactgcacgcggtgccagaaggatggctatcctgggcgacaccgcctgggatttcgggtctgttggaggcgtgctcaactccctgggtaagatggtccaccagatttttgggagcgcatacacagcgcttttctcgggcgtgtcttgggtaatgaaaatcggaatcggcgtgctgttgacttggattgggctcaattccaagaacacctcaatgagttttagctgcatagctatcggaattatcacgctgtatttaggcgccgttgtccaggcagacacaggttgtgtgattaattggaaagggaaggagctgaagtgcggatccggcatcttcgtgaccaacgaggtccatacttggacagaacagtacaaatttcaagccgattctcccaagcggctagctaccgccatagccggtgcttgggagaatggcgtttgtgggatccgaagcactacccgcatggaaaacctcctgtggaaacagattgccaatgagcttaactatatcttgtgggaaaataacattaagctgacagtggtggtaggagacatcataggcgtcctcgagcaggggaaaagaacgctgaccccacagcctatggagttaaagtactcatggaaaacttggggaaaggcgaagattgtgacagccgaaacccaaaacagttccttcatcattgatggccccaatacaccagagtgccccagcgcttctagggcatggaacgtttgggaagtggaggactatggttttggggtcttcactaccaatatctggctgaaacttcgggaagtgtacacgcagttgtgtgaccaccgcctcatgtcagccgctgttaaggatgagagagccgtgcacgcagacatgggatactggatagagagtcagaaaaacggcagctggaagctggaaaaagcgtccctaatcgaggtaaagacatgcacctggcctaagtctcatactctgtggtcgaatggtgtcctcgaaagcgatatgattatcccaaaatccctggccggcccgatttcacagcacaactataggcccgggtaccatacccaaacagctggaccttggcaccttggcaagttggagctggactttaattattgcgaggggactaccgtggtgatcacagaaaactgtggaacgcgtggcccaagtttacggaccactacagtctctggtaaactcatacacgagtggtgctgtcgaagctgcaccctgccccctcttagatacatgggggaagatggatgttggtatggcatggagattaggccaatctccgaaaaggaggagaatatggttaaatcactggtgagcgccggttctggcaaggtagacaacttcactatgggggtgttgtgcctcgcaatcctgtttgaagaggtcatgcgcggaaagttcggcaaaaagcatatgattgctggggtgttctttacattcgttctactgctctccggacagatcacctggcgggatatggcccacacgctgattatgataggcagtaatgcaagcgacagaatgggtatgggggtgacttaccttgccttgatcgctacctttaaaattcagcccttcctggcgttaggatttttcctcaggaagctgacatctcgcgaaaaccttctgctaggcgtcggcctcgccatggcaaccactctgcaattgccggaggatatcgaacagatggctaatgggattgccctgggattaatggccctcaaactgatcacacagtttgagacctatcagctttggacagctctgatatccttgacttgttcaaacaccatcttcacgctcacagtggcatggcgaaccgccactctgattctagcgggtgttagtctgcttcctgtgtgccaaagctcgtccatgcggaagaccgactggctcccaatgacagtcgctgccatgggcgtacagcccctgcctttgtttatcttctctctgaaggatactttaaaacgtagaagctggcccctcaatgagggggtgatggcagttggactggtgtcaattcttgccagttccctgttgaggaacgacgtcccaatggctggccctctcgtggccggtgggctgctaatcgcctgttacgtaataaccggaacgtctgcggatctgacagtggaaaaggctgccgacgtcacctgggaggaagaggcagaacagactggcgttagccataaccttatgattacagtggacgatgacggcaccatgcgcatcaaagatgacgagactgagaatatcctcacagtgctgttgaagaccgccttactgattgtctccgggatatttccctactcaatcccagctacgctcctggtgtggcacacttggcagaaacaaacccagcggagcggagttctttgggatgtaccgagtcctcccgaaacacagaaggccgagctggaagagggtgtgtatagaattaaacagcaaggcatcttcgggaagacccaggtcggagtgggcgttcagaaggagggtgtgtttcatacaatgtggcacgtcactagaggggcagtgttgacctacaacggaaaacgactagaaccaaattgggcttctgtaaagaaagacctgatttcctatggcggcgggtggcgcctcagcgcccaatggcagaagggagaggaagtccaggtgatcgcggttgagcccggtaaaaaccctaagaatttccagacgatgccaggcacattccaaactaccacaggggaaataggagccatcgcactggattttaagcccggcacctcgggttcacctattatcaaccgggaggggaaagtggtcggactttacggcaatggcgtggttactaagaacgggggatatgtgtctggtattgctcagaccaatgccgagccggacggcccaacacccgaattagaggaagagatgttcaaaaagagaaacctgacgatcatggatctccaccctgggagtggaaaaactaggaagtacttgccagctatagtccgtgaagcaattaagcgccggctgagaaccctcatcctggcccccacaagggtggtagccgctgagatggaggaagcgcttaaaggcctgcctatccgatatcagaccactgcaacaaagtccgagcataccggtcgggaaattgtggacttgatgtgccacgccacgtttactatgcgcctactgagcccggttagagtccccaattacaacctcatcataatggatgaggctcatttcacagacccagcctctattgcagccagggggtacatcagcacccgggtgggaatgggcgaagctgcggccatttttatgaccgcaactcctcccggcacagctgatgccttcccacagtccaatgcacctatccaagacgaggagcgagacatacccgaaagatcatggaacagtgggaatgagtggattaccgattttgccggaaaaacagtgtggttcgtcccaagcatcaaggctggtaacgacatcgccaactgtttacgcaaaaatggcaagaaggtaattcagctgtctaggaaaacttttgatacggaatatcagaagaccaaacttaacgactgggatttcgtggttacaactgacatctccgagatgggggcgaattttaaggcagatcgtgtgattgacccgcggagatgcctgaaacctgtcatactcaccgatggacccgagagggtgatcttggccggcccaatgcccgttacagctgcctcagctgcacagcgccgaggtagagtggggcggaaccctcaaaaggaaaatgaccagtacattttcaccggccagccactgaacaatgatgaggaccacgcccattggactgaagctaagatgctcctggacaacatcaatacgcccgagggaatcattcctgcccttttcgaaccggagagggagaaaagtgcagcgatagatggcgaatatcgcctaaagggggagagccgtaaaacctttgtcgaactgatgagacggggagacttgccagtgtggttagcccacaaggtagcttccgagggtatcaaatacacagataggaagtggtgcttcgacggccagcgcaacaatcaaattctggaagagaacatggatgtggagatctggactaaagaaggggagaagaagaaactccgacccagatggctggacgcccggacctattctgatcctcttgcactgaaggaatttaaagacttcgctgccggaaggaagtcgattgcactcgatttggttacagagatcggccgcgtccccagccacctggcccatagaaccaggaatgctctagacaacctggtgatgctccacacttcagaacatggtgggcgggcgtaccgtcacgccgtggaggagcttccagaaacaatggagacgctgttattgctgggcctcatgatactgcttaccggaggcgcaatgctgtttctcatctccgggaaaggaattggtaagacaagtatcggcttgatttgtgtcatcgcttctagcgggatgctgtggatggccgaaatacctttacagtggattgcctccgcaatcgttctagagttctttatgatggtgctgctcattcccgagccagaaaagcagcgcacacctcaagataatcagcttgcttatgtagtgatcggaatactgaccttggccgcgatcattgctgccaacgagatgggcctgctcgaaaccactaaaaaggacctgggtatgtcaaaagagccgggggtcgtgtctcccacaagctaccttgatgttgacctccacccagcaagtgcctggacgctgtacgctgtggcaaccacagtcatcactcctatgttgcgacataccattgaaaattccacagccaacgtaagcctggcggctatcgccaaccaggcagtggttttaatgggcctagacaagggatggcccatatctaaaatggatctgggcgtgccactccttgccctggggtgctattcacaggtcaatcctttgaccctgactgctgccgtgctcctgcttattacgcactacgcaatcatcggacccggcttacaagctaaggccacaagagaggcgcagaagaggaccgccgcaggtattatgaaaaacccgactgtcgacgggatcatgaccatagatctggacccagtgatttatgattccaagttcgagaaacagctcggacaggttatgttgctggtgctatgtgctgtacaactgctccttatgcggacaagttgggccctgtgcgaagcattgactctggctaccggccctatcacaacgctctgggagggtagccccggcaagttttggaataccactattgccgtgtcgatggccaacatcttccgcgggtcttacctggcgggagctggcttagcattttccataatgaaaagcgtcgggacaggaaagagaggcaccggttcacagggggaaactcttggagagaagtggaaaaagaaactgaatcagctcagtaggaaggagttcgacctatataaaaagtctggcatcacagaggttgatcggaccgaggccaaagaaggtctgaagcgaggcgagattacgcatcacgctgtgtccagagggagcgccaagttgcagtggtttgtcgaacgcaacatggtgatcccagagggaagggtaattgacctgggctgtgggcggggaggctggtcatactattgcgcaggtctcaaaaaggtgaccgaagttcgtgggtacacaaaaggaggccccggccatgaggagcctgtgccgatgagtacttacgggtggaatatcgtcaaacttatgagcggaaaagatgtgttctatctgcccccagaaaagtgtgacaccttgctgtgcgatattggtgagtcctctcctagccccacagtcgaagagtccagaactatcagggtgctcaagatggttgagccttggctaaagaacaatcaattctgtataaaggtactgaacccatacatgcccaccgtgattgaacaccttgagcgcctgcagcggaaacacggcgggatgctagtccgaaatcctctctcaagaaactctacacatgaaatgtattggatcagtaatggaaccggcaacatcgtggcctcggttaatatggtgagcaggctgttgctgaaccgctttactatgacgcaccggagaccaacaattgagaaggacgtcgatctcggtgctgggacccgtcatgtgaacgcggaacccgagactccgaatatggacgtaataggagagaggatcaaacggattaaggaagaacacaactccacctggcactacgacgatgaaaatccttataagacatgggcctaccatggctcttatgaggtgaaagcaacgggctcagctagctccatgatcaacggggttgtcaaacttctgaccaaaccatgggacgtggtgcccatggtcactcagatggccatgacagataccactcctttcggacaacagcgcgtttttaaggaaaaagtggacacacgaaccccaagaagtatgcccggtacaaggcgggtaatgggcattactgcagagtggttatggcgcaccctggggagaaataagaagccgaggttgtgcacgcgagaggagttcaccaaaaaggtgcggacaaacgccgctatgggagccgtctttactgaggaaaatcagtgggattctgcgaaagcagccgtggaggacgaagatttctggaagctcgttgaccgtgagagagagctgcacaaactaggcaagtgtggtagctgcgtgtacaacatgatggggaaacgcgaaaagaaacttggagagtttggcaaagctaagggctcaagggccatctggtacatgtggctgggggcacggtatctcgagttcgaggctctgggatttttgaatgaggatcattggttctccagagaaaacagttacagcggtgtcgagggcgaagggctgcacaaactcggatatatacttcgcgacatctctaagattcctggcggtgccatgtacgctgatgacaccgccgggtgggacacaaggatcactgaggatgacctgcataatgaagagaaaattacccagcaaatgaaccccgagcaccgacagttagcaaatgcgatctttaagctgacgtatcagaacaaggtggtaaaagttcagcggccaacacctaccggaactgtgatggatataatttccagaaaggaccaaaggggctcaggccaggtcgggacatacggattgaataccttcactaacatggaagcccagctcatccgccagatggagggtgaaggcgtgctgagcaaagctgatctagagaacccccaccttccagaaaagaaaatcacccaatggctggagacaaagggggtggagcgtctcaagcggatggccatttcgggagacgattgcgtcgttaaacccatagacgatagatttgcaaatgctctgttggccttaaacgacatgggcaaggtgaggaaagatatccctcagtggcagccatctaagggttggcatgactggcagcaagtaccgttctgtagtcaccatttccacgaactgattatgaaagatgggcgcaagctcgtggtcccctgccgacctcaggacgagcttatcggacgggcaagaatttcccagggcgccggctggagcctgagggaaacggcgtgtctagggaaggcttatgcccaaatgtggtcactgatgtactttcaccgcagagacctccggttggcatccaatgccatctgctctgctgtgccagttcattgggtgcccaccagcaggactacatggagtatacacgcccatcaccagtggatgaccactgaggatatgctgacagtctggaaccgtgtgtggatcgaagacaatccttggatggaggataaaaccccagtaacgacatgggagaacgttccctaccttggaaagcgagaagaccagtggtgtggttccctgattggcctcaccagccgcgcaacttgggctcagaatatccctaccgccattcaacaggtgagatctttaatcgggaacgaggagttcctggattatatgccgtcaatgaaacggtttaggaaggaggaggaaagtgagggagcgatttggtga

SEQ ID NO: 15258 - RNA, 9873 nt, synthetic construct
  misc_feature 1..9873: note = derived and/or modified CDS sequence (opt3) from DENV-3__FJ898441__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaaatggtgcagtatgaaaatctgaagtacacagtcattatcactgtgcataccggtgaccagcaccaggttggcaacgagacacaaggggtgaccgcagaaattactcctcaggcttccatcacggaggccatcctcccagaatatggaacacttggcctggagtgctctccgcgaaccggtttggacttcaatgagatgattctactgactatgaaaaacaaggcgtggatggtccatagacagtggtttttcgatctccccctgccttggaccagcggggccacaaccgaaactccaacatggaataggaaagagcttctggtgacgtttaagaacgcacacgctaaaaagcaagaagtagttgtgttgggctcccaggagggagccatgcacaccgctctcactggcgccacagaaatacagaattcagggggaaccacaatcttcgcaggtcatctgaagtgtcggttaaaaatggacaagctggagctaaaaggcatgagttacgccatgtgcactaacacctttgtcctcaagaaagaggtgagcgaaacgcagcacgggaccattctgatcaaggtcgagtacaagggagaagatgctccctgtaaaatacctttctctacagaggacggccaaggtaaggcgcataacgggcgtcttattactgcaaatccagtggttaccaaaaaggaggaacccgtgaacatcgaggccgaaccgcctttcggcgagtccaatatcgtaattggaatcggcgataacgctttgaaaattaattggtataagaaggggtcaagcataggaaaaatgtttgaagccacagcacgcggtgccagaaggatggctatcctgggcgacactgcctgggatttcgggagtgtcggaggcgtgctcaactctctgggtaagatggttcaccaggtgtttgggtccgcatacaccgcgcttttcagcggcgtctcgtgggtgatgaaaattggaatcggcgtactgttgacgtggatcgggctcaattctaagaacacatccatgtcatttagttgcattgctataggaatcattaccctgtatttaggcgccgtggttcaggcagacactggttgtgtcatcaattggaaagggaaggagctgaagtgcggaagcggcattttcgtgacaaacgaggtgcatacctggactgaacagtacaaatttcaagccgattcccccaagcggctagctaccgccatcgcaggtgcttgggagaatggcgtctgtgggatacgatctacaacgcgcatggaaaacctcctgtggaaacagatcgccaatgagcttaactatattttgtgggaaaataacatcaagctgaccgttgtggtgggagacattatcggcgtactcgagcaggggaaaagaactctgacaccacagcctatggagttaaagtacagctggaaaacctggggaaaggcgaagatagtcacagccgaaactcaaaactcaagtttcattatcgatggccccaataccccagagtgcccctccgctagcagggcatggaacgtgtgggaagttgaggactatggttttggggtgttcacgacaaatatttggctgaaacttcgggaagtctacacccagttgtgtgaccaccgcctcatgtctgccgctgtgaaggatgagagagccgttcacgcagacatgggatactggatcgagtcacagaaaaacggcagttggaagctggaaaaagcgagcctaatagaggtgaagacttgcacctggcctaagtcccatacactgtggtctaatggtgtactcgaatcggatatgatcattccaaaaagcctggccggcccgatctcccagcacaactataggcccgggtaccatactcaaaccgctggaccttggcaccttggcaagttggagctggactttaattattgcgaggggacaacggtcgtgattaccgaaaactgtggaactcgtggcccatcattacggacaaccactgtgagtggtaaactcatccacgagtggtgctgtcgatcttgcacactgccccctcttagatacatgggggaagatggatgttggtatggcatggagataaggccaattagcgaaaaggaggagaatatggtcaaatccctggtttcagccggtagcggcaaggtggacaacttcaccatgggggtattgtgcctcgcaatcctgtttgaagaggtgatgcgcggaaagttcggcaaaaagcatatgatcgtcggggtgttctttacgttcgttctactgctctctggacagattacttggcgggatatggctcacaccctgatcatgattggctccaatgccagtgacagaatgggtatgggggtgacataccttgcattgatagccacctttaaaatccagcccttcctggctttaggatttttcctcaggaagctgactagccgcgaaaaccttctgctaggcgtcggcctcgcgatggccacaaccctgcaattgccggcagatattgagcagatggctaatgggatcgccctgggattaatggccctcaaactgattacacagtttgaaacttatcagctttggaccgctctgatctctttgacgtgttccaacacaatattcaccctcactgtggcatggcgaaccgccacactgatcctagcgggtgtttcactgcttcctgtgtgccaaagtagctcgatgcggaagactgactggctcccaatgaccgtcgctgccatgggcgtacagcccctgcctttgtttattttctccctgaaggatacgttaaaacgtagatcttggcccctcaatgagggggtgatggcagttggactggtgagcatccttgcctcaagtctgttgaggaacgacgtcccaatggctggccctctcgtggcaggtgggctgctaattgcctgttacgtaatcacaggaacctccgcggatctgactgtggagaaggctgccgacgtcacatgggaagaggaagcagagcagaccggcgtttctcataaccttatgataactgtggacgatgacggcacaatgcgcattaaagatgacgaaaccgagaatatcctcacggtgctgttgaagactgccttactgatcgtcagcgggatttttccctactccataccagctaccctcctggtgtggcacacatggcagaaacaaacccagcggtcaggagttctttgggatgtaccgagccctcccgagacacagaaggccgaactggaggaaggtgtgtatagaatcaaacagcaaggcattttcgggaagactcaggtcggagtgggcgttcagaaggagggtgtgtttcataccatgtggcacgtcacgaggggggcagtgttgacatacaacggaaaacgactagagccaaattgggctagtgtaaagaaagacctgatctcttatggcggcgggtggcgcctctccgcccaatggcagaagggagaagaggtccaggtgattgcggttgaacccggtaaaaaccctaagaatttccagactatgccaggcaccttccaaacaaccactggggagatcggagccatagcactggattttaagcccggcaccagcggttcgcctatcattaaccgggaagggaaagtggtcggactttacggcaatggcgtggttacaaagaacgggggatatgtgtcaggtatcgctcagacgaatgccgagccggacggcccaactcccgagttagaagaggaaatgttcaaaaagagaaacctgaccattatggatctccaccctgggtctggaaaaacaaggaagtacttgccagctatcgtccgtgaggcaataaagcgccggctgagaaccctcattctggcccccactagggtggtagccgctgaaatggaggaggcgcttaaaggcctgcctatccgatatcagacaaccgcaacgaagagtgaacatactggtcgggagatcgtggacttgatgtgccacgccacatttaccatgcgcctactgtccccggttagagtccccaattacaacctcattatcatggatgaagctcatttcaccgacccagccagcatagcagccagggggtacatttctactcgggtgggaatgggcgaggctgcggccatctttatgacagcaacccctcccggcacagctgatgccttcccacagagcaatgcacctattcaagacgaagagcgagacatccccgagagatcctggaactcagggaatgaatggataactgattttgccggaaaaacggtgtggttcgtcccaagtattaaggctggtaacgacatcgccaactgtttacgcaaaaatggcaagaaggtaatccagctgagcaggaaaacctttgatacagagtatcagaagactaaacttaacgactgggatttcgtggttaccacagacatttctgaaatgggggcgaattttaaggcagatcgtgtgatcgacccgcggagatgcctgaaacctgtcattctcaccgatggacccgagagggtgatattggccggcccaatgcccgttactgctgcctccgctgcacagcgccgaggtagagtggggcggaaccctcaaaaggagaatgaccagtacatcttcacgggccagccactgaacaatgatgaagaccacgcccattggaccgaggctaagatgctcctggacaacattaatacacccgaaggaatcatccctgcccttttcgagccggaaagggagaaatcagcagcgattgatggcgagtatcgcctaaagggggaaagtcgtaaaacttttgtcgagctgatgagacggggagacttgccagtgtggttagcccacaaggtagctagcgaaggtataaaatacaccgataggaagtggtgcttcgacggccagcgcaacaatcaaatcctggaggaaaacatggatgtggagatttggacaaaagagggggaaaagaagaaactccgacccagatggctggacgcccggacctattccgatcctcttgcactgaaggagtttaaagacttcgctgccggaaggaagtctatcgcactcgatttggttactgaaattggccgcgtcccctcgcacctggcccatagaacaaggaatgctctagacaacctggtgatgctccacacgagcgagcatggtgggcgggcgtaccgtcacgccgtggaagagcttccagagaccatggaaactctgttattgctgggcctcatgatcctgcttacaggaggcgcaatgctgtttctcatatcagggaaaggaatcggtaagacctccattggcttgatctgtgtcattgctagttctgggatgctgtggatggccgagatccctttacagtggatagccagcgcaattgttctagaattctttatgatggtgctgctcatccccgagccagagaagcagcgcacccctcaagataatcagcttgcttatgtagtgattggaatcctgacattggccgcgataatcgctgccaacgaaatgggcctgctcgagactacgaaaaaggacctgggtatgtccaaagaaccgggggtcgtgtcatctaccagctaccttgatgttgacctccaccccgcaagtgcctggacactgtacgctgtggcaactaccgtcattacaccaatgttgcgacataccatcgagaattccactgccaacgtaagcctggcggctattgccaaccaggcagtggttttaatgggcctagacaagggatggcctatctctaaaatggatctgggcgtgcccctccttgccctggggtgctattcacaggtcaatccattgacgctgacagctgccgtgctcctgcttataacccactacgcaattatcggacctggcttacaagctaaggccactagagaagcgcagaagaggaccgccgcaggtatcatgaaaaaccccacagtcgacgggattatgactatcgatctggacccggtgatatatgattccaagttcgagaaacagctcggacaggttatgttgctggtgctatgtgctgtacaactgctccttatgcggaccagttgggccctgtgcgaggcattgacactggctacgggcccaattaccactctctgggaaggtagccctggcaagttttggaatacaaccatcgccgtgtcgatggccaacattttccgcgggtcttacctggcgggagctggcttagcattttccatcatgaaaagcgtcgggactggaaagagaggcacaggttcacagggggagacccttggagaaaagtggaaaaagaaactgaatcagctcagtaggaaggagttcgacctatataaaaagtctggcataacggaagttgatcggaccgaggccaaagagggtctgaagcgaggcgaaatcacacatcacgctgtgtccagagggagcgccaagttgcagtggtttgtcgagcgcaacatggtgattcccgaaggaagggtaatcgacctgggctgtgggcggggaggctggtcatactattgcgcaggtctcaaaaaggtgactgaggttcgtgggtacaccaaaggaggcccaggccatgaagagcccgtgcctatgagtacatacgggtggaatattgtcaagcttatgactggaaaagatgtgttctatctgccgcccgagaagtgtgacaccttgctgtgcgatatcggtgaaagctccccatctcctacagtcgaggaaagcagaaccattagggtgctcaagatggttgagccctggttaaaaaacaatcaattctgtatcaaggtactgaacccttacatgccaactgtgatagagcaccttgaacgcctgcagcggaaacacggcgggatgctagtccgaaatcccctctccagaaactcaacgcatgagatgtattggatttctaatggaacaggcaacatcgtggccagtgttaatatggtgtcgaggctgttgctgaaccgctttaccatgactcaccggagacctaccatcgaacgtgacgtcgatctcggtgctgggacaaggcatgtgaacgcggagccagaaacgcccaatatggacgtaattggagagcggataaagcgcatcaaagaggaacacaacagcacctggcactacgacgatgagaatccgtataagacttgggcctaccatggctcctatgaagtgaaggcaacaggctctgcttcaagcatgattaacggggttgtcaaacttctgaccaagccttgggacgtggtgccaatggtcactcagatggccatgacagataccacacccttcggacaacagcgagtttttaaagagaaggtggacactagaacccctaggtccatgccaggtacgcggaaagtaatgggcatcaccgcagaatggttatggcgcacactggggagaaataagaagcccaggttgtgcactcgagaggagttcaccaaaaaggtgcggacaaacgccgctatgggagccgtctttactgaagagaatcagtgggatagtgcgaaagcagccgtggaagacgaggatttctggaagctcgttgaccgtgaaagagagctgcacaaactaggcaagtgtggttcttgcgtgtacaacatgatggggaaacgcgagaagaagcttggagaatttggcaaagctaagggcagcagggccatttggtacatgtggctgggggcacggtatctcgagttcgaagctctgggatttttgaatgaggatcattggttctcaagagagaactcctacagtggtgtcgaaggcgaggggctgcacaaactcggatatatccttcgcgacataagcaccatcccgggcggtgccatgtacgctgatgacacggccgggtgggacacaaggattaccgaagatgacctgcataatgaggaaaagatcactcagcaaatggatcctgagcaccgacagttagcaaacgcgatttttaaactgacatatcagaataaggtggtaaaggttcagcggcccaccccaactggaaccgtgatggacatcatatctagaaaagatcaaaggggctccggccaggtcgggacatacggattgaacacgttcaccaatatggaggcccagctcattcgccagatggaaggtgagggcgtgctgtcaaaggctgacctagaaaaccctcaccttcccgagaaaaagatcactcaatggctggaaacaaaaggggtggagcgtctcaagcggatggccatcagcggagatgactgcgtcgttaagccaattgatgacagatttgcaaacgctctgttggccttaaatgatatgggcaaagtgaggaaggacataccccagtggcagccttcgaaaggttggcatgattggcagcaagtaccattctgttctcaccatttccacgagctgatcatgaaggacgggcgcaaactcgtggtcccgtgccgaccccaggacgaacttattggacgggcaagaatcagtcagggcgccggctggtccctgagggagaccgcgtgtctagggaaggcttatgcccaaatgtggagcctgatgtactttcaccgcagagatctccggttggcatcaaacgccatttgctccgctgtgcctgttcattgggtgccaacttctaggacaacctggagcatccacgcccatcaccagtggatgacgacagaagacatgctgaccgtctggaatcgtgtgtggatagaggataacccctggatggaagacaagactcctgtaaccacatgggagaatgttccataccttggaaaacgagaggatcagtggtgtggtagtctgatcggcctcacttcccgcgcaacctgggctcagaacattcccacagccatccaacaggtgagaagcttaattgggaatgaagagttcctggactatatgccttctatgaagcggtttaggaaagaagaggagtcagaaggagcgatctggtga

SEQ ID NO: 15259 - RNA, 9873 nt, synthetic construct
  misc_feature 1..9873: note = derived and/or modified CDS sequence (opt3) from DENV-3__FJ898442__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaaatggtgcagtatgaaaatctgaagtacacagtcattatcactgtgcataccggtgaccagcaccaggttggcaacgagacacaaggggtgaccgcagaaattactcctcaggcttccatcacggaggccatcctcccagaatatggaacacttggcctggagtgctctccgcgaaccggtttggacttcaatgagatgattctactgactatgaaaaacaaggcgtggatggtccatagacagtggtttttcgatctccccctgccttggaccagcggggccacaaccgaaactccaacatggaataggaaagagcttctggtgacgtttaagaacgcacacgctaaaaagcaagaagtagttgtgttgggctcccaggagggagccatgcacaccgctctcactggcgccacagaaatacagaattcagggggaaccacaatcttcgcaggtcatctgaagtgtcggttaaaaatggacaagctggagctaaaaggcatgagttacgccatgtgcactaacacctttgtcctcaagaaagaggtgagcgaaacgcagcacgggaccattctgatcaaggtcgagtacaagggagaagatgctccctgtaaaatacctttctctacagaggacggccaaggtaaggcgcataacgggcgtcttattactgcaaatccagtggttaccaaaaaggaggaacccgtgaacatcgaggccgaaccgcctttcggcgagtccaatatcgtaattggaatcggcgataacgctttgaaaattaattggtataagaaggggtcaagcataggaaaaatgtttgaagccacagcacgcggtgccagaaggatggctatcctgggcgacactgcctgggatttcgggagtgtcggaggcgtgctcaactctctgggtaagatggttcaccaggtgtttgggtccgcatacaccgcgcttttcagcggcgtctcgtgggtgatgaaaattggaatcggcgtactgttgacgtggatcgggctcaattctaagaacacatccatgtcatttagttgcattgctataggaatcattaccctgtatttaggcgccgtggttcaggcagacactggttgtgtcatcaattggaaagggaaggagctgaagtgcggaagcggcattttcgtgacaaacgaggtgcatacctggactgaacagtacaaatttcaagccgattcccccaagcggctagctaccgccatcgcaggtgcttgggagaatggcgtctgtgggatacgatctacaacgcgcatggaaaacctcctgtggaaacagatcgccaatgagcttaactatattttgtgggaaaataacatcaagctgaccgttgtggtgggagacattatcggcgtactcgagcaggggaaaagaactctgacaccacagcctatggagttaaagtacagctggaaaacctggggaaaggcgaagatagtcacagccgaaactcaaaactcaagtttcattatcgatggccccaataccccagagtgcccctccgctagcagggcatggaacgtgtgggaagttgaggactatggttttggggtgttcacgacaaatatttggctgaaacttcgggaagtctacacccagttgtgtgaccaccgcctcatgtctgccgctgtgaaggatgagagagccgttcacgcagacatgggatactggatcgagtcacagaaaaacggcagttggaagctggaaaaagcgagcctaatagaggtgaagacttgcacctggcctaagtcccatacactgtggtctaatggtgtactcgaatcggatatgatcattccaaggagcctggccggcccgatctcccagcacaactatcgtcccgggtaccatactcaaaccgctggaccttggcaccttggcaaattggagctggactttaattattgcgaggggacaacggtcgtgattaccgaaaactgtggaactcggggcccatcattacgaacaaccactgtgagtggtaagctcatccacgagtggtgctgtagatcttgcacactgccccctcttaggtacatgggggaagatggatgttggtatggcatggagatacgcccaattagcgaaaaagaggagaatatggtcaagtccctggtttcagccggtagcggcaaagtggacaacttcaccatgggggtattgtgcctcgcaatcctgtttgaagaggtgatgcggggaaagttcggcaagaaacatatgatcgctggggtcttctttacgttcgtgctactgctctctggacagattacttggagagatatggcccacaccctgatcatgattggctccaatgcaagtgacaggatgggtatgggggttacataccttgccttgatagctacctttaagatccagcccttcctggcgttaggatttttcctccgcaaactgactagccgagaaaaccttctgctaggcgtgggcctcgccatggcaacaaccctgcaattgccggctgatattgagcagatggccaatgggatcgccctgggattaatggctctcaagctgattacacagtttgaaacttatcagctttggaccgcactgatctctttgacgtgttccaacacaatattcaccctcactgtcgcctggcggaccgcgacactgatcctagctggtgtgtcactgcttcctgtttgccaaagtagctcgatgcgtaaaactgactggctcccaatgaccgtggccgcaatgggcgtccagcccctgcctttgtttattttctccctgaaggatacgttaaagagaaggtcttggcccctcaatgagggggtaatggccgtgggactggttagcatccttgcttcaagtctgttgcgcaacgacgtgccaatggcaggccctctcgtcgccggtgggctgctaattgcgtgttacgtgatcacaggaacctccgctgatctgactgtagagaaagccgcagacgtgacatgggaagaggaagccgagcagaccggcgtctctcataaccttatgataactgttgacgatgacggcacaatgcggattaaggatgacgaaaccgagaatatcctcacggtgctgttgaaaactgctttactgatcgtgagcgggatttttccctactccataccagccaccctcctggtctggcacacatggcagaagcaaacccagagatcaggagtgctttgggatgttccgagccctcccgagacacagaaagcagaactggaggaaggtgtatataggatcaagcagcaaggcattttcgggaaaactcaggtgggagtcggcgtgcagaaggagggtgtttttcataccatgtggcacgtgacgcgaggggctgtcttgacatacaacggaaagcgcctagagccaaattgggccagtgtgaaaaaggacctgatctcttatggcggcgggtggcggctctccgcgcaatggcagaaaggagaagaggtacaggtcattgccgtggaacccggtaagaaccctaaaaatttccagactatgccaggcaccttccaaacaaccactggggagatcggagcaatagctctggattttaagcccggcaccagcggttcgcctatcattaacagagaagggaaggttgtgggactttacggcaatggcgtcgtgacaaaaaacgggggatatgtttcaggtatcgcccagacgaatgctgagccggacggcccaactcccgagttagaagaggaaatgttcaagaaaaggaacctgaccattatggatctccaccctgggtctggaaagacacgtaaatacttgccagcaatcgtgcgcgaggccataaagcggagactgaggaccctcattctggcccccactcgagtcgtggctgcggaaatggaggaggcacttaagggcctgcctatccggtatcagacaaccgccacgaaaagtgaacatactggtcgcgagatcgtagacttgatgtgccacgctacatttaccatgagactactgtccccggtgagggttcccaattacaacctcattatcatggatgaagcccatttcaccgacccagcaagcatagccgctcgggggtacatttctactcgagtcggaatgggcgaggcggccgcaatctttatgacagctacccctcccggcacagccgatgcattcccacagagcaatgcccctattcaagacgaagagagagacatccccgagcgctcctggaactcagggaatgaatggataactgattttgctggaaagacggtgtggttcgtgccaagtattaaagccggtaacgacatcgcgaactgtttaaggaagaatggcaaaaaggtcatccagctgagccgtaagacctttgatacagagtatcagaaaactaagcttaacgactgggatttcgtagtgaccacagacatttctgaaatgggggcaaattttaaagccgatcgggttatcgacccgagaaggtgcctgaagcctgtgattctcaccgatggacccgagcgcgtcatattggctggcccaatgcccgtgactgccgcttccgcagcccagcgaagaggtcgggttgggaggaaccctcaaaaagagaatgaccagtacatcttcacgggccagccactgaacaatgatgaagaccacgctcattggaccgaggccaagatgctcctggacaacattaatacacccgaaggaatcatccctgcacttttcgagccggaacgcgagaagtcagcggccattgatggcgagtatcgtctaaaaggggaaagtagaaagacttttgtggagctgatgcggaggggagacttgccagtctggttagctcacaaagtggccagcgaaggtataaagtacaccgatcgcaaatggtgcttcgacggccagcgaaacaatcaaatcctggaggaaaacatggatgtagagatttggacaaaggagggggaaaaaaagaagctcagaccccggtggctggacgcaaggacctattccgatcctcttgctctgaaagagtttaaggacttcgccgcaggacgcaaatctatcgccctcgatttggtgactgaaattggcagagttccctcgcacctggctcataggacacggaatgcgctagacaacctggtcatgctccacacgagcgagcatggtgggcgtgcctaccgccacgcagtggaagagcttccagagaccatggaaactctgttattgctgggcctcatgatcctgcttacaggaggcgctatgctgtttctcatatcagggaagggaatcggtaaaacctccattggcttgatctgtgtgattgccagttctgggatgctgtggatggccgagatccctttacagtggatagcaagcgctattgtcctagaattctttatgatggttctgctcatccccgagccagagaagcagcgaacccctcaagataatcagcttgcctatgtggtaattggaatcctgacattggcggctataatcgccgcaaacgaaatgggcctgctcgagactacgaagaaagacctgggtatgtccaaggaaccgggggtggtctcatctaccagctaccttgatgtggacctccaccccgccagtgcttggacactgtacgcagttgccactaccgtgattacaccaatgttgagacataccatcgagaattccactgcgaacgtcagcctggctgccattgcaaaccaggccgtagtgttaatgggcctagacaaaggatggcctatctctaagatggatctgggcgttcccctccttgctctggggtgctattcacaggtgaatccattgacgctgacagccgcagtcctcctgcttataacccactacgctattatcggacctggcttacaagccaaagcgactagggaagcccagaagcggaccgcagctggtatcatgaagaaccccacagtggacgggattatgactatcgatctggacccggtcatatatgattccaaattcgagaagcagctcggacaggtgatgttgctggttctatgtgccgtgcaactgctccttatgcgcaccagttgggcactgtgcgaggctttgacactggccacgggcccaattaccactctctgggaaggtagccctggcaaattttggaatacaaccatcgccgtatcgatggcgaacattttcagagggtcttacctggctggagcaggcttagccttttccatcatgaagagcgtggggactggaaaaaggggcacaggttcacagggggagacccttggagaaaagtggaagaaaaagctgaatcagctcagtcggaaagagttcgacctatataagaaatctggcataacggaagtcgatcgaaccgaggctaaggagggtctgaaaagaggcgaaatcacacatcacgccgtttcccgcgggagcgcaaagttgcagtggtttgtggagaggaacatggtcattcccgaaggacgggtgatcgacctgggctgtgggcgtggaggctggtcatactattgcgccggtctcaagaaagtaactgaggtgagagggtacaccaagggaggcccaggccatgaagagcccgttcctatgagtacatacgggtggaatattgtgaaacttatgactggaaaggatgtcttctatctgccgcccgagaaatgtgacaccttgctgtgcgatatcggtgaaagctccccatctcctacagtggaggaaagcaggaccattcgcgtcctcaagatggtggagccctggttaaagaacaatcaattctgtatcaaagttctgaacccttacatgccaactgtaatagagcaccttgaacggctgcagcgaaagcacggcgggatgctagtgagaaatcccctctccaggaactcaacgcatgagatgtattggatttctaatggaacaggcaacatcgtcgctagtgtgaatatggtttcgcgcctgttgctgaaccggtttaccatgactcacagacgtcctaccatcgaaagggacgtggatctcggtgcggggacacggcatgtcaacgccgagccagaaacgcccaatatggacgtgattggagagcgcataaaacgaatcaaggaggaacacaacagcacctggcactacgacgatgagaatccgtataaaacttgggcataccatggctcctatgaagtaaaggctacaggctctgcctcaagcatgattaacggggtggttaagcttctgaccaaaccttgggacgtcgtgccaatggtgactcagatggcaatgacagataccacacccttcggacaacagagagtctttaaggagaaagttgacactaggacccctcggtccatgccaggtacgcgcaaggtgatgggcatcaccgccgaatggttatggagaacactggggaggaataaaaagccccgattgtgcactcgggaggagttcaccaagaaagtacgtacaaacgctgccatgggagcggtgtttactgaagagaatcagtgggatagtgcaaaggccgctgtcgaagacgaggaattctggaaactcgtggatagagagcgcgagctgcacaagctaggcaaatgtggttcttgcgtttacaacatgatggggaagagggaaaaaaagcttggagagtttggcaaggccaaaggcagccgggcaatttggtacatgtggctgggggctagatatctcgaattcgaggccctgggatttttgaatgaggaccattggttctcacgcgaaaactcctacagtggtgtggagggcgaagggctgcacaagctcggatatatccttagggatataagcaccatcccgggcggtgctatgtacgccgacgatacggcagggtgggacacacgaattaccgaggacgatctgcataatgaagagaaaatcactcagcaaatggaccctgagcaccggcagttagcgaacgccatttttaagctgacatatcagaataaagtcgtgaaggtacagagacccaccccaactggaaccgttatggatatcatatctaggaaggaccaacgcggctccggccaggtggggacatacggattgaacacgttcaccaatatggaagctcagctcattcgtcagatggagggtgaaggcgtcctgtcaaaagccgatctagagaaccctcaccttcccgaaaagaaaatcactcaatggctggagacaaagggggtggagcggctcaaaagaatggcaatcagcggagacgattgcgtggtcaagccaattgacgataggtttgctaacgccctgttggcattaaatgacatgggcaaggttcgcaaagatataccccagtggcagccttcgaagggttggcatgactggcagcaagtgccattctgttctcaccatttccacgaactgatcatgaaagatgggcgaaagctcgtagtgccgtgccggccccaggacgagcttattggaagagccaggatcagtcagggcgcgggctggtccctgcgcgaaaccgcttgtctagggaaagcctatgcacaaatgtggagcctgatgtactttcacagacgggacctcaggttggcctcaaacgctatttgctccgccgtccctgtgcattgggttccaacttctcgtacaacctggagcatccacgcacatcaccagtggatgacgacagagaatatgctgaccgtgtggaaccgagtctggatagaagataatccctggatggaggacaagactcctgtgaccacatgggagaacgtaccataccttggaaagcgcgaagatcagtggtgtggtagtctgatcggcctcacttccagagctacctgggcccagaatattcccacagcgatccaacaggttcggagcttaattgggaacgaggaattcctggactatatgccttctatgaaaaggtttcgcaaggaggaggaatcagagggagctatctggtga

SEQ ID NO: 15260 - RNA, 9873 nt, synthetic construct
  misc_feature 1..9873: note = derived and/or modified CDS sequence (opt3) from DENV-3__FJ882575__SS-prME
  source 1..9873: mol_type = other RNA
accagcctgtgcctcatgatgatccttcccgccacactggctttccacttgacttccagagacggcgagcctaggatgattgtggggaagaacgaacggggaaaatctttactgtttaagacggcatcaggtataaatatgtgtaccctaatcgccatggatctcggcgagatgtgcgacgatacagtcacttacaaatgtccacatattaccgaagttgagccggaagacatcgattgctggtgtaacctgacaagtacctgggtgacttatgggacatgcaatcaggcgggagagcaccgccgagacaagcgtagcgtagctcttgccccccatgtgggcatgggtctggataccagaacgcaaacttggatgtccgcagagggggcctggaggcaggtcgaaaaagtggagacctgggctttgcggcaccctggattcacaattctcgcactgtttctggcccattacatcggcacttctctcacccagaaggttgtgatattcatcttactgatgcttgtcacaccatcgatgaccatgcgctgtgtgggcgtagggaacagagactttgttgaaggattgtcaggtgctacgtgggtggatgtcgtgctggagcacggcgggtgcgtgactacaatggccaagaataaacccaccctagacattgagctccagaagactgaagcgacacaactggcaacccttaggaaactgtgtatcgagggaaagattacgaacatcaccacagatagccggtgccctactcagggcgaagccgtcttgccagaggaacaggaccagaattatgtttgtaaacacacctacgtggatcgcggttgggggaacggatgcggcctcttcggcaaggggagtctggtaacatgcgctaagtttcaatgtttagagcccatagagggaaaagtggtccagtatgaaaatctgaagtacactgtgattatcaccgttcatacaggtgaccagcaccaggtgggcaacgagacccaaggggtcactgccgaaattacgcctcaggcatccacaaccgaggctatcctcccagaatatggaactcttggcctggagtgctctccgcgaaccggtttggacttcaatgagatgatcctactgacaatgaaaaacaaggcctggatggtgcatagacagtggtttttcgatctccccctgccttggaccagcggggcgactacagaaacgccaacctggaataggaaagagcttctggtaacttttaagaacgcccacgcaaaaaagcaagaagttgtggtcttgggctcccaggagggagctatgcacacagccctcaccggcgctacagaaattcagaattcagggggaactagtatattcgccggtcatctgaagtgtcggttaaaaatggacaagctggagctaaaaggcatgagctacgcaatgtgcaccaacacgtttgtgctcaagaaagaggtctctgaaacccagcacgggacaatcctgattaaggtggagtacaagggagaagatgccccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcatcctcaactccctgggtaagatggttcaccagatttttgggagcgcctacacggcacttttctcgggcgtgtcttgggtcatgaaaatcggaatcggcgtgctgttgacatggattgggctcaattccaagaacacctcaatgagttttagctgcatagcgatcggaattatcactctgtatttaggcgctgtagtgcaggccgacatgggttgtgttattaattggaaagggaaggagctgaagtgcggatccggcatcttcgtcacaaacgaggtgcatacctggactgaacagtacaaatttcaagcagattctcccaagcggctagccaccgctatagccggtgcatgggagaatggcgtgtgtgggatccgaagcacaacgcgcatggaaaacctcctgtggaaacagattgctaatgagcttaactatatcttgtgggaaaataacattaagctgaccgtcgttgtgggagacactatcggcgtgctcgagcaggggaaaagaacactgaccccacagcctatggagttaaagtactcatggaaaacatggggaaaggccaagatagtaactgcggaaacccaaaacagttccttcattatcgatggccccaatacgccagagtgccccagcgcctctagggcttggaacgtctgggaagtggaggactatggttttggggttttcacaaccaatatttggctgaaacttcgggaagtgtacactcagttgtgtgaccaccgcctcatgtcagcagccgtcaaggatgagagagctgtgcacgccgacatgggatactggatcgagagtcagaaaaacggcagctggaagctggaaaaagcatccctaatagaggttaagacctgcacatggcctaagtctcatactctgtggtcgaatggtgtgctcgaaagcgatatgatcattccaaaatccctggcgggcccgatctcacagcacaactataggcccgggtaccatacccaaacagccggaccttggcaccttggcaagttggagctggactttaattattgcgaggggacgaccgtagtcattactgaaaactgtggaacacgtggcccaagtttacggaccactacagtgtctggtaaactcatccacgagtggtgctgtcgaagctgcaccctgccccctcttagatacatgggggaagatggatgttggtatggcatggagataaggccaatttccgaaaaggaggagaatatggtgaaatcactggtcagcgctggttctggcaaggttgacaacttcacgatgggggtgttgtgcctcgccatcctgtttgaagaggtaatgcgcggaaagttcggcaaaaagcatatgatcgcaggggtgttctttactttcgtcctactgctctccggacagattacctggcgggatatggctcacacactgatcatgattggcagtaatgccagcgacagaatgggtatgggggtgacctaccttgcattgatagccacttttaaaatccagcccttcctggctttaggatttttcctcaggaagctgacatctcgcgaaaaccttctgctaggcgttggcctcgcgatggccaccacactgcaattgccggaggatattgaacagatggcaaatgggatcgctctgggattaatggccctcaaactgattactcagtttgagacctatcagctttggacggccctgatctccttgacatgttcaaacaccatattcactctcaccgtggcttggcgaacagcaactctgatcctagccggtgtcagtctgcttcctgtgtgccaaagctcgtccatgcggaagaccgactggctcccaatgacggttgcggctatgggcgtgccccctctgcccttgtttattttctctctgaaggatacattaaaacgtagaagctggccactcaatgagggggtcatggccgtaggactggtgtcaatccttgcaagttccctgttgaggaacgacgttcctatggccggccccctcgtggctggtgggctgctaattgcatgttacgtcatcaccggaacttctgccgatctgacagtggaaaaggcggctgacgtaacctgggaggaagaggccgaacagactggcgtgagccataaccttatgataacagtcgacgatgacggcaccatgcgcattaaagatgacgagacggagaatatcctcactgttctgttgaagaccgcattactgatcgtgtccgggatttttccatactcaataccggccacactcctggtgtggcacacctggcagaaacagacacaacggagcggagtcctttgggatgtgcctagtcccccagaaactcagaaggctgagctggaagagggtgtttatagaatcaaacagcagggcattttggggaagacccaagtaggagtgggcgtccagaaggagggtgtgttccatacgatgtggcacgttacaaggggggccgtgctaactcacaacggaaaacgactggaacccaattgggcatctgtcaagaaagacctcatctcctacggcggcgggtggcgcctgagcgctcagtggcaaaagggagaggaagtgcaggtaattgccgtcgagcctggtaaaaacccaaagaattttcagaccatgcccggcacattccagaccactaccggggaaatcggagcgatagcccttgatttcaagcctggcacatcgggttcaccgatcattaaccgggaggggaaagtggttggattatatggcaatggcgtggtcacgaagaacgggggatacgtgtctggtatcgcacaaactaatgctgagccagacggccccacccctgaactggaggaagagatgtttaaaaagagaaacctcacaattatggatttgcatccagggagtggaaaaaccaggaagtatctgcccgccatcgttcgtgaagctataaagcgccggctcagaactctgattcttgcacctacaagggtggtcgccgccgagatggaggaagctctgaaaggcttgccgatccgataccagaccacggcgactaagtccgagcacacaggtcgggaaatcgtggacctaatgtgccatgcaaccttcaccatgcgcctgctcagccccgtaagagtgccaaattataacttaattatcatggatgaggcccactttactgaccctgcttctatagccgcaagggggtacattagcacacgggttggaatgggcgaagccgctgcgatcttcatgaccgccacacccccaggcactgcagatgcttttcctcagtccaatgcccccattcaggacgaggagcgagacatcccagaaagatcatggaacagtgggaatgagtggataacggatttcgcaggaaaaaccgtctggtttgtgccgagcattaaggccggtaacgacatcgctaactgtctgcgcaaaaatggcaagaaggtgatccaactttctaggaaaacattcgatactgaataccagaagaccaaactgaacgactgggattttgtcgtaacaaccgacatttccgagatgggggccaatttcaaggcggatcgtgtgatcgaccctcggagatgcctcaaacccgttattttgactgatggaccagagagggtgatactggcaggccccatgcctgtcacggccgcttcagccgctcagcgccgaggtagagtggggcggaacccacagaaggaaaatgaccaatatatctttaccggccagcccctcaacaatgatgaggaccatgcacactggacagaagccaagatgctgcttgacaacattaatactcctgagggaatcatcccggctctattcgaaccagagagggagaaaagtgccgcaattgatggcgaataccgcctgaagggggagagccgtaaaaccttcgttgaattgatgagacggggagacttacccgtgtggctggcgcacaaggtcgcctccgagggtataaaatatacagataggaagtggtgctttgacggccagcgcaacaatcagatcctcgaagagaacatggatgtggagatttggaccaaagaaggggagaagaagaaactgcgacctagatggcttgacgctcggacttactctgatcccctggccctcaaggaattcaaagactttgcagctggaaggaagtcgatcgccttggatctggtaacagagattggccgcgtgccaagccatctagcacacagaacgaggaatgccctggacaacctcgttatgcttcatacctcagaacacggtgggcgggcttatcgtcacgcggtcgaggagctgcctgaaactatggagacattattgctgctcggcctgatgatccttctgaccggaggcgccatgctcttcttgatatccgggaaaggaatcggtaagaccagtattggcctgatctgtgtgattgcatctagcgggatgttatggatggctgaaatccccctacaatggatagcctccgccattgtgctggagtttttcatgatggtcctccttatcccagagcctgaaaagcagcgcacaccgcaggataatcaactggcatacgttgtgattggaatcttgactctggctgccataatcgcggctaacgagatgggcctcctggaaacgaccaaacgagaccttggtatgtcaaaggagcccggggtagtgtctccaacaagctatctcgatgtcgacctgcatcctgccagtgcatggactttgtacgccgtggctaccacagttattacccccatgctgagacacactatcgaaaattccacggcaaacgtgagcttagccgcgattgctaaccaggccgtcgtactaatgggcctggacaaaggatggccaatctctaagatggatctcggcgtgcctcttctggcattggggtgctactcacaggttaatcccctgacactcaccgccgctgtgctgcttttaataactcattatgccattatcggaccgggcctgcaggcaaaagctaccagggaggcccaaaagcggacagcggccggtatcatgaagaacccaactgtcgacgggattatgaccatcgatctcgaccctgtgatatacgattccaaatttgagaagcagttgggacaggtcatgctgctagtgctgtgtgcagttcagctccttctgatgcgcacaagttgggctttgtgcgaagccctgacgctcgcaaccggccccattactacactgtgggagggtagcccaggcaaattctggaataccactatcgctgtgtcgatggccaacatttttagagggtcttatttagccggagcgggccttgctttctccatcatgaagagcgtagggacaggaaaaaggggcaccggttcacaaggggaaacgctgggagagaagtggaagaaaaagctcaatcagctaagtcggaaagaatttgacctgtacaagaaatctggcataaccgaggtggatcgaacagaggcaaaggaaggtttgaaaagaggcgagatcactcaccatgccgtctcccgcgggagcgctaagctgcagtggttcgttgaaaggaacatggtgattcccgagggacgggtcatcgacctcggctgtgggcgtggaggctggtcatattactgcgccggtcttaagaaagtgaccgaagtaagagggtatacaaagggaggccctggccacgaggagccggtgcccatgagtacttacgggtggaatattgttaaactgatgagcggaaaggatgtgttttacttgccacctgaaaaatgtgacaccctgctctgcgatatcggtgagtcctctcccagccctacagtcgaagagtccaggaccattcgcgtgttaaagatggtcgagccatggctgaagaacaatcagttctgtatcaaagtgcttaacccctatatgcctactgttatagaacacctggagcggctacaacgaaagcatggcgggatgctcgtaagaaatccactgtcaaggaactctacgcacgaaatgtactggattagtaatggaacaggcaacatcgtgtcgagcgtcaatatggtgtcccgcttgctgctcaaccggttcaccatgactcatagacgtcccaccatcgagaaagacgttgatcttggtgcagggacaaggcacgtggacgccgaaccggagacgcctaacatggacgtcattggagagcggataaagcgcatcaaagaagagcacaattctacctggcattatgatgacgaaaacccatacaagacttgggcttatcacggctcatacgaggtgaaggcgacaggcagcgcctccagtatgattaatggggtagtgaaactgttaaccaagccctgggatgttgtccctatggtgactcagatggcaatgacagacaccacaccatttggacagcaacgagtgttcaaagaaaaggtcgatactagaacccccaggccgatgcctggtacgcggaaagttatgggcatcaccgctgagtggctgtggcgcacattggggagaaacaagaggccccgactctgcactcgggaggaatttaccaagaaagtgcgtacaaatgccgcaatgggagccgtattcactgaggaaaaccagtgggactctgctaaggccgcggtggaggatgaagagttttggaaactggtcgacagagagcgcgaactacataagcttggcaaatgtggtagctgcgtgtataatatgatggggaagagggagaaaaagctgggagaattcggcaaggcaaaaggctcacgggccatttggtacatgtggctcggggctagatacctggagtttgaggccttgggattcctgaacgaagatcactggttttcccgcgagaatagttatagcggtgttgaaggcgaggggctccataagcttggatacatcctgagggacatatctaaaatcccaggcggtgcaatgtatgctgatgacaccgccgggtgggacacgcgaattacagaagatgacttacacaacgaggagaagatcacccagcagatggatcctgaacaccggcaactggctaatgccattttcaaattgacttaccagaacaaggtggtcaaggtgcagagacccacaccaaccggaactgtaatggacatcatatccaggaaagatcagcgcggctcaggccaagttgggacctatggactcaatacatttacgaacatggaggcacagctggtgcgtcagatggaaggtgagggcgtcctaagcaaggcggaccttgaaaatccccatctgcctgagaaaaagattacccagtggctcgagactaaaggggtggaacggctgaagagaatggccatctcgggagatgactgcgtggtcaagccaatcgatgacaggttcgctaacgccttgttagcactgaacgatatgggcaaagttcgcaaggacattccgcaatggcagccctctaaaggttggcacgattggcagcaggtgcctttttgtagtcatcacttccacgagctcataatgaaggacgggcgaaaacttgtagtgccatgccggccccaagacgaactgatcggaagagctaggatttcccagggcgccggctggagcctacgcgagacagcatgtctggggaaggcctacgcgcagatgtggtcactcatgtatttccatagacgggatttgaggctggcttccaatgccatctgctctgcagtccctgtgcactgggttccaaccagccgtactacatggagtattcatgcccaccatcaatggatgaccacggaagacatgcttacagtgtggaaccgagtctggatcgaggataatccctggatggaggacaagacccctgtgactacctgggaaaacgtaccgtacctgggaaaacgcgaggatcagtggtgtggttccctcataggcttaacaagcagagctacttgggcccagaatatcccaaccgcaattcagcaagttcggtctctgatcgggaacgaagagtttttggactacatgccctcaatgaagaggttccgcaaagaggaagagagtgaaggagctatttggtga

SEQ ID NO: 15261 - RNA, 9873 nt, synthetic construct
  misc_feature 1..9873: note = derived and/or modified CDS sequence (opt3) from DENV-3__GQ199886__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatggggctcaattccaagaacacatcaatgagttttagctgcatcgcgattggaataatcaccctgtatttaggcgctgttgtccaggccgacatgggttgtgtgattaattggaaagggaaggagctgaagtgcggatccggcatcttcgtgactaacgaggtccatacatggaccgaacagtacaaatttcaagcagattctcccaagcggctagccactgctattgccggtgcatgggagaatggcgtttgtgggatccgaagcaccacacgcatggaaaacctcctgtggaaacagatagctaatgagcttaactatatcttgtgggaaaataacattaagctgacggtggtggtaggagacaccatcggcgtcctcgagcaggggaaaagaactctgacaccacagcctatggagttaaagtactcatggaaaacctggggaaaggccaagattgtgacagcggaaactcaaaacagttccttcatcatagatggccccaataccccagagtgccccagcgcctctagggcttggaacgtttgggaagtggaggactatggttttggggtcttcacgacaaatatttggctgaaacttcgggaagtgtacacccagttgtgtgaccaccgcctcatgtcagcagccgttaaggatgagagagctgtgcacgccgacatgggatactggatcgagagtcagaaaaacggcagctggaagctggaaaaagcatccctaattgaggtaaagacttgcacctggcctaagtctcatacactgtggtcgaatggtgtcctcgaaagcgatatgatcataccaaaatccctggcgggcccgatctcacagcacaactataggcccgggtaccatactcaaaccgccggaccttggcaccttggcaagttggagctggactttaattattgcgaggggacaacggtggtgattaccgaaaactgtggaactcgtggcccaagtttacggacaaccactgtctctggtaaactcatccacgagtggtgctgtcgaagctgcacactgccccctcttagatacatgggggaagatggatgttggtatggcatggagattaggccaatctccgaaaaggaggagaatatggttaaatcactggtgagcgctggttctggcaaggtagacaacttcaccatgggggtgttgtgcctcgccatactgtttgaagaggtcatgcgcggaaagttcggcaaaaagcatatgattgcaggggtgttctttacgttcgttctactgctctccggacagatcacttggcgggatatggctcacaccctgatcatgattggcagtaatgccagcgacagaatgggtatgggggtgacataccttgcattgatcgccacctttaaaattcagcccttcctggctttaggatttttcctcaggaagctgacttctcgcgaaaaccttctgctaggcgtcggcctcgcgatggccacaaccctgcaattgccggaggatatagaacagatggcaaatgggatcgctctgggattaatggccctcaaactgattacacagtttgagacttatcagctttggaccgccctgatctccttgacgtgttcaaacacaattttcaccctcactgtggcttggcgaaccgcaacactgatcctagccggtgttagtctgcttcctgtgtgccaaagctcgtccatgcggaagactgactggctcccaatgaccgtcgcggctatgggcgtaccccctctgcccttgtttatattctctctgaaggatacgttaaaacgtagaagctggccactcaatgagggggtgatggccgttggactggtgtcaatccttgcaagttccctgttgaggaacgacgtccctatggccggccccctcgtggctggtgggctgctaattgcatgttacgtaatcacaggaacctctgccgatctgactgtggaaaaggcggctgacgtcacatgggaggaagaggccgaacagaccggcgttagccataaccttatgattactgtggacgatgacggcacaatgcgcatcaaagatgacgagaccgagaatatactcacggtgctgttgaagactgcattactgattgtctccgggatctttccatactcaatcccggccaccctcctggtgtggcacacatggcagaaacagacccaacggagcggagttctttgggatgtacctagtcccccagaaacacagaaggctgagctggaagagggtgtgtatagaattaaacagcagggcatattcgggaagactcaagtcggagtgggcgttcagaaggagggtgtgtttcataccatgtggcacgtcacgaggggggccgtgttgacatacaacggaaaacgactagaacccaattgggcatctgtaaagaaagacctgatctcctatggcggcgggtggcgcctcagcgctcagtggcaaaagggagaggaagtccaggtgattgccgttgagcctggtaaaaacccaaagaatttccagactatgcccggcaccttccagacaaccactggggaaatcggagcgattgccctggattttaagcctggcacctcgggttcaccgatcataaaccgggaggggaaagtggtcggactttacggcaatggcgtggttacaaagaacgggggatatgtgtctggtatcgcacaaacgaatgctgagccagacggccccactcctgaattagaggaagagatgttcaaaaagagaaacctgaccattatggatctccacccagggagtggaaaaacaaggaagtacttgcccgccatcgtccgtgaagctattaagcgccggctgagaaccctcatcctggcacctactagggtggtagccgccgagatggaggaagctcttaaaggcctgccgatacgatatcagacaaccgcgacgaagtccgagcatactggtcgggaaattgtggacttgatgtgccacgcaacatttaccatgcgcctactgagccccgttagagtcccaaattacaacctcatcatcatggatgaggcccatttcaccgaccctgcttctattgccgcaagggggtacatcagcactcgggtgggaatgggcgaagccgctgcgatatttatgacagccacccccccaggcacagcagatgctttccctcagtccaatgcccccattcaggacgaggagaaagacatcccagaacgatcatggaacagtgggaatgagtggattactgattttgcaggaaagacggtgtggttcgtcccgagcatcaaagccggtaacgacatagctaactgtttaagaaagaatggcaagaaagtaattcaactgtctcgcaagacctttgatacagaatatcagaaaactaagcttaacgactgggatttcgtggttaccacagacatctccgagatgggggccaattttaaagcggatagggtgatcgaccctcgtcggtgcctgaagcccgtcattctcaccgatggaccagagagagtgatcttggcaggccccatgcctgttactgccgcttcagccgctcagaggcgcggtcgagtggggagaaacccacagaaggaaaatgaccaatacattttcacgggccagcccctgaacaatgatgaggaccacgcacattggaccgaagccaaaatgctcctggacaacataaatacacctgagggaatcattccggctcttttcgaaccagagcgggagaagagtgccgcaatcgatggcgaatataggctaaaaggggagagccgcaagacttttgtcgaactgatgcgtagaggagacttgcccgtgtggttagcgcacaaagtagcctccgagggtatcaagtacaccgatcggaaatggtgcttcgacggccagaggaacaatcagattctggaagagaacatggatgtggagatatggacaaaggaaggggagaagaaaaagctccgccctcgatggctggacgctagaacctattctgatccccttgccctgaaagaatttaaggacttcgcagctggacggaaatcgatcgccctcgatttggttactgagattggcagggtcccaagccacctggcacatcgcacaagaaatgccctagacaacctggtgatgctccacacgtcagaacatggtgggagggcttaccggcacgcggtggaggagcttcctgaaaccatggagactctgttattgctgggcctcatgatcctgcttacaggaggcgccatgctgtttctcatttccgggaagggaatcggtaagaccagtataggcttgatctgtgtcattgcatctagcgggatgctgtggatggctgaaatccccttacaatggattgcctccgccatcgttctagagttctttatgatggtgctgctcataccagagcctgaaaaacagcgtaccccgcaggataatcaacttgcatatgtagtgattggaatcctgacattggctgccattatcgcggctaacgagatgggcctgctcgaaactacgaagcgcgacctgggtatgtcaaaagagcccggggtcgtgtctccaaccagctaccttgatgttgacctccaccctgccagtgcatggacactgtacgccgtggctactaccgtcataacacccatgttgcgacataccatcgaaaattccactgcaaacgtaagcctggccgcgattgctaaccaggccgtggttttaatgggcctagacaagggatggccaatctctaaaatggatctgggcgtgcctctccttgcactggggtgctattcacaggtcaatcccttgacgctgacagccgctgtgctcctgcttattacccactacgccatcataggaccgggcttacaggcaaaggctactagagaggcccaaaagaggaccgcggccggtattatgaaaaacccaacagtcgacgggatcatgactatcgatctggaccctgtgatttatgattccaagttcgagaaacagctcggacaggttatgttgctggtgctatgtgcagtacagctgctccttatgcggaccagttgggctctgtgcgaagccttgacactggcaacgggccccatcaccactctctgggagggtagcccaggcaagttttggaatacaaccatagctgtgtcgatggccaacattttccgcgggtcttacctggccggagcgggcttagctttttccatcatgaaaagcgtcgggactggaaagagaggcacaggttcacaaggggaaacccttggagagaagtggaaaaagaaactgaatcagctcagtaggaaggaattcgacctatataaaaagtctggcattacggaggttgatcggaccgaggcaaaagaaggtctgaagcgaggcgagatcacacatcacgccgtgtccagagggagcgctaagttgcagtggtttgtcgaacgcaacatggtgatacccgagggaagggtaatcgacctgggctgtgggcggggaggctggtcatactattgcgccggtctcaaaaaggtgactgaagttcgtgggtacaccaaaggaggccctggccatgaggagccggtgcccatgagtacatacgggtggaatattgtcaagcttatgagcggaaaagatgtgttctatctgccacctgaaaagtgtgacactttgctgtgcgatatcggtgagtcctctcccagccctaccgtcgaagagtccagaacaattagggtgctcaagatggttgagccatggttaaaaaacaatcagttctgtatcaaggtactgaacccctacatgcctaccgtgattgaacaccttgagcgcctgcaacggaaacacggcgggatgctagtccgaaatccactctcaagaaactctactcatgaaatgtattggatcagtaatggaacgggcaacatagtggcatcggttaatatggtgagcaggctgttgctgaaccgctttacaatgacccaccggagacccactattgagaaggacgtcgatctcggtgccgggacccgtcatgtgaacgctgaaccggagacacctaatatggacgtaatcggagagaggatcaaacggattaaggaagagcacaactccacgtggcactacgacgatgaaaatccatataagacctgggcgtaccatggctcttatgaggtgaaagccactggctcagcaagctccatgataaacggggttgtcaagcttctgacaaaaccctgggacgtggtgcctatggtcacccagatggctatgactgatacaaccccattcggacagcaacgcgtttttaaggaaaaagtggacacacgaactcccagaagtatgccgggtaccaggcgggtaatgggcatcacggccgagtggttatggcgcaccctggggagaaataagaagcctaggttgtgcacacgagaggaattcactaaaaaggtgcggaccaacgcagccatgggagctgtctttacagaggaaaatcagtgggattctgccaaagcggcagtggaggacgaagatttctggaagctcgttgaccgtgagagagagctgcacaaactaggcaagtgtggtagctgcgtgtacaacatgatggggaaacgcgaaaagaagcttggagagtttggcaaagccaagggctcaagggctatttggtacatgtggctgggggcccggtatctcgaattcgaggcactgggatttttgaatgaggatcattggttctccagagaaaacagttacagcggtgtcgagggcgaagggctgcacaaactcggatatatccttcgcgacatttctaagatccccggcggtgctatgtacgccgatgacactgctgggtgggacaccaggataacggaggatgacctgcataatgaagagaaaatcacacagcagatggatccagagcaccgacaattagccaacgcaatttttaagctgacctatcagaataaggtggtaaaagttcagcggcctactcccacaggaaccgtgatggacatcatttccagaaaggatcagaggggctcaggccaagtcgggacttacggattgaacaccttcacaaatatggaagcgcagctcatccgccagatggagggtgaaggcgtgctgagcaaagccgacctagagaacccacaccttcccgaaaagaaaataacgcagtggctggagaccaagggggtggagcgtctcaagcggatggctatttcgggagatgactgcgtcgttaaacctatcgatgacagatttgccaacgcactgttggctttaaatgatatgggcaaggtgaggaaagacatcccacaatggcagccgtctaagggttggcatgattggcagcaggtacccttctgtagtcaccatttccacgaactgattatgaaagacgggcgcaagctcgtggtcccttgccgaccacaagacgagcttataggacgggccagaatctcccagggcgcaggctggagcctgagggaaactgcctgtctagggaaggcgtatgctcagatgtggtcactgatgtactttcaccgcagagatctccggttggcctccaacgcaatttgctctgccgtgcccgttcattgggtgcctacaagcaggaccacttggagtatccacgctcatcaccaatggatgacaaccgaggacatgctgacggtctggaatcgtgtgtggattgaagataacccatggatggaggacaaaacacccgtaaccacttgggagaatgttccttaccttggaaagcgagaagatcagtggtgtggttccctgatcggcctcaccagccgcgccacatgggcacagaacataccgactgctatccagcaagtgagatctttaattgggaatgaggaattcctggactatatgccatcaatgaaacggtttaggaaggaggaggaaagtgagggagccatctggtga

SEQ ID NO: 15262 - RNA, 9873 nt, synthetic construct
  misc_feature 1..9873: note = derived and/or modified CDS sequence (opt3) from DENV-3__FJ882576__SS-prME
  source 1..9873: mol_type = other RNA
accagcctgtgcctcatgatgatccttcccgcagctctggcattccacttgacatccagagacggcgagcctaggatgattgtggggaagaacgagcggggaaagtctttactgtttaagactgcatcaggtataaatatgtgtacgctaatcgcgatggatctcggcgagatgtgcgacgataccgtcacctacaagtgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatggccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccagctggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcaaaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgttccctgtaaaatccctttctccaccgaggacggccaaggtaaggcgcataacgggcgtcttataacagcaaatccagtggtaactaaaaaggaggaacccgtcaacattgaggccgaaccgcctttcggcgagtcaaatatcgtgatcggaattggcgataacgctttgaaaatcaattggtataagaaggggagcagtattggaaaaatgtttgaagccaccgcacgcggtgccagaaggatggctatactgggcgacacagcctgggatttcgggtctgttggaggcgtgctcaactccctgggtaagatggtccaccagatctttgggagcgcatacactgcgcttttctcgggcgtgtcttgggtaatgaaaattggaatcggcgtgctgttgacctggatcgggctcaattccaagaacacgtcaatgagttttagctgcattgctataggaatcattacactgtatttaggcgccgttgtccaggcagacatgggttgtgtgatcaattggaaagggaaggagctgaagtgcggatccggcattttcgtgaccaacgaggtccatacttggacagaacagtacaaatttcaagccgattctcccaagcggctagctaccgccatcgccggtgcttgggagaatggcgtttgtgggatacgaagcactacccgcatggaaaacctcctgtggaaacagatcgccaatgagcttaactatattttgtgggaaaataacatcaagctgacagtggtggtaggagacattatcggcgtcctcgagcaggggaaaagaacgctgaccccacagcctatggagttaaagtactcatggaaaacttggggaaaggcgaagatagtgacagccgaaacccaaaacagttccttcattatcgatggccccaatacaccagagtgccccagcgcttctagggcatggaacgtttgggaagtggaggactatggttttggggtcttcactaccaatatttggctgaaacttcgggaagtgtacacgcagttgtgtgaccaccgcctcatgtcagccgctgttaaggatgagagagccgtgcacgcagacatgggatactggatcgagagtcagaaaaacggcagctggaagctggaaaaagcgtccctaatagaggtaaagacatgcacctggcctaagtctcatactctgtggtcgaatggtgtcctcgaaagcgatatgatcattccaaaatccctggccggcccgatctcacagcacaactataggcccgggtaccatacccaaacagctggaccttggcaccttggcaagttggagctggactttaattattgcgaggggactaccgtggtgattacagaaaactgtggaacgcgtggcccaagtttacggaccactacagtctctggtaaactcatccacgagtggtgctgtcgaagctgcaccctgccccctcttagatacatgggggaagatggatgttggtatggcatggagataaggccaatttccgaaaaggaggagaatatggttaaatcactggtgagcgccggttctggcaaggtagacaacttcactatgggggtgttgtgcctcgcaatcctgtttgaagaggtcatgcgcggaaagttcggcaaaaagcatatgatcgctggggtgttctttacattcgttctactgctctccggacagattacctggcgggatatggcccacacgctgatcatgattggcagtaatgcaagcgacagaatgggtatgggggtgacttaccttgccttgatagctacctttaaaatccagcccttcctggcgttaggatttttcctcaggaagctgacatctcgcgaaaaccttctgctaggcgtcggcctcgccatggcaaccactctgcaattgccggaggatattgaacagatggctaatgggatcgccctgggattaatggccctcaaactgattacacagtttgagacctatcagctttggacagctctgatctccttgacttgttcaaacaccatattcacgctcacagtggcatggcgaaccgccactctgatcctagcgggtgttagtctgcttcctgtgtgccaaagctcgtccatgcggaagaccgactggctcccaatgacagtcgctgccatgggcgtaccccctctgcccttgtttattttctctctgaaggatactttaaaacgtagaagctggccactcaatgagggggtgatggcagttggactggtgtcaatccttgccagttccctgttgaggaacgacgtccctatggctggccccctcgtggccggtgggctgctaattgcctgttacgtaatcaccggaacgtctgcggatctgacagtggaaaaggctgccgacgtcacctgggaggaagaggcagaacagactggcgttagccataaccttatgataacagtggacgatgacggcaccatgcgcattaaagatgacgagactgagaatatcctcacagtgctgttgaagaccgccttactgatcgtctccgggatttttccatactcaataccggctacgctcctggtgtggcacacttggcagaaacagacccaacggagcggagttctttgggatgtacctagtcccccagaaacacagaaggccgagctggaagagggtgtgtatagaatcaaacagcagggcattttcgggaagacccaagtcggagtgggcgttcagaaggagggtgtgtttcatacaatgtggcacgtcactagaggggcagtgttggcttacaacggaaaacgactagaacccaattgggcctctgtaaagaaagacctgatctcctatggcggcgggtggcgcctcagcgcgcagtggcaaaagggagaggaagtccaggtgattgccgttgagcctggtaaaaacccaaagaatttccagaccatgcccggcacgttccagacaactaccggggaaatcggagcaatagctctggattttaagcctggcacatcgggttcaccgatcattaaccgggaggggaaagtggtcggactttacggcaatggcgtggttaccaagaacgggggatatgtgtctggtatcgcccaaactaatgctgagccagacggccccacccctgaattagaggaagagatgttcaaaaagagaaacctgacaattatggatctccacccagggagtggaaaaacgaggaagtacttgcccgcaatcgtccgtgaagccataaagcgccggctgagaactctcattctggcccctaccagggtggtagctgcggagatggaggaagcacttaaaggcctgccgatccgatatcagacaaccgccactaagtccgagcatacaggtcgggaaatcgtggacttgatgtgccacgctacctttacgatgcgcctactgagccccgttagagtcccaaattacaacctcattatcatggatgaggcccatttcactgaccctgcatctatagccgctagggggtacattagcacacgggtgggaatgggcgaagcggccgcaatctttatgaccgctacacccccaggcactgccgatgcattccctcagtccaatgcccccattcaggacgaggagcgagacatcccagaaagatcatggaacagtgggaatgagtggataacagattttgctggaaaaaccgtgtggttcgtcccgagcattaaggccggtaacgacatcgcgaactgtttacgcaaaaatggcaagaaggtaatccaactgtctaggaaaacatttgatactgaatatcagaagacgaaacttaacgactgggatttcgtggttaccacagacatttccgagatgggggcaaattttaaggccgatcgtgtgatcgaccctcggagatgcctgaaacccgtcattctcactgatggaccagagagggtgatattggctggccccatgcctgttaccgccgcttcagcagcccagcgccgaggtagagtggggcggaacccacagaaggaaaatgaccaatacatcttcacaggccagcccctgaacaatgatgaggaccacgctcattggaccgaagccaagatgctcctggacaacattaatactcctgagggaatcatcccggcacttttcgaaccagagagggagaaaagtgcggccattgatggcgaatatcgcctaaagggggagagccgtaaaacgtttgtcgaactgatgagacggggagacttgcccgtgtggttagctcacaaggtagcctccgagggtataaaatacaccgataggaagtggtgcttcgacggcgaacgcaacaatcagatcctggaggagaacatggatgtggaaatttggacaaaagagggggaaaagaagaaactccgacctagatggctggacgcacggacttattctgatccccttgctctgaaggagtttaaagacttcgccgcaggaaggaagtcgatcgccctcgatttggttaccgaaattggccgcgtcccaagccacctggctcatagaacaaggaatgcgctagacaacctggtgatgctccacacctcagagcatggtgggcgggcctaccgtcacgcagtggaggaacttcctgagactatggaaacactgttattgctgggcctcatgatcctgcttacgggaggcgctatgctgtttctcatatccgggaaaggaatcggtaagaccagtattggcttgatctgtgtcattgcctctagcgggatgctgtggatggccgagatccccttacagtggatagcatccgctattgttctagagttctttatgatggtgctgctcatcccagaacctgagaagcaacgcactccgcaggataatcagcttgcctatgtagtgattggaatcctgacattggcggctataatcgccgcaaacgaaatgggcctgctcgagaccaccaaacgagacctgggtatgtcaaaggaacccggggtcgtgtctccaacaagctaccttgatgttgacctccaccctgccagtgcttggactctgtacgcagtggccacgaccgtcattacacccatgttgagacatactatcgaaaattccaccgcgaacgtaagcctggctgccattgcaaaccaagccgtggttttaatgggcctagacaaaggatggccaatctctaagatggatctgggcgtgcctctccttgctctggggtgctattcacaggtcaatcccttgacactgaccgccgcagtgctcctgcttataactcactacgctattatcggaccgggcttacaggccaaagcgacgagggaggcccagaagcggacagcagctggtatcatgaagaacccaaccgtcgacgggattatgactatcgatctggaccctgtgatatatgattccaaattcgaaaagcaactcggacaggttatgttgctggtgctatgtgccgtacagctgctccttatgcgcaccagttgggcactgtgcgaggctttgacactggccactggccccattaccacactctgggaaggtagcccaggcaaattttggaatacgaccatcgccgtgtcgatggcgaacattttcagagggtcttacctggctggagcaggcttagccttttccatcatgaaaagcgtcgggactggaaaaaggggcacaggttcacagggggagacccttggagaaaagtggaagaaaaagctgaatcaactcagtcggaaagagttcgacctatataagaaatctggcataactgaggttgatcgaacagaagctaaggagggtctgaaaagaggcgaaatcacccatcacgccgtgtcccgcgggagcgcaaagttgcagtggtttgtcgagaggaacatggtgattcccgaaggacgggtaatcgacctgggctgtgggcgtggaggctggtcatactattgcgccggtctcaagaaagtgacggaggttagagggtacaccaagggaggccctggccatgaggaaccggtgcccatgagtacatacgggtggaatattgtcaaacttatgagcggaaaggatgtgttctatctgccacctgagaaatgtgacactttgctgtgcgatatcggtgaatcctctcccagccctaccgtcgaggagtccaggacaattcgcgtgctcaagatggttgaaccatggttaaagaacaatcagttctgtatcaaagtactgaacccctacatgcctactgtgatagagcaccttgaacggctgcagcgaaagcacggcgggatgctagtcagaaatccactctcaaggaactctacccatgagatgtattggattagtaatggaacaggcaacatcgtgtcgagcgttaatatggtgtcccgcctgttgctgaaccggtttaccatgactcacagacgtcccacgatcgaaaaagacgtcgatctcggtgctgggacaaggcatgtgaacgcggagccggagacccctaatatggacgtaattggagaacggataaagcgcatcaaagaggaacacaactctacttggcactacgacgatgagaatccatataagacctgggcctaccatggctcatatgaagtgaaggcaacaggcagcgcttccagtatgattaacggggttgtcaaacttctgacgaagccctgggacgtggtgcctatggtcacccaaatggccatgactgatacaaccccattcggacagcagcgagtttttaaagagaaggtggacactagaacacccaggtctatgccgggtacccggcgcgtaatgggcatcacagcagagtggttatggagaactctggggaggaataaaaagcctcgattgtgcacccgggaagagttcacgaagaaagtgcgtaccaacgccgctatgggagccgtctttacagaagagaatcaatgggatagcgcgaaggcagccgtggaagacgaggatttctggaaactcgttgacagagagcgcgaactgcacaagctaggcaaatgtggttcatgcgtgtacaacatgatggggaagagggagaagaaacttggagaatttggcaaagctaaaggctcccgggccatttggtacatgtggctgggggcaagatatctcgagttcgaggctctgggatttttgaatgaagatcattggttcagtcgcgagaacagctactctggtgtcgaaggcgaggggctgcacaagctcggatatatccttagggacatatccaaaatccccggcggtgccatgtacgctgatgacactgccgggtgggacacccgaattacagaagatgacctgcataatgaggagaagatcactcagcagatggatccagaacaccggcagttagcaaacgcgatttttaaactgacctatcaaaataaggtggtaaaggttcagagacctacgcccacaggaaccgtgatggacatcatatcaaggaaagatcagcgcggcagcggccaggtcgggacttacggattgaacacattcaccaatatggaggcccaactcattcgtcagatggaaggtgagggcgtgctgtcgaaggctgacctagaaaacccacaccttcccgagaaaaagatcactcagtggctggagaccaaaggggtggaacggctcaagagaatggccatctctggagatgactgcgtcgttaagcctattgatgacaggtttgcaaacgctctgttggccttaaatgatatgggcaaagtgcgcaaggacataccacagtggcaaccgagtaaaggttggcatgattggcagcaggtacccttctgttcccaccatttccacgagctgatcatgaaggacgggcgaaaactcgtggtcccttgccggccacaggacgaacttattggaagggcaaggatcagccaaggcgccggctggtcactgcgcgagacagcgtgtctagggaaggcttatgcccagatgtggtccctgatgtactttcacagacgggatctcaggttggcatctaacgccatttgcagcgctgtgcccgttcattgggtgcctacgagtcgtaccacttggtccatccacgcccatcaccagtggatgacaaccgaagacatgctgactgtctggaatcgagtgtggatagaggataacccatggatggaggacaagacacccgtaaccacgtgggaaaatgttccttaccttggaaaacgcgaggatcaatggtgtggtagcctgatcggcctcacatctagagcaacctgggctcagaacattccgactgccatccaacaggtgcggtcattaattgggaatgaagagttcctggactatatgccaagtatgaagaggtttcgcaaagaggaagagtccgaaggagcgatctggtga

SEQ ID NO: 15263 - RNA, 9873 nt, synthetic construct
  misc_feature 1..9873: note = derived and/or modified CDS sequence (opt3) from DENV-3__FJ850052__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagcaggtgttagtctgcttcctgtgtgccaaagctcgtccatgcggaagactgactggctcccaatggccgtcgcggctatgggcgtaccccctctgcccttgtttattttcgggctgaaggataccttaaaacgtagatcttggccactcaatgagggagtgatggccgttggcctggtgagcatccttgcatcaagtctgttgaggaacgacgtccctatggccggtcccctcgtggctgggggactgctaattgcatgttatgtaatcacgggcacatccgccgatctgaccgtggaaaaggcggctgacataacttgggaggaagaggccgaacagacaggcgtctctcacaaccttatgattaccgttgacgatgacgggactatgcgcatcaaagatgacgagacagagaatatcctcaccgtgctgttgaagacggcattactgattgtgagcggaatatttccatactccatcccggccactctcctggtctggcatacctggcagaaacagacacaacggtcaggtgtgctttgggatgttcctagccccccagaaacccagaaggctgagctggaagagggcgtatacagaattaaacagcaggggatcttcggaaagacacaagtgggcgtcggtgtgcagaaggagggggtttttcacactatgtggcacgtgaccaggggagccgtcttgacgtataacggcaaacgactagaacccaattgggcaagtgtgaagaaagacctgatttcttacggcgggggatggcgcctctccgctcagtggcaaaagggtgaggaagtacaggtcatcgccgtggagcctggcaaaaacccaaagaatttccagacaatgcccgggactttccagaccacaaccggagaaataggcgcgatcgccctggattttaagcctggtactagcgggtcgccgattatcaaccgggagggaaaagttgtgggcctttatggcaatggggtcgtgaccaagaacggaggttacgtttcaggcattgcacaaacaaatgctgagccagacgggcccacgcctgaattagaggaagagatgttcaaaaagagaaacctgactatcatggatctccatccaggatctggcaaaaccaggaagtatttgcccgccatagtgcgtgaagctattaagcgccggctgagaacactcatcctggcacctaccagggtcgtggccgccgagatggaggaagctcttaaaggtctgccgatccgataccagactacagcgaccaagagtgagcacacggggcgggaaattgtagacttgatgtgccatgcaacttttacaatgcgcctactgtcccccgtgagagttccaaattataacctcatcataatggatgaggcccacttcaccgaccctgctagcattgccgcaaggggatacatctctacccgggtcggcatgggcgaagccgctgcgatttttatgactgccacacccccagggaccgcagatgctttccctcagagcaatgcccccatccaggacaaagagcgagacataccagagagatcctggaactcaggaaatgaatggattacagattttgcaggtaagactgtgtggttcgtgccgagtatcaaagccggcaacgacatcgctaactgtttacgcaagaatgggaagaaagtcattcaactgagcaggaagacgtttgataccgagtaccagaaaacaaagcttaacgactgggatttcgtagtgactaccgacatctctgaaatgggagccaattttaaagcggatcgtgttattgaccctcggagatgcctgaagcccgtgatactcacagatggcccagagagggtcatcttggcaggtcccatgcctgtgaccgccgcttccgccgctcagcgccgagggagagttggccggaacccacagaaggagaatgaccaatatattttcactggacagcccctgaacaatgatgaagaccatgcacactggacggaggccaaaatgctcctggacaacatcaatacccctgaaggcatcattccggctcttttcgagccagaaagggagaagtcagccgcaatagatggggagtaccgcctaaaaggagaaagtcgtaagacatttgtggagctgatgagacggggtgacttgcccgtctggttagcgcacaaagtggccagcgaaggcatcaagtatactgataggaaatggtgcttcgacgggcagcgcaacaatcagattctggaggaaaacatggatgtagagatctggaccaaggagggagaaaagaaaaagctccgacctagatggctggacgctcggacatactccgatccccttgccctgaaagagtttaaggaattcgcagctggcaggaaatctattgccctcgacttggtgaccgagatcggtcgcgttccatcgcatctggcacacagaactaggaatgccctagataacctggtcatgctccatacaagcgaacacgggggccgggcttatcgtcacgcggtggaggagcttcctgaaacgatggagaccctgttattgctgggactcatgatactgcttactggcggggccatgctgtttctcatctcaggaaagggtattggcaagacatccatcgggttgatttgtgtgatcgcaagttctggaatgctgtggatggctgaaatacccttacaatggattgccagcgccatcgtcctagagttctttatgatggttctgctcattccagagcctgaaaaacagcgcaccccgcaggacaatcaacttgcatacgtggtaatcggcatactgaccttggctgccatcattgcggctaacgagatgggtctgctcgaaacaactaagcgagatctggggatgtccaaagagcccggcgtggtctcaccaacgtcttatcttgacgtggatctccatcctgccagcgcatggaccctgtacgccgttgctacaactgtgatcacccccatgttgagacacacaattgaaaatagtaccgcaaacgtctccctggccgcgatcgctaaccaggccgtagtgttaatgggactagacaagggctggccaataagcaaaatggacctgggggttcctctccttgcactgggatgctactctcaggtgaatcccttgactctgacggccgctgtcctcctgcttattacacattatgccatcatcggcccgggtttacaggcaaaggctaccagggaggcccaaaagcggactgcggccgggattatgaaaaacccaaccgtggatggaatcatgacaatagacctggatcctgtcatttacgactcaaagttcgagaaacagctcggccaggtgatgttgctggttctatgtgcagtgcagctgctccttatgcgcacttcctgggctctgtgcgaagccttgaccctggcaacaggtcccatcacgaccctctgggagggcagtccagggaagttttggaatactacaattgctgtaagcatggccaacatcttcagaggatcgtatctggccggcgcggggttagctttttctataatgaaatccgtgggaaccggcaagaggggtactgggagccaaggagaaacacttggcgagaagtggaaaaagaaactgaatcagctctcacggaaggatttcgacctatacaaaaagagtggtatcaccgaagtcgatcgaacggaggcaaaagagggcctgaagagaggggaaattacccaccatgccgtttctcgcggatccgctaagttgcagtggtttgtggagaggaacatggtcatccccgaaggccgggtgattgacctggggtgtggacgtggcggttggagctattactgcgccgggctcaaaaaggtaacagaggtgagaggatatactaaaggcggccctgggcacgaagagccggttcccatgtcaacctacggatggaatatcgtgaagcttatgagtggtaaagatgtcttctacctgccacctgagaagtgtgacacattgctgtgcgatattggcgaaagctccccctctcctactgtggaggaaagcaggaccatccgcgtcctcaagatggtggagccatggttaaaaaacaatcagttctgtataaaggttctgaacccctatatgcctacagtaattgagcaccttgaacggctgcaacgaaaacatgggggaatgctagtgagaaatccactctccaggaactcaacccacgagatgtactggatctctaatggcactggtaacatcgtcgcaagtgtgaatatggtttcgcgcctgttgctgaaccggtttacgatgacacatagacgtcccaccattgaaaaggacgtggatctcggggccggaactaggcacgtcaacgctgagccggaaacccctaatatggacgtgataggcgagcggatcaaacgcattaaggaggaacacaacagcacatggcattatgacgatgagaatccatacaagacgtgggcgtatcacggctcctacgaagtaaaagccaccgggtctgcatcaagcatgatcaacggagtggttaagcttctgactaaaccctgggacgtcgtgcctatggtgacacagatggctatgaccgatactacaccattcggtcagcaacgagtctttaaggagaaagttgacaccagaacacccaggtccatgccgggcactcggcgcgtgatggggattaccgccgaatggttatggagaacgctgggaaggaataagaagcctcgattgtgcacccgggaggagttcacaaaaaaggtacgtactaacgcagccatgggcgctgtgtttaccgaagagaatcagtgggatagtgccaaagcggcagtcgaagacgaggatttctggaagctcgtggacagagaacgcgagctgcataaactaggtaagtgtgggtcttgcgtttataacatgatgggaaaaagggagaagaagcttggcgaatttggcaaagccaaggggagccgggctatctggtacatgtggctgggagccagatacctcgagttcgaagcactgggttttttgaatgaggatcactggttctcacgcgagaactcctatagtggcgtggaaggggagggactgcataaactcggctacatacttagggacatcagcaagattcccggtggggctatgtatgccgatgacacagctggatgggacactcgaatcaccgaagatgacctgcacaatgaggaaaaaattacgcagcagatggatccagagcaccggcaattagccaacgcaatctttaagctgacataccagaataaggtcgtgaaagtacagagacctacccccactggcacagttatggacataatttctaggaaggatcagcgcggctccgggcaagtgggaacctatggtttgaacactttcaccaatatggaggcgcagctcatccgtcagatggaaggcgagggggtcctgtcaaaagccgacctagaaaacccacatcttcccgagaagaaaatcacacagtggctggaaacgaagggagtggagcggctcaagagaatggctattagcggcgatgactgcgtggtcaaacctatagatgacaggtttgccaacgcactgttggctttaaatgatatgggtaaggttcgcaaagacatcccacaatggcagccgtcgaaggggtggcacgattggcagcaggtgcccttctgttctcatcacttccacgagctgattatgaaagacggacgaaagctcgtagtgccttgccggccacaagacgaacttatcggcagagccaggattagtcagggcgcagggtggtccctgaaggagaccgcctgtctaggaaaagcgtacgctcagatgtggagcctgatgtattttcatcgcagagatctccggttggcctcaaacgcaatctgctccgccgtccccgtgcactgggttcctacttctaggacaacctggagcatacatgctcaccatcaatggatgactacagaagacatgctgaccgtgtggaatcgtgtctggatcgaggataacccatggatggaagacaagacgcccgtgacaacctgggagaatgtaccttaccttggtaaacgagaggatcagtggtgtggcagtctgattgggctcacttcccgcgccacctgggcacagaacatcccgacagctattcagcaagttagaagcttaatcggaaatgaagagttcctggactacatgccatctatgaagcggtttaggaaagaagaggagtcagaaggcgccatttggtga

SEQ ID NO: 15264 - RNA, 9873 nt, synthetic construct
  misc_feature 1..9873: note = derived and/or modified CDS sequence (opt3) from DENV-3__FJ873812__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatctcaaatgagcttaactatattttgtgggaaaataacatcaagctgaccgttgtggtgggagacattatcggcgtactcgagcaggggaaaagaactctgacaccacagcctatggagttaaagtacagttggaaaacctggggaaaggctaagatagtcacagccgaaactcaaaactccagcttcattatcgatggccccaataccccagagtgcccctctgtgtcaagggcgtggaacgtttgggaagtggaggactatggttttggggtcttcacgacaaatatttggctgaaacttcgggaagtgtacacccagttgtgtgaccaccgcctcatgagtgccgctgttaaggatgagagagcagtgcacgccgacatgggatactggatcgagagccagaaaaacggctcctggaagctggaaaaagcttctctaatagaggtaaagacttgcacctggcctaagtcgcatacactgtggagcaatggtgtcctcgaatccgatatgatcattccaaaatcactggccggcccgatcagtcagcacaaccataggcccgggtatcacactcaaaccgcaggaccttggcaccttggcaagttggagctggactttaattactgcgaggggacaacggtggtgattaccgaaaactgtggaactcgtggcccatctttacggacaaccactgtcagcggtaaactcatccatgagtggtgctgtcgatcctgcacactgccccctcttagatatatgggggaagatggatgttggtacggcatggagataaggccaatttcagaaaaggaggagaatatggttaaaagcctggtgtctgcgggttccggcaaggtagacaacttcaccatgggggtgttgtgcctcgccatcctgtttgaagaggtcatgcgcggaaagttcggcaaaaagcacatgatcgctggggtgttcctaacgtttgttctgctcctgagtggacagattacttggcgggatatggcccatacccttatcatgattggcagcaatgcatctgacagaatgggtatgggggtgacatatttggctctgatagccaccttcaaaatccagccctttttagcactcggattctttctgaggaagcttacttcccgcgaaaacctgctactcggcgtcggcctggccatggctacaaccttgcaactgccggaggatattgaacagatggcgaatgggatcgccttaggactcatggcactgaaacttattacacagttcgagacttaccagctgtggaccgctttgatctcactcacgtgtagtaacacaatatttaccctgactgtggcctggcgaaccgccacactaatcctggctggtgttagccttctccctgtgtgccaatcgtcctctatgcggaagactgactggctgccaatggcagtcgccgcgatgggcgtaccccctttgcccctgttcatttttagcttaaaggataccctcaaacgtagatcatggccactgaatgagggggtgatggctgttggacttgtgagtatcctggcctcctctttgctcaggaacgacgtccctatggcaggccccctggtggccggtgggctactgattgcttgttatgtaatcacgggaacaagcgcagatcttaccgtggaaaaggccgcggacataacttgggaggaagaggctgaacagacaggcgtctcccacaacctcatgattaccgttgacgatgacggcactatgcgcatcaaagatgacgagacagagaatatcctgaccgtgttgttaaagacggccctgctcattgtgtcagggatattcccatacagcatcccggcaactctgcttgtctggcatacctggcagaaacagacacaacggagtggagtgctgtgggatgttccttctcccccagaaacccagaaggccgagttggaagagggtgtatacagaattaaacagcagggcatctttgggaagacacaagtgggagtcggcgtgcagaaggagggtgttttccacactatgtggcacgtgaccaggggggctgtcctaacgtataacggaaaacgactggaacccaattgggcctccgtgaagaaagacctcattagctacggcggcgggtggcgcctgtcggcacagtggcaaaagggagaggaagtacaggtcatcgctgtggagcctggtaaaaacccaaagaattttcagacaatgcccggcactttccagaccacaaccggggaaataggagccatcgcgcttgatttcaagcctggcacttcaggttctccgattatcaaccgggaggggaaagttgtgggattatatggcaatggcgtcgtgaccaagaacgggggatacgttagtggtattgcccaaacaaatgcagagccagacggccccacgcctgaactggaggaagagatgtttaaaaagagaaacctcactatcatggatttgcatccagggtccggaaaaaccaggaagtatctgcccgctatagtgcgtgaagccattaagcgccggctcagaacactgatccttgctcctaccagggtcgtggcagccgagatggaggaagccctgaaaggcttgccgatccgataccagactacagctaccaagagcgagcacacgggtcgggaaattgtagacctaatgtgccatgcgactttcacaatgcgcctgctctctcccgtgagagttccaaattataacttaatcataatggatgaggcacactttaccgaccctgccagcattgctgccagggggtacatctccacccgggtcggaatgggcgaagcagccgctattttcatgactgcgacacccccaggcaccgccgatgcatttcctcagtcaaatgctcccatccaggacgaggagcgagacataccagaaagaagttggaacagcgggaatgagtggattacagatttcgccggaaaaactgtgtggtttgtgccgtctatcaaggcaggtaacgacatcgccaactgtctgcgcaaaaatggcaagaaggtcattcaactttccaggaaaacgttcgataccgaataccagaagacaaaactgaacgactgggattttgtagtgactaccgacatctcagagatgggggctaatttcaaggccgatcgtgttattgaccctcggagatgcctcaaacccgtgatattgacagatggaccagagagggtcatcctggcgggccccatgcctgtgaccgcagccagtgctgcccagcgccgaggtagagttgggcggaacccacagaaggaaaatgaccaatatatttttactggccagcccctcaacaatgatgaggaccatgctcactggacggaagcaaagatgctgcttgacaacatcaatacccctgagggaatcattccggccctattcgaaccagagagggagaaaagcgctgccatagatggcgaataccgcctgaagggggagtcccgtaaaacattcgtggaattgatgagacggggagacttacccgtctggctggcacacaaggtggcgtctgagggtatcaaatatactgataggaagtggtgctttgacggccagcgcaacaatcagattctcgaagagaacatggatgtagagatctggaccaaagaaggggagaagaagaaactgcgacctagatggcttgacgcccggacatactcggatcccctggctctcaaggaattcaaagagtttgccgcaggaaggaagagcattgctttggacctggtgaccgaaatcggccgcgttccatcacatctagcccacagaactaggaatgcactggataacctcgtcatgcttcatacatccgagcacggtgggcgggcctatcgtcacgctgtggaggaactgcctgagacgatggaaaccttattgctgctcggcctgatgatacttctgactggaggcgcgatgctcttcttgatcagtgggaaaggaattggtaagacatctatcggcctgatttgtgtgatcgccagctccgggatgttatggatggcagagatacccctacaatggattgcttcagccatcgtcctggagtttttcatgatggttctccttattccagaacctgagaagcagcgcaccccgcaggacaatcaactggcctacgtggtaatcggaatattgaccctggcagctatcattgccgcgaacgaaatgggcctcctggagacaactaaacgagatcttggtatgtctaaggaacccggggtggtcagcccaacgagttatctcgacgtggatctgcatcctgcttccgcctggaccttgtacgcagttgccacaactgtgatcacccccatgctgagacacacaattgagaatagcaccgctaacgtctctttagcagccatcgcgaaccaggctgtagtgctaatgggcctggacaaaggatggccaatatcaaagatggacctcggcgttcctcttctggccttggggtgctactcccaggtgaatcccctgactctcacggcagccgtcctgcttttaattacacattatgctatcatcggaccgggcctgcaggccaaagcaaccagggaggctcaaaagcggactgccgcgggtattatgaagaacccaaccgtggatgggatcatgacaatagacctcgatcctgtcatttacgacagtaaatttgaaaagcagttgggacaggtgatgctgctagttctgtgtgccgtgcagctccttctgatgcgcactagctgggcattgtgcgaggctctgaccctcgccacaggccccatcacgaccctgtgggaaggttcgccaggcaaattctggaatactacaattgcagtatctatggctaacatctttagagggtcctatttagccggagccggccttgcgttcagcataatgaagtcagtggggaccggaaaaaggggcactggtagtcaaggggagacactgggagaaaagtggaagaaaaagctcaatcagctatctcggaaagattttgacctgtacaagaaatccggcatcaccgaggtcgatcgaacggaggctaaggaaggtttgaaaagaggcgagattacccaccatgcagttagccgcgggtcagccaagctgcagtggttcgtggaaaggaacatggtcatccccgagggacgggtgattgacctcggctgtgggcgtggaggctggagttattactgcgctggtcttaagaaagtaacagaagtgagagggtatactaagggaggccctggccacgaggagccggttcccatgagcacctacgggtggaatatcgtgaaactgatgtccggaaaggatgtcttttacttgccacctgaaaaatgtgacacactgctctgcgatattggtgagtctagcccctcccctactgtggaagagtcaaggaccatccgcgtcttaaagatggtggagccatggctgaagaacaatcagttctgtataaaagttcttaacccctatatgcctacagtaattgaacacctggagcggctacaacgaaagcatggcgggatgctcgtgagaaatccactgtctaggaacagtacccacgaaatgtactggatctcgaatggaactggcaacatcgtcgccagcgtgaatatggtttcccgcttgctgctcaaccggttcacgatgacacatagacgtcccaccattgagaaagacgtggatcttggtgcagggactaggcacgtcaacgccgaaccggagacccctaatatggacgtgataggagagcggatcaagcgcattaaagaagagcacaactctacatggcattatgacgatgaaaatccatacaagacgtgggcttatcacggctcatacgaggtaaaggcgaccggcagcgcctccagtatgatcaacggggtggttaaactgttaactaagccctgggacgtcgtgcctatggtgacacagatggcaatgaccgatactacaccatttggacagcaacgagtcttcaaagaaaaggttgacaccagaacacccaggtctatgccgggtactcggcgcgtgatgggcattaccgctgagtggctgtggagaacgttggggaggaataaaaagcctcgactctgcacccgggaggaatttacaaagaaagtacgtactaacgccgcaatgggagccgtgttcaccgaggaaaatcagtgggatagcgctaaggccgcggtcgaggacgaagatttttggaaactggtggacagagagcgcgagctacataagcttggcaaatgtggttcatgcgtttataacatgatggggaagagggaaaaaaagctgggagagttcggcaaggcaaaaggctcccgggccatctggtacatgtggctcggggctagatacctggaatttgaggccttgggattcctgaatgaggatcactggtttagtcgcgaaaacagctattctggtgtggagggcgaagggctccataagcttggatacatactgagggacatctccaaaattcccggcggtgcaatgtatgctgatgacacagccgggtgggacactcgaatcaccgaggatgacttacacaatgaagagaagattacgcagcagatggatccagagcaccggcaactggctaacgccatcttcaaattgacataccagaataaggtcgtgaaggtacagagacctacccccactggaacagttatggacataatttcaaggaaagatcagcgcggcagcggccaagtggggacctatggactcaacacttttaccaatatggaagcacagctgatccgtcagatggagggtgaaggcgtcctatcgaaggcggaccttgagaacccacatctgcccgaaaaaaagatcacacagtggctcgagacgaaaggggtggagcggctgaagagaatggccatttctggagatgactgcgtggtcaagcctatagatgacaggttcgctaacgccttgttagcactgaatgatatgggcaaagttcgcaaggacatcccacaatggcagccgagtaaaggttggcacgattggcagcaggtgcccttttgttcccatcacttccacgaactcattatgaaggacgggcgaaaacttgtagtgccttgccggccacaagacgagctgatcggaagagctaggattagccagggcgccggctggtcactaaaggaaaccgcatgtctggggaaggcctacgcgcagatgtggtccctcatgtatttccatcgcagagatttgcggctggcttctaacgccatctgcagcgcagtccccgtgcactgggttcctactagtaggacaacctggtccatacatgcccaccatcaatggatgactacagaggacatgcttaccgtgtggaatcgtgtctggatcgaagataacccatggatggaggacaaaacgcccgtgacaacctgggagaatgtaccttacctgggaaagcgagaagatcagtggtgtggtagcctcattggcttaacttctcgcgctacctgggcccagaacatcccgacagcaattcagcaagttagatcactgatcgggaatgaggaatttttggactacatgccaagtatgaaacggttcaggaaggaggaggaatccgagggagctatttggtga

SEQ ID NO: 15265 - RNA, 9873 nt, synthetic construct
  misc_feature 1..9873: note = derived and/or modified CDS sequence (opt3) from DENV-3__FJ873813__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcagaattcagggggaactagtatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtacaagaaggggagcagtattggaaaaatgtttgaagctactgcccgcggtgcaagaaggatggccatactgggcgacaccgcttgggatttcgggtctgtgggaggcgttctcaactccctgggtaagatggtgcatcagatctttgggagcgcctatacggcacttttctcgggcgtctcttgggtgatgaaaattggaatcggcgtactgttgacatggatcgggctcaattccaagaacacctcaatgagttttagctgcattgcgataggaatcattactctgtacttaggcgctgtggttcaggccgacatgggttgtgtcatcaattggaaagggaaggagctgaagtgcggatccggcattttcgtgacaaacgaggtgcacacctggactgaacagtataaatttcaagcagattctcccaagcggctagccaccgctatcgccggtgcatgggagaatggcgtctgtgggatacgaagcacaacgcgcatggaaaacctcctgtggaaacagatcgctaatgagcttaactacattttgtgggaaaataacatcaagctgaccgttgtggtgggagacattatcggcgtactcgagcaggggaaaagaactctgacaccacagcctatggagttaaagtattcatggaaaacctggggaaaggccaagatagtcacagcggaaactcaaaacagttccttcattatcgatggccccaataccccagagtgccccagcgtgtctagggcctggaacgtttgggaagtggaggactacggttttggggtcttcacgacaaatatttggctgaaacttcgggaagtgtatacccagttgtgtgaccaccgcctcatgtcagctgcagttaaggatgagagagccgtgcatgctgacatgggatactggatcgagagtcagaaaaacggcagctggaagctggaaaaagcctccctaatagaggtaaagacttgcacctggcctaagtctcacacactgtggtcgaatggtgtcctcgaaagcgatatgatcattccaaaatccctggcaggcccgatctcacagcataaccacaggcccgggtaccacactcaaaccgcgggaccttggcatcttggcaagttggagctggactttaattattgcgaggggacaacggtggtgattaccgaaaactgtggaactcgtggcccaagtttacggacaaccactgtctctggtaaactcatccacgagtggtgctgtcgaagctgcacactgccccctcttagatacatgggggaagatggatgttggtatggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcatatgatcgccggggtgttctttacgttcgttctactgctctccggacagattacttggcgggatatggcacacaccctgatcatgattggcagtaatgctagcgacagaatgggtatgggggtgacataccttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttatcagctttggaccgccctgatctccttgacgtgttcaaacacaatattcaccctcactgtggcctggcgaaccgctacactgatcctagcaggtgttagtctgcttcctgtgtgccaaagctcgtccatgcggaagactgactggctcccaatggccgtcgcggctatgggcgtaccccctctgcccttgtttattttctctctgaaggataccttaaaacgtagaagctggccactcaatgagggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggaaaaggcggctgacataacttgggaggaagaggccgaacagacaggcgtcagccataaccttatgattaccgttgacgatgacggcactatgcgcatcaaagatgacgagacagagaatatcctcaccgtgctgttgaagacggcattactgattgtgtccgggatatttccatattcaatcccggccactctcctggtctggcacacctggcagaaacagacacaacggagcggagtgctttgggatgttcctagtcccccagaaacccagaaggctgagctggaagagggtgtatacagaattaaacagcagggcatcttcgggaagacacaagtgggagtcggcgtgcagaaggagggtgtttttcacactatgtggcatgtgaccaggggggccgtcttgacgtacaacggaaaacgactagaacccaattgggcatctgtgaagaaagacctgatttcctatggcggcgggtggcgcctcagcgctcagtggcaaaagggagaggaagtacaggtcatcgccgtggagcctggtaaaaacccaaagaatttccagacaatgcccggcactttccagaccacaaccggggaaataggagcgatcgccctggattttaagcctggcacttcgggttcaccgattatcaaccgggaggggaaagttgtgggactttacggcaatggcgtcgtgaccaagaacgggggatatgtttctggtattgcacaaacaaatgctgagccagacggccccacgcctgaattagaggaagagatgttcaaaaagagaaacctgactatcatggatctccacccagggagtggaaaaaccaggaagtacttgcccgccatagtgcgtgaagctattaagcgccggctgagaacactcatcctggcacctaccagggtcgtggccgccgagatggaggaagctcttaaaggcctgccgatccgatatcagactacagcgaccaagtccgagcatacgggtcgggaaattgtagacttgatgtgccacgcaacttttacaatgcgcctactgagccccgtgagagttccaaattacaacctcatcataatggatgaggcccatttcaccgaccctgcttctattgccgcaagggggtatatcagcacccgggtcggaatgggcgaagccgctgcgatttttatgactgccacacccccaggcaccgcagatgctttccctcagtccaatgcccccatccaggacgaggagcgagacataccagaaagatcatggaacagtgggaatgagtggattacagattttgcaggaaaaactgtgtggttcgtgccgagcatcaaggccggtaacgacatcgctaactgtttacgcaaaaatggcaagaaggtcattcaactgtctaggaaaacgtttgataccgaataccagaagacaaaacttaacgactgggatttcgtagtgactaccgacatctccgagatgggggccaattttaaggcggatcgtgttattgaccctcggagatgcctgaaacccgtgatactcacagatggaccagagagggtcatcttggcaggccccatgcctgtgaccgccgcttcagccgctcagcgccgaggtagagttgggcggaacccacagaaggaaaatgaccaatacattttcactggccagcccctgaacaatgatgaggaccacgcacactggacggaagccaagatgctcctggacaacatcaatacccctgagggaatcattccggctcttttcgaaccagagagggagaaaagtgccgcaatagatggcgaatatcgcctaaagggggagagccgtaaaacatttgtggaactgatgagacggggagacttgcccgtctggttagcgcataaggtggcctccgagggtatcaaatacactgataggaagtggtgcttcgacggccagcgcaacaatcagattctggaagagaacatggatgtagagatctggaccaaagaaggggagaagaagaaactccgacctagatggctggacgctcggacatattctgatccccttgccctgaaggaatttaaagagttcgcagctggaaggaagtcgattgccctcgacttggtgaccgaaatcggccgcgttccaagccacctggcacatagaactaggaatgccctagataacctggtcatgctccacacatcagagcacggtgggcgggcttaccgtcatgcggtggaggaacttcctgagacgatggaaaccctgttattgctgggcctcatgatactgcttactggaggcgccatgctgtttctcatctccgggaaaggaattggtaagacaagtatcggcttgatttgtgtgatcgcatctagcgggatgctgtggatggctgagatacccttacaatggattgcctccgccatcgtcctagagttctttatgatggttctgctcattccagaacctgagaagcagcgcaccccgcaggacaatcaacttgcatatgtggtaatcggaatactgaccttggctgccatcattgcggctaacgaaatgggcctgctcgagacaactaaacgagatctgggtatgtcaaaggaacccggggtggtctctccaacgagctaccttgacgtggatctccaccctgccagtgcatggaccctgtatgccgttgctacaactgtgatcacccccatgttgagacatacaattgagaattccaccgcaaacgtcagcctggccgcgatcgctaaccaggccgtagtgttaatgggcctagacaaaggatggccaatatctaagatggacctgggcgttcctctccttgcactggggtgctactcacaggtgaatcccttgactctgacggccgctgtcctcctgcttattacacactacgccatcatcggaccgggcttacaggcaaaagctaccagggaggcccaaaagcggactgcggccggtattatgaagaacccaaccgtggatgggatcatgacaatagacctggatcctgtcatttatgactccaaattcgaaaagcagctcggacaggtgatgttgctggttctatgtgcagtgcagctgctccttatgcgcactagttgggctctgtgcgaggccttgaccctggcaacaggccccatcacgaccctctgggaaggtagcccaggcaaattttggaatactacaattgctgtatcgatggccaacatcttcagagggtcttacctggccggagcgggcttagctttttccataatgaagagcgtggggaccggaaaaaggggcactggttcacaaggggagacacttggagaaaagtggaagaaaaagctgaatcagctcagtcggaaagatttcgacctatataagaaatctggcatcaccgaggtcgatcgaacggaggcaaaggaaggtctgaaaagaggcgagattacccatcacgccgtttcccgcgggagcgctaagttgcagtggtttgtggaaaggaacatggtcatccccgagggacgggtgattgacctgggctgtgggcgtggaggctggtcatactattgcgccggtctcaagaaagtaacagaagtgagagggtacactaagggaggccctggccacgaggagccggttcccatgagtacctatgggtggaatatcgtgaaacttatgagcggaaaggatgtcttctacctgccacctgaaaaatgtgacacattgctgtgcgatattggtgagtcctctcccagccctactgtggaagagtccaggaccatccgcgtcctcaagatggtggagccatggttaaagaacaatcagttctgtataaaagttctgaacccctacatgcctacagtaattgaacatcttgagcggctgcaacgaaagcacggcgggatgctagtgagatatccactctcaaggaattctacccatgaaatgtactggatcagtaacggaactggcaatatcgtcgcatcggtgaacatggttagccgcctgttgctgaatcggtttacgatgacacacagacgtcccaccattgagaaagacgtggatctcggtgccgggactaggcacgtcaacgctgaaccggagacccctaacatggacgtgataggagagcggatcaagcgcattaaagaagagcataattccacatggcactatgacgatgaaaacccatacaagacgtgggcgtatcatggctcttacgaggtaaaggccaccggctcagcaagctccatgatcaatggggtggttaaacttctgactaagccctgggacgtcgtgcctatggtgacacagatggctatgaccgatactacaccattcggacagcaacgagtctttaaagaaaaggttgacaccagaacacccaggagtatgccgggtactcggcgcgtgatgggcattaccgccgagtggttatggagaacgctggggaggaacaaaaagcctcgattgtgcacccgggaggaattcacaaagaaagtacgtactaatgcagccatgggagctgtgtttaccgaggaaaaccagtgggattctgccaaggcggcagtcgaggacgaagatttctggaaactcgtggacagagagcgcgagctgcacaagctaggcaaatgtggtagctgcgtttataatatgatggggaagagggaaaaaaagcttggagagtttggcaaggccaaaggctcacgggctatctggtacatgtggctgggggccagatacctcgaattcgaggcactgggatttttgaacgaggatcattggttctcccgcgaaaatagttatagcggtgtggagggcgaagggctgcacaagctcggatacatacttagggacatctctaaaattcccggcggtgctatgtatgccgatgacacagctgggtgggacactcgaatcaccgaggatgacctgcacaacgaagagaagattacgcagcagatggatccagagcatcggcaattagccaatgcaatctttaaactgacataccagaacaaggtcgtgaaggtacagagacctacccccactggaacagttatggacataatttccaggaaagatcagcgcggctcaggccaagtggggacctatggattgaatactttcaccaacatggaagcgcagctcatccgtcagatggagggtgaaggcgtcctgagcaaggccgacctagagaatccacaccttcccgaaaaaaagatcacacagtggctggagacgaaaggggtggagcggctcaagagaatggctatttcgggagatgactgcgtggtcaagcctatagatgacaggtttgccaacgcactgttggctttaaacgatatgggcaaagttcgcaaggacatcccacaatggcagccgtctaaaggttggcatgattggcagcaggtgcccttctgtagtcaccacttccatgaactgattatgaaggacgggcgaaaactcgtagtgccttgccggccacaagacgagcttatcggaagagccaggatttcccagggcgcaggctggagcctgaaggaaaccgcctgtctagggaaggcgtacgctcagatgtggtcactgatgtattttcaccgcagagatctccggttggcctccaatgcaatctgctctgccgtccccgtgcattgggttcctactagcaggacaacctggagtatacacgctcatcaccaatggatgactacagaggacatgctgaccgtgtggaaccgtgtctggatcgaagataatccatggatggaggacaaaacgcccgtgacaacctgggagaacgtaccttaccttggaaagcgagaagatcagtggtgtggttccctgattggcctcactagccgcgccacctgggcacagaatatcccgacagctattcagcaagttagatctttaatcgggaacgaggaattcctggactacatgccatcaatgaaacggtttaggaaggaggaggaaagtgagggagccatttggtga

SEQ ID NO: 15266 - RNA, 9873 nt, synthetic construct
  misc_feature 1..9873: note = derived and/or modified CDS sequence (opt3) from DENV-3__FJ850048__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagcaggtgttagtctgcttcctgtgtgccaaagctcgtccatgcggaagactgactggctcccaatggccgtcgcggctatgggcgtaccccctctgcccttgtttattttctctctgaaggataccttaaaacgtagaagctggccactcaatgagggggtgatggccgttggactggtgtcaatccttgcaagttccctgttgaggaacgacgtccctatggccggccccctcgtggctggtgggctgctaattgcatgttatgtaatcacgggaacatctgccgatctgaccgtggaaaaggcggctgacataacttgggaggaagaggccgaacagacaggcgtcagccacaaccttatgattaccgttgacgatgacggcactatgcgcatcaaagatgacgagacagagaatatcctcaccgtgctgttgaagacggcattactgattgtgtccgggatatttccatactcaatcccggccactctcctggtctggcatacctggcagaaacagacacaacggagcggagtgctttgggatgttcctagtcccccagaaacccagaaggctgagctggaagagggtgtatacagaattaaacagcagggcatcttcgggaagacacaagtgggagtcggcgtgcagaaggagggtgtttttcacactatgtggcacgtgaccaggggggccgtcttgacgtataacggaaaacgactagaacccaattgggcatctgtgaagaaagacctgatttcctacggcggcgggtggcgcctcagcgctcagtggcaaaagggagaggaagtacaggtcatcgccgtggagcctggtaaaaacccaaagaatttccagacaatgcccggcactttccagaccacaaccggggaaataggagcgatcgccctggattttaagcctggcacttcgggttcaccgattatcaaccgggaggggaaagttgtgggactttatggcaatggcgtcgtgaccaagaacgggggatacgtttctggtattgcacaaacaaatgctgagccagacggccccacgcctgaattagaggaagagatgttcaaaaagagaaacctgactatcatggatctccatccagggagtggaaaaaccaggaagtatttgcccgccatagtgcgtgaagctattaagcgccggctgagaacactcatcctggcacctaccagggtcgtggccgccgagatggaggaagctcttaaaggcctgccgatccgataccagactacagcgaccaagtccgagcacacgggtcgggaaattgtagacttgatgtgccatgcaacttttacaatgcgcctactgagccccgtgagagttccaaattataacctcatcataatggatgaggcccacttcaccgaccctgcttctattgccgcaagggggtacatcagcacccgggtcggaatgggcgaagccgctgcgatttttatgactgccacacccccaggcaccgcagatgctttccctcagtccaatgcccccatccaggacgaggagcgagacataccagaaagatcatggaacagtgggaatgagtggattacagattttgcaggaaaaactgtgtggttcgtgccgagcatcaaggccggtaacgacatcgctaactgtttacgcaaaaatggcaagaaggtcattcaactgtctaggaaaacgtttgataccgaataccagaagacaaaacttaacgactgggatttcgtagtgactaccgacatctccgagatgggggccaattttaaggcggatcgtgttattgaccctcggagatgcctgaaacccgtgatactcacagatggaccagagagggtcatcttggcaggccccatgcctgtgaccgccgcttcagccgctcagcgccgaggtagagttgggcggaacccacagaaggaaaatgaccaatatattttcactggccagcccctgaacaatgatgaggaccatgcacactggacggaagccaagatgctcctggacaacatcaatacccctgagggaatcattccggctcttttcgaaccagagagggagaaaagtgccgcaatagatggcgaataccgcctaaagggggagagccgtaaaacatttgtggaactgatgagacggggagacttgcccgtctggttagcgcacaaggtggcctccgagggtatcaaatatactgataggaagtggtgcttcgacggccagcgcaacaatcagattctggaagagaacatggatgtagagatctggaccaaagaaggggagaagaagaaactccgacctagatggctggacgctcggacatactctgatccccttgccctgaaggaatttaaagagttcgcagctggaaggaagtcgattgccctcgacttggtgaccgaaatcggccgcgttccaagccatctggcacacagaactaggaatgccctagataacctggtcatgctccatacatcagagcacggtgggcgggcttatcgtcacgcggtggaggaacttcctgagacgatggaaaccctgttattgctgggcctcatgatactgcttactggaggcgccatgctgtttctcatctccgggaaaggaattggtaagacaagtatcggcttgatttgtgtgatcgcatctagcgggatgctgtggatggctgagatacccttacaatggattgcctccgccatcgtcctagagttctttatgatggttctgctcattccagaacctgagaagcagcgcaccccgcaggacaatcaacttgcatacgtggtaatcggaatactgaccttggctgccatcattgcggctaacgaaatgggcctgctcgagacaactaaacgagatctgggtatgtcaaaggaacccggggtggtctctccaacgagctatcttgacgtggatctccatcctgccagtgcatggaccctgtacgccgttgctacaactgtgatcacccccatgttgagacacacaattgagaattccaccgcaaacgtcagcctggccgcgatcgctaaccaggccgtagtgttaatgggcctagacaaaggatggccaatatctaagatggacctgggcgttcctctccttgcactggggtgctactcacaggtgaatcccttgactctgacggccgctgtcctcctgcttattacacattatgccatcatcggaccgggcttacaggcaaaagctaccagggaggcccaaaagcggactgcggccggtattatgaagaacccaaccgtggatgggatcatgacaatagacctggatcctgtcatttacgactccaaattcgaaaagcagctcggacaggtgatgttgctggttctatgtgcagtgcagctgctccttatgcgcactagttgggctctgtgcgaggccttgaccctggcaacaggccccatcacgaccctctgggaaggtagcccaggcaaattttggaatactacaattgctgtatcgatggccaacatcttcagagggtcttatctggccggagcgggcttagctttttccataatgaagagcgtggggaccggaaaaaggggcactggttcacaaggggagacacttggagaaaagtggaagaaaaagctgaatcagctcagtcggaaagatttcgacctatacaagaaatctggcatcaccgaggtcgatcgaacggaggcaaaggaaggtctgaaaagaggcgagattacccaccatgccgtttcccgcgggagcgctaagttgcagtggtttgtggaaaggaacatggtcatccccgagggacgggtgattgacctgggctgtgggcgtggaggctggtcatattactgcgccggtctcaagaaagtaacagaagtgagagggtatactaagggaggccctggccacgaggagccggttcccatgagtacctacgggtggaatatcgtgaaacttatgagcggaaaggatgtcttctacctgccacctgaaaaatgtgacacattgctgtgcgatattggtgagtcctctcccagccctactgtggaagagtccaggaccatccgcgtcctcaagatggtggagccatggttaaagaacaatcagttctgtataaaagttctgaacccctatatgcctacagtaattgaacaccttgagcggctgcaacgaaagcatggcgggatgctagtgagaaatccactctcaaggaactctacccacgaaatgtactggatcagtaatggaactggcaacatcgtcgcatcggtgaatatggttagccgcctgttgctgaaccggtttacgatgacacatagacgtcccaccattgagaaagacgtggatctcggtgccgggactaggcacgtcaacgctgaaccggagacccctaatatggacgtgataggagagcggatcaagcgcattaaagaagagcacaactccacatggcattatgacgatgaaaatccatacaagacgtgggcgtatcacggctcttacgaggtaaaggccaccggctcagcaagctccatgatcaacggggtggttaaacttctgactaagccctgggacgtcgtgcctatggtgacacagatggctatgaccgatactacaccattcggacagcaacgagtctttaaagaaaaggttgacaccagaacacccaggagtatgccgggtactcggcgcgtgatgggcattaccgccgagtggttatggagaacgctggggaggaataaaaagcctcgattgtgcacccgggaggaattcacaaagaaagtacgtactaacgcagccatgggagctgtgtttaccgaggaaaatcagtgggattctgccaaggcggcagtcgaggacgaagatttctggaaactcgtggacagagagcgcgagctgcataagctaggcaaatgtggtagctgcgtttataacatgatggggaagagggaaaaaaagcttggagagtttggcaaggccaaaggctcacgggctatctggtacatgtggctgggggccagatacctcgaattcgaggcactgggatttttgaatgaggatcactggttctcccgcgaaaacagttatagcggtgtggagggcgaagggctgcataagctcggatacatacttagggacatctctaaaattcccggcggtgctatgtatgccgatgacacagctgggtgggacactcgaatcaccgaggatgacctgcacaatgaagagaagattacgcagcagatggatccagagcaccggcaattagccaacgcaatctttaaactgacataccagaataaggtcgtgaaggtacagagacctacccccactggaacagttatggacataatttccaggaaagatcagcgcggctcaggccaagtggggacctatggattgaacactttcaccaatatggaagcgcagctcatccgtcagatggagggtgaaggcgtcctgagcaaggccgacctagagaacccacatcttcccgaaaaaaagatcacacagtggctggagacgaaaggggtggagcggctcaagagaatggctatttcgggagatgactgcgtggtcaagcctatagatgacaggtttgccaacgcactgttggctttaaatgatatgggcaaagttcgcaaggacatcccacaatggcagccgtctaaaggttggcacgattggcagcaggtgcccttctgtagtcatcacttccacgaactgattatgaaggacgggcgaaaactcgtagtgccttgccggccacaagacgagcttatcggaagagccaggatttcccagggcgcaggctggagcctgaaggaaaccgcctgtctagggaaggcgtacgctcagatgtggtcactgatgtattttcatcgcagagatctccggttggcctccaacgcaatctgctctgccgtccccgtgcactgggttcctactagcaggacaacctggagtatacatgctcaccatcaatggatgactacagaggacatgctgaccgtgtggaatcgtgtctggatcgaagataacccatggatggaggacaaaacgcccgtgacaacctgggagaatgtaccttaccttggaaagcgagaagatcagtggtgtggttccctgattggcctcactagccgcgccacctgggcacagaacatcccgacagctattcagcaagttagatctttaatcgggaatgaggaattcctggactacatgccatcaatgaaacggtttaggaaggaggaggaaagtgagggagccatttggtga

SEQ ID NO: 15267 - RNA, 9873 nt, synthetic construct
  misc_feature 1..9873: note = derived and/or modified CDS sequence (opt3) from DENV-3__FJ850049__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcagaattcagggggaactagtatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtacaagaaggggagcagtattggaaaaatgtttgaagctactgcccgcggtgcaagaaggatggccatactgggcgacaccgcttgggatttcgggtctgtgggaggcgttctcaactccctgggtaagatggtgcatcagatctttgggagcgcctatacggcacttttctcgggcgtctcttgggtgatgaaaattggaatcggcgtactgttgacatggatcgggctcaattccaagaacacctcaatgagttttagctgcattgcgataggaatcattactctgtacttaggcgctgtggttcaggccgacatgggttgtgtcatcaattggaaagggaaggagctgaagtgcggatccggcattttcgtgacaaacgaggtgcacacctggactgaacagtataaatttcaagcagattctcccaagcggctagccaccgctatcgccggtgcatgggagaatggcgtctgtgggatacgaagcacaacgcgcatggaaaacctcctgtggaaacagatcgctaatgagcttaactacattttgtgggaaaataacatcaagctgaccgttgtggtgggagacattatcggcgtactcgagcaggggaaaagaactctgacaccacagcctatggagttaaagtattcatggaaaacctggggaaaggccaagatagtcacagcggaaactcaaaacagttccttcattatcgatggccccaataccccagagtgccccagcgtgtctagggcctggaacgtttgggaagtggaggactacggttttggggtcttcacgacaaatatttggctgaaacttcgggaagtgtatacccagttgtgtgaccaccgcctcatgtcagctgcagttaaggatgagagagccgtgcatgctgacatgggatactggatcgagagtcagaaaaacggcagctggaagctggaaaaagcctccctaatagaggtaaagacttgcacctggcctaagtctcacacactgtggtcgaatggtgtcctcgaaagcgatatgatcattccaaaatccctggcaggcccgatctcacagcataaccacaggcccgggtaccacactcaaaccgcgggaccttggcatcttggcaagttggagctggactttaattattgcgaggggacaacggtggtgattaccgaaaactgtggaactcgtggcccaagtttacggacaaccactgtctctggtaaactcatccacgagtggtgctgtcgaagctgcacactgccccctcttagatacatgggggaagatggatgttggtatggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcatatgatcgccggggtgttctttacgttcgttctactgctctccggacagattacttggcgggatatggcacacaccctgatcatgattggcagtaatgctagcgacagaatgggtatgggggtgacataccttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttatcagctttggaccgccctgatctccttgacgtgttcaaacacaatattcaccctcactgtggcctggcgaaccgctacactgatcctagcaggtgttagtctgcttcctatgtgccaaagctcgtccatgcggaagactgactggctcccaatggccgtggcggctatgggcgtcccccctctgcccttgtttattttctctctgaaggataccttaaaacgtagaagctggccactcaatgagggggtaatggccgtgggactggtttcaatccttgcaagttccctgttgaggaacgacgtgcctatggccggccccctcgtcgctggtgggctgctaattgcatgttacgtgatcacgggaacatctgccgatctgaccgtagaaaaggcggctaacataacttgggaggaagaggccgaacagacaggcgtgagccataatcttatgattaccgtcgacgacgatggcactatgcgcatcaaagacgatgagacagagaacatcctcaccgttctgttgaagacggcattactgattgtgtccgggatatttccatattcaatcccggccactctcctggtgtggcacacctggcagaaacagacacaacggagcggagtcctttgggacgtgcctagtcccccagaaacccagaaggctgagctggaagagggtgtttacagaattaaacagcagggcatcttcgggaagacacaagtaggagtgggcgtccagaaggagggtgtgtttcacactatgtggcatgttaccaggggggccgtgttgacgtacaatggaaaacgactagaacccaactgggcatctgtcaagaaagatctgatttcctatggcggcgggtggcgcctcagcgctcagtggcaaaagggagaggaagtgcaggtaatcgccgtcgagcctggtaaaaatccaaagaacttccagacaatgcccggcactttccagaccacaaccggggaaataggagcgatcgccctggactttaagcctggcacttcgggttcaccgattatcaatcgggaggggaaagtggttggactttacggcaacggcgtggtcaccaagaatgggggatatgtgtctggtattgcacaaacaaacgctgagccagatggccccacgcctgaattagaggaagagatgttcaaaaagagaaatctgactatcatggacctccacccagggagtggaaaaaccaggaagtacttgcccgccatagttcgtgaagctattaagcgccggctgagaacactcatcctggcacctaccagggtggtcgccgccgagatggaggaagctcttaaaggcctgccgatccgatatcagactacagcgaccaagtccgagcatacgggtcgggaaattgtggatttgatgtgccacgcaacttttacaatgcgcctactgagccccgtaagagtgccaaactacaatctcatcataatggacgaggcccatttcaccgatcctgcttctattgccgcaagggggtatatcagcacccgggttggaatgggcgaagccgctgcgatttttatgactgccacacccccaggcaccgcagacgctttccctcagtccaacgcccccatccaggatgaggagcgagacataccagaaagatcatggaatagtgggaacgagtggattacagactttgcaggaaaaactgtctggttcgtgccgagcatcaaggccggtaacgatatcgctaattgtttacgcaaaaacggcaagaaggtgattcaactgtctaggaaaacgtttgacaccgaataccagaagacaaaacttaatgattgggacttcgtcgtaactaccgatatctccgagatgggggccaactttaaggcggaccgtgtgattgatcctcggagatgcctgaaacccgttatactcacagacggaccagagagggtgatcttggcaggccccatgcctgtcaccgccgcttcagccgctcagcgccgaggtagagtggggcggaatccacagaaggaaaacgatcaatacattttcactggccagcccctgaataacgacgaggatcacgcacactggacggaagccaagatgctcctggacaatatcaacacccctgagggaatcattccggctcttttcgaaccagagagggagaaaagtgccgcaatagacggcgaatatcgcctaaagggggagagccgtaaaacatttgttgaactgatgagacggggagatttgcccgtgtggttagcgcataaggtcgcctccgagggtatcaaatacactgacaggaagtggtgcttcgatggccagcgcaataaccagattctggaagagaatatggacgtggagatctggaccaaagaaggggagaagaagaaactccgacctagatggctggatgctcggacatattctgacccccttgccctgaaggaatttaaagagttcgcagctggaaggaagtcgattgccctcgatttggtaaccgaaatcggccgcgtgccaagccacctggcacatagaactaggaacgccctagacaatctggttatgctccacacatcagagcacggtgggcgggcttaccgtcatgcggtcgaggaacttcctgagacgatggaaaccctgttattgctgggcctcatgatactgcttactggaggcgccatgctgtttctcatctccgggaaaggaattggtaagacaagtatcggcttgatttgtgtgatcgcatctagcgggatgctgtggatggctgagatacccttacaatggattgcctccgccatcgtgctagagttctttatgatggtcctgctcattccagaacctgagaagcagcgcaccccgcaggataaccaacttgcatatgttgtgatcggaatactgaccttggctgccatcattgcggctaatgaaatgggcctgctcgagacaactaaacgagacctgggtatgtcaaaggaacccggggtagtgtctccaacgagctaccttgatgtcgacctccaccctgccagtgcatggaccctgtatgccgtggctacaactgttatcacccccatgttgagacatacaattgagaactccaccgcaaacgtgagcctggccgcgatcgctaatcaggccgtcgtattaatgggcctagataaaggatggccaatatctaagatggacctgggcgtgcctctccttgcactggggtgctactcacaggttaaccccttgactctgacggccgctgtgctcctgcttattacacactacgccatcatcggaccgggcttacaggcaaaagctaccagggaggcccaaaagcggactgcggccggtattatgaagaatccaaccgtcgacgggatcatgacaatagatctggaccctgtgatttatgattccaaattcgaaaagcagctcggacaggtcatgttgctggtgctatgtgcagttcagctgctccttatgcgcactagttgggctctgtgcgaggccttgaccctggcaacaggccccatcacgaccctctgggaaggtagcccaggcaaattttggaacactacaattgctgtgtcgatggccaatatcttcagagggtcttacctggccggagcgggcttagctttttccataatgaagagcgtagggaccggaaaaaggggcactggttcacaaggggagacacttggagaaaagtggaagaaaaagctgaaccagctcagtcggaaagacttcgatctatataagaaatctggcatcaccgaggtggaccgaacggaggcaaaggaaggtctgaaaagaggcgagattacccatcacgccgtctcccgcgggagcgctaagttgcagtggtttgttgaaaggaatatggtgatccccgagggacgggtcattgatctgggctgtgggcgtggaggctggtcatactattgcgccggtctcaagaaagtgacagaagtaagagggtacactaagggaggccctggccacgaggagccggtgcccatgagtacctatgggtggaacatcgttaaacttatgagcggaaaggacgtgttctacctgccacctgaaaaatgtgatacattgctgtgcgacattggtgagtcctctcccagccctactgtcgaagagtccaggaccatccgcgtgctcaagatggtcgagccatggttaaagaataaccagttctgtataaaagtgctgaatccctacatgcctacagttattgaacatcttgagcggctgcaacgaaagcacggcgggatgctagtaagaaacccactctcaaggaattctacccatgaaatgtattggatcagtaacggaactggcaatatcgtggcatcggtcaacatggtgagccgcctgttgctgaaccggtttacgatgacacacagacgtcccaccattgagaaagatgttgacctcggtgccgggactaggcacgtgaatgctgaaccggagacccctaacatggatgtcataggagagcggatcaagcgcattaaagaagagcataattccacatggcactacgacgacgaaaacccatataagacgtgggcgtaccatggctcttatgaggtgaaggccaccggctcagcaagctccatgatcaatggggtagtgaaacttctgactaagccctgggatgttgtccctatggtgacacagatggctatgaccgacactacaccattcggacagcaacgagtgtttaaagaaaaggtcgataccagaacacccaggagtatgccgggtactcggcgcgttatgggcattaccgccgagtggttatggagaacgctggggaggaacaaaaagcctcgattgtgcacccgggaggaattcacaaagaaagtgcgtactaatgcagccatgggagctgtatttaccgaggaaaaccagtgggactctgccaaggcggcagtggaggatgaagacttctggaaactcgtcgatagagagcgcgagctgcacaagctaggcaaatgtggtagctgcgtgtacaatatgatggggaagagggaaaaaaagcttggagagtttggcaaggccaaaggctcacgggctatctggtatatgtggctgggggccagatacctcgaattcgaggcactgggatttttgaacgaggaccattggttctcccgcgaaaatagttacagcggtgttgagggcgaagggctgcacaagctcggatatatacttagggatatctctaaaattcccggcggtgctatgtacgccgacgatacagctgggtgggacactcgaatcaccgaggacgatctgcacaacgaagagaagattacgcagcagatggacccagagcatcggcaattagccaatgcaatctttaaactgacatatcagaacaaggtggtcaaggtgcagagacctacccccactggaacagtaatggatataatttccaggaaagaccagcgcggctcaggccaagttgggacctacggattgaatactttcaccaacatggaagcgcagctcatccgtcagatggagggtgaaggcgtgctgagcaaggccgatctagagaacccacaccttcccgaaaaaaagatcacacagtggctggagacgaaaggggtcgagcggctcaagagaatggctatttcgggagacgattgcgtggtgaagcctatagacgataggtttgccaatgcactgttggctttaaacgacatgggcaaagtccgcaaggatatcccacaatggcagccgtctaaaggttggcatgactggcagcaggttcccttctgtagtcaccacttccatgaactgattatgaaggatgggcgaaaactcgtggtaccttgccggccacaagacgagcttatcggaagagccaggatttcccagggcgcaggctggagcctgaaggaaaccgcctgtctagggaaggcgtatgctcagatgtggtcactgatgtactttcaccgcagagacctccggttggcctccaatgcaatctgctctgccgtgcccgtccattgggtgcctactagcaggacaacctggagtatacacgctcatcaccaatggatgactacagaggatatgctgaccgtttggaaccgtgtgtggatcgaagacaatccatggatggaggataaaacgcccgtcacaacctgggagaacgtgccttatcttggaaagcgagaagaccagtggtgtggttccctgattggcctcactagccgcgccacctgggcacagaatatcccgacagctattcagcaagtaagatctttaatcgggaacgaggaattcctggattacatgccatcaatgaaacggtttaggaaggaggaggaaagtgagggagccatttggtga

SEQ ID NO: 15268 - RNA, 9873 nt, synthetic construct
  misc_feature 1..9873: note = derived and/or modified CDS sequence (opt3) from DENV-3__FJ898476__SS-prME
  source 1..9873: mol_type = other RNA
accagcctgtgcctcatgatgatccttcccgcagctctggcattccacttgacatccagagacggcgaacctagaatgattgtggggaagaacgaacggggtaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagcatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgactaagaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagccggtgttagtctgcttcctgtgtgccaaagctcgtccatgcggaagactgactggctcccaatggccgtcgcggctatgggcgtaccccctctgcccttgtttattttcgggctgaaggataccttaaaacgtagatcttggccactcaatgagggagtgatggccgttggcctggtgagcatccttgcatcaagtctgttgaggaacgacgtccctatggccggtcccctcgtggctgggggactgctaattgcatgttatgtaatcacgggcacatccgccgatctgaccgtggaaaaggcggctgacataacttgggaggaagaggccgaacagacaggcgtctctcacaaccttatgattaccgttgacgatgacgggactatgcgcatcaaagatgacgagacagagaatatcctcaccgtgctgttgaagacggcattactgattgtgagcggaatatttccatactccatcccggccactctcctggtctggcatacctggcagaaacagacacaacggtcaggtgtgctttgggatgttcctagtcccccagaaacccagaaggctgagctggaagagggcgtatacagaattaaacagcaggggatcttcggaaagacacaagtgggcgtcggtgtgcagaaggagggggtttttcacactatgtggcacgtgaccaggggagccgtcttgacgtataacggcaaacgactagaacccaattgggcaagtgtgaagaaagacctgatttcttacggcgggggatggcgcctctccgctcagtggcaaaagggtgaggaagtacaggtcatcgccgtggagcctggcaaaaacccaaagaatttccagacaatgcccgggactttccagaccacaaccggagaaataggcgcgatcgccctggattttaagcctggtactagcgggtcgccgattatcaaccgggagggaaaagttgtgggcctttatggcaatggggtcgtgaccaagaacggaggttacgtttcaggcattgcacaaacaaatgctgagccagacgggcccacgcctgaattagaggaagagatgttcaaaaagagaaacctgactatcatggatctccatccaggatctggcaaaaccaggaagtatttgcccgccatagtgcgtgaagctattaagcgccggctgagaacactcatcctggcacctaccagggtcgtggccgccgagatggaggaagctcttaaaggtctgccgatccgataccagactacagcgaccaagagtgagcacacggggcgggaaattgtagacttgatgtgccatgcaacttttacaatgcgcctactgtcccccgtgagagttccaaattataacctcatcataatggatgaggcccacttcaccgaccctgctagcattgccgcaaggggatacatctctacccgggtcggcatgggcgaagccgctgcgatttttatgactgccacacccccagggaccgcagatgctttccctcagagcaatgcccccatccaggacgaggagcgagacataccagaaagatcctggaactcaggaaatgagtggattacagattttgcaggtaaaactgtgtggttcgtgccgagtatcaaggccggcaacgacatcgctaactgtttacgcaaaaatgggaagaaggtcattcaactgagcaggaaaacgtttgataccgaataccagaagacaaaacttaacgactgggatttcgtagtgactaccgacatctctgagatgggagccaattttaaggcggatcgtgttattgaccctcggagatgcctgaaacccgtgatactcacagatggcccagagagggtcatcttggcaggtcccatgcctgtgaccgccgcttccgccgctcagcgccgagggagagttggccggaacccacagaaggaaaatgaccaatatattttcactggacagcccctgaacaatgatgaggaccatgcacactggacggaagccaagatgctcctggacaacatcaatacccctgagggcatcattccggctcttttcgaaccagagagggagaaatcagccgcaatagatggggaataccgcctaaagggagagagtcgtaaaacatttgtggaactgatgagacggggtgacttgcccgtctggttagcgcacaaggtggccagcgagggcatcaaatatactgataggaagtggtgcttcgacgggcagcgcaacaatcagattctggaagagaacatggatgtagagatctggaccaaagaaggagagaagaagaaactccgacctagatggctggacgctcggacatactccgatccccttgccctgaaggaatttaaagagttcgcagctggcaggaagtctattgccctcgacttggtgaccgaaatcggtcgcgttccatcgcatctggcacacagaactaggaatgccctagataacctggtcatgctccatacaagcgagcacgggggccgggcttatcgtcacgcggtggaggaacttcctgagacgatggaaaccctgttattgctgggactcatgatactgcttactggcggggccatgctgtttctcatctcaggaaaaggtattggcaagacatccatcgggttgatttgtgtgatcgcaagttctggaatgctgtggatggctgagatacccttacaatggattgccagcgccatcgtcctagagttctttatgatggttctgctcattccagaacctgagaagcagcgcaccccgcaggacaatcaacttgcatacgtggtaatcggcatactgaccttggctgccatcattgcggctaacgaaatgggtctgctcgagacaactaaacgagatctggggatgtccaaggaacccggcgtggtctcaccaacgtcttatcttgacgtggatctccatcctgccagcgcatggaccctgtacgccgttgctacaactgtgatcacccccatgttgagacacacaattgagaatagtaccgcaaacgtctccctggccgcgatcgctaaccaggccgtagtgttaatgggactagacaaaggctggccaataagcaagatggacctgggggttcctctccttgcactgggatgctactctcaggtgaatcccttgactctgacggccgctgtcctcctgcttattacacattatgccatcatcggcccgggtttacaggcaaaagctaccagggaggcccaaaagcggactgcggccgggattatgaagaacccaaccgtggatggaatcatgacaatagacctggatcctgtcatttacgactcaaaattcgaaaagcagctcggccaggtgatgttgctggttctatgtgcagtgcagctgctccttatgcgcacttcctgggctctgtgcgaggccttgaccctggcaacaggtcccatcacgaccctctgggaaggcagtccagggaaattttggaatactacaattgctgtaagcatggccaacatcttcagaggatcgtatctggccggcgcggggttagctttttctataatgaagtccgtgggaaccggcaaaaggggtactgggagccaaggagagacacttggcgaaaagtggaagaaaaagctgaatcagctctcacggaaagatttcgacctatacaagaaaagtggtatcaccgaggtcgatcgaacggaggcaaaggaaggcctgaaaagaggggagattacccaccatgccgtttctcgcggatccgctaagttgcagtggtttgtggaaaggaacatggtcatccccgagggccgggtgattgacctggggtgtggacgtggcggttggagctattactgcgccgggctcaagaaagtaacagaagtgagaggatatactaagggcggccctgggcacgaggagccggttcccatgtcaacctacggatggaatatcgtgaaacttatgagtggtaaggatgtcttctacctgccacctgaaaaatgtgacacattgctgtgcgatattggcgagagctccccctctcctactgtggaagagagcaggaccatccgcgtcctcaagatggtggagccatggttaaagaacaatcagttctgtataaaagttctgaacccctatatgcctacagtaattgaacaccttgagcggctgcaacgaaagcatgggggaatgctagtgagaaatccactctccaggaactcaacccacgaaatgtactggatctctaatggcactggtaacatcgtcgcaagtgtgaatatggtttcgcgcctgttgctgaaccggtttacgatgacacatagacgtcccaccattgagaaagacgtggatctcggggccggaactaggcacgtcaacgctgaaccggagacccctaatatggacgtgataggcgagcggatcaagcgcattaaagaagaacacaacagcacatggcattatgacgatgaaaatccatacaagacgtgggcgtatcacggctcctacgaggtaaaggccaccgggtctgcatcaagcatgatcaacggagtggttaaacttctgactaagccctgggacgtcgtgcctatggtgacacagatggctatgaccgatactacaccattcggtcagcaacgagtctttaaagaaaaggttgacaccagaacacccaggtccatgccgggcactcggcgcgtgatggggattaccgccgagtggttatggagaacgctgggaaggaataaaaagcctcgattgtgcacccgggaggagttcacaaagaaagtacgtactaacgcagccatgggcgctgtgtttaccgaggaaaatcagtgggatagtgccaaggcggcagtcgaggacgaagatttctggaaactcgtggacagagagcgcgagctgcataagctaggtaaatgtgggtcttgcgtttataacatgatgggaaagagggagaagaaacttggcgagtttggcaaagccaaagggagccgggctatctggtacatgtggctgggagccagatacctcgagttcgaggcactgggatttttgaatgaggatcactggttctcacgcgaaaactcctatagtggcgtggagggggaaggactgcataagctcggctacatacttagggacatcagcaaaattcccggtggggctatgtatgccgatgacacagctggatgggacactcgaatcaccgaggatgacctgcacaatgaagagaagattacgcagcagatggatccagagcaccggcaattagccaacgcaatctttaaactgacataccagaataaggtcgtgaaggtacagagacctacccccactggcacagttatggacataatttctaggaaagatcagcgcggctccgggcaagtgggaacctatggtttgaacactttcaccaatatggaagcgcagctcatccgtcagatggagggcgaaggggtcctgtcaaaggccgacctagagaacccacatcttcccgagaaaaagatcacacagtggctggagacgaaaggagtggagcggctcaagagaatggctattagcggcgatgactgcgtggtcaagcctatagatgacaggtttgccaacgcactgttggctttaaatgatatgggtaaagttcgcaaggacatcccacaatggcagccgtcgaaagggtggcacgattggcaacaggtgcccttctgttctcatcacttccacgaactgattatgaaggacggacgaaaactcgtagtgccttgccggccacaagacgagcttatcggcagagccaggattagtcagggcgcagggtggtccctgaaggaaaccgcctgtctaggaaaggcgtacgctcagatgtggagcctgatgtattttcatcgcagagatctccggttggcctcaaacgcaatctgctccgccgtccccgtgcactgggttcctacttctaggacaacctggagcatacatgctcaccatcaatggatgactacagaggacatgctgaccgtgtggaatcgtgtctggatcgaagataacccatggatggaggacaaaacgcccgtgacaacctgggagaatgtaccttaccttggtaagcgagaagatcagtggtgtggcagtctgattgggctcacttcccgcgccacctgggcacagaacatcccgacagctattcagcaagttaggagcttaatcggaaatgaggagttcctggactacatgccatctatgaaacggtttaggaaggaggaggaatcagagggcgccatttggtga

SEQ ID NO: 15269 - RNA, 9873 nt, synthetic construct
  misc_feature 1..9873: note = derived and/or modified CDS sequence (opt3) from DENV-3__FJ898475__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttcctaacgtttgttctgctcctgtccggacagattacttggcgggatatggcacatacccttatcatgattggcagtaatgctagcgacagaatgggtatgggggtgacatatttggccctgatagcaaccttcaaaatccagccctttttagccctcggattctttctgaggaagcttacttctcgcgaaaacctgctactcggcgtcggcctggctatggcgacaaccttgcaactgccggaggatattgaacagatggccaatgggatcgcattaggactcatggctctgaaacttattacacagttcgagacttaccagctgtggaccgccttgatctccctcacgtgttcaaacacaatatttaccctgactgtggcctggcgaaccgctacactaatcctggcaggtgttagtcttctccctgtgtgccaaagctcgtccatgcggaagactgactggctgccaatggccgtcgcggctatgggcgtaccccctttgcccctgttcattttttctttaaaggataccctcaaacgtagaagctggccactgaatgagggggtgatggccgttggacttgtgtcaatcctggcaagttccttgctcaggaacgacgtccctatggccggccccctggtggctggtgggctactgattgcatgttatgtaatcacgggaacatctgccgatcttaccgtggaaaaggcggctgacataacttgggaggaagaggccgaacagacaggcgtcagccacaacctcatgattaccgttgacgatgacggcactatgcgcatcaaagatgacgagacagagaatatcctgaccgtgttgttaaagacggcactgctcattgtgtccgggatattcccatactcaatcccggccactctgcttgtctggcatacctggcagaaacagacacaacggagcggagtgctgtgggatgttcctagtcccccagaaacccagaaggctgagttggaagagggtgtatacagaattaaacagcagggcatctttgggaagacacaagtgggagtcggcgtgcagaaggagggtgttttccacactatgtggcacgtgaccaggggggccgtcctaacgtataacggaaaacgactggaacccaattgggcatctgtgaagaaagacctcatttcctacggcggcgggtggcgcctgagcgctcagtggcaaaagggagaggaagtacaggtcatcgccgtggagcctggtaaaaacccaaagaattttcagacaatgcccggcactttccagaccacaaccggggaaataggagcgatcgcccttgatttcaagcctggcacttcgggttcaccgattatcaaccgggaggggaaagttgtgggattatatggcaatggcgtcgtgaccaagaacgggggatacgtttctggtattgcacaaacaaatgctgagccagacggccccacgcctgaactggaggaagagatgtttaaaaagagaaacctcactatcatggatttgcatccagggagtggaaaaaccaggaagtatctgcccgccatagtgcgtgaagctattaagcgccggctcagaacactgatccttgcacctaccagggtcgtggccgccgagatggaggaagctctgaaaggcttgccgatccgataccagactacagcgaccaagtccgagcacacgggtcgggaaattgtagacctaatgtgccatgcaactttcacaatgcgcctgctcagccccgtgagagttccaaattataacttaatcataatggatgaggcccactttaccgaccctgcttctattgccgcaagggggtacatcagcacccgggtcggaatgggcgaagccgctgcgattttcatgactgccacacccccaggcaccgcagatgcttttcctcagtccaatgcccccatccaggacgaggagcgagacataccagaaagatcatggaacagtgggaatgagtggattacagatttcgcaggaaaaactgtgtggtttgtgccgagcatcaaggccggtaacgacatcgctaactgtctgcgcaaaaatggcaagaaggtcattcaactttctaggaaaacgttcgataccgaataccagaagacaaaactgaacgactgggattttgtagtgactaccgacatctccgagatgggggccaatttcaaggcggatcgtgttattgaccctcggagatgcctcaaacccgtgatattgacagatggaccagagagggtcatcctggcaggccccatgcctgtgaccgccgcttcagccgctcagcgccgaggtagagttgggcggaacccacagaaggaaaatgaccaatatatttttactggccagcccctcaacaatgatgaggaccatgcacactggacggaagccaagatgctgcttgacaacatcaatacccctgagggaatcattccggctctattcgaaccagagagggagaaaagtgccgcaatagatggcgaataccgcctgaagggggagagccgtaaaacattcgtggaattgatgagacggggagacttacccgtctggctggcgcacaaggtggcctccgagggtatcaaatatactgataggaagtggtgctttgacggccagcgcaacaatcagattctcgaagagaacatggatgtagagatctggaccaaagaaggggagaagaagaaactgcgacctagatggcttgacgctcggacatactctgatcccctggccctcaaggaattcaaagagtttgcagctggaaggaagtcgattgccttggacctggtgaccgaaatcggccgcgttccaagccatctagcacacagaactaggaatgccctggataacctcgtcatgcttcatacatcagagcacggtgggcgggcttatcgtcacgcggtggaggaactgcctgagacgatggaaaccttattgctgctcggcctgatgatacttctgactggaggcgccatgctcttcttgatctccgggaaaggaattggtaagacaagtatcggcctgatttgtgtgatcgcatctagcgggatgttatggatggctgagatacccctacaatggattgcctccgccatcgtcctggagtttttcatgatggttctccttattccagaacctgagaagcagcgcaccccgcaggacaatcaactggcatacgtggtaatcggaatattgaccctggctgccatcattgcggctaacgaaatgggcctcctggagacaactaaacgagatcttggtatgtcaaaggaacccggggtggtctctccaacgagctatctcgacgtggatctgcatcctgccagtgcatggaccttgtacgccgttgctacaactgtgatcacccccatgctgagacacacaattgagaattccaccgcaaacgtcagcttagccgcgatcgctaaccaggccgtagtgctaatgggcctggacaaaggatggccaatatctaagatggacctcggcgttcctcttctggcattggggtgctactcacaggtgaatcccctgactctcacggccgctgtcctgcttttaattacacattatgccatcatcggaccgggcctgcaggcaaaagctaccagggaggcccaaaagcggactgcggccggtattatgaagaacccaaccgtggatgggatcatgacaatagacctcgatcctgtcatttacgactccaaatttgaaaagcagttgggacaggtgatgctgctagttctgtgtgcagtgcagctccttctgatgcgcactagttgggctttgtgcgaggccctgaccctcgcaacaggccccatcacgaccctgtgggaaggtagcccaggcaaattctggaatactacaattgctgtatcgatggccaacatctttagagggtcttatttagccggagcgggccttgctttctccataatgaagagcgtggggaccggaaaaaggggcactggttcacaaggggagacactgggagaaaagtggaagaaaaagctcaatcagctaagtcggaaagattttgacctgtacaagaaatctggcatcaccgaggtcgatcgaacggaggcaaaggaaggtttgaaaagaggcgagattacccaccatgccgtttcccgcgggagcgctaagctgcagtggttcgtggaaaggaacatggtcatccccgagggacgggtgattgacctcggctgtgggcgtggaggctggtcatattactgcgccggtcttaagaaagtaacagaagtgagagggtatactaagggaggccctggccacgaggagccggttcccatgagtacctacgggtggaatatcgtgaaactgatgagcggaaaggatgtcttttacttgccacctgaaaaatgtgacacactgctctgcgatattggtgagtcctctcccagccctactgtggaagagtccaggaccatccgcgtcttaaagatggtggagccatggctgaagaacaatcagttctgtataaaagttcttaacccctatatgcctacagtaattgaacacctggagcggctacaacgaaagcatggcgggatgctcgtgagaaatccactgtcaaggaactctacccacgaaatgtactggatcagtaatggaactggcaacatcgtcgcatcggtgaatatggttagccgcttgctgctcaaccggttcacgatgacacatagacgtcccaccattgagaaagacgtggatcttggtgccgggactaggcacgtcaacgctgaaccggagacccctaatatggacgtgataggagagcggatcaagcgcattaaagaagagcacaactccacatggcattatgacgatgaaaatccatacaagacgtgggcgtatcacggctcttacgaggtaaaggccaccggctcagcaagctccatgatcaacggggtggttaaactgttaactaagccctgggacgtcgtgcctatggtgacacagatggctatgaccgatactacaccatttggacagcaacgagtcttcaaagaaaaggttgacaccagaacacccaggagtatgccgggtactcggcgcgtgatgggcattaccgccgagtggctgtggagaacgttggggaggaataaaaagcctcgactctgcacccgggaggaatttacaaagaaagtacgtactaacgcagccatgggagctgtgttcaccgaggaaaatcagtgggattctgccaaggcggcagtcgaggacgaagatttttggaaactggtggacagagagcgcgagctacataagcttggcaaatgtggtagctgcgtttataacatgatggggaagagggaaaaaaagctgggagagttcggcaaggccaaaggctcacgggctatctggtacatgtggctcggggccagatacctggaatttgaggcattgggattcctgaatgaggatcactggttttcccgcgaaaacagttatagcggtgtggagggcgaagggctccataagcttggatacatactgagggacatctctaaaattcccggcggtgctatgtatgccgatgacacagctgggtgggacactcgaatcaccgaggatgacttacacaatgaagagaagattacgcagcagatggatccagagcaccggcaactggccaacgcaatcttcaaattgacataccagaataaggtcgtgaaggtacagagacctacccccactggaacagttatggacataatttccaggaaagatcagcgcggctcaggccaagtggggacctatggactcaacacttttaccaatatggaagcgcagctgatccgtcagatggagggtgaaggcgtcctaagcaaggccgaccttgagaacccacatctgcccgaaaaaaagatcacacagtggctcgagacgaaaggggtggagcggctgaagagaatggctatttcgggagatgactgcgtggtcaagcctatagatgacaggttcgccaacgcattgttagctctgaatgatatgggcaaagttcgcaaggacatcccacaatggcagccgtctaaaggttggcacgattggcagcaggtgcccttttgtagtcatcacttccacgaactcattatgaaggacgggcgaaaacttgtagtgccttgccggccacaagacgagctgatcggaagagccaggatttcccagggcgcaggctggagcctaaaggaaaccgcctgtctggggaaggcgtacgctcagatgtggtcactcatgtatttccatcgcagagatttgcggctggcctccaacgcaatctgctctgccgtccccgtgcactgggttcctactagcaggacaacctggagtatacatgctcaccatcaatggatgactacagaggacatgcttaccgtgtggaatcgtgtctggatcgaagataacccatggatggaggacaaaacgcccgtgacaacctgggagaatgtaccttacctgggaaagcgagaagatcagtggtgtggttccctcattggcttaactagccgcgccacctgggcacagaacatcccgacagctattcagcaagttagatctctgatcgggaatgaggaatttttggactacatgccatcaatgaaacggttcaggaaggaggaggaaagtgagggagccatttggtga

SEQ ID NO: 15270 - RNA, 9873 nt, synthetic construct
  misc_feature 1..9873: note = derived and/or modified CDS sequence (opt3) from DENV-3__GQ199861__SS-prME
  source 1..9873: mol_type = other RNA
accagcctgtgcctcatgatgatccttcccgccgctctggcattccacttgacatccagagacggcgaacctaggatgattgtggggaagaatgaacggggaaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagaacaccgccgagacaagcgtagcgtcgcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcaaaattcagggggaacaagtatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgactaagaaggaggaacccgtaaacattgaggcagaaccgcctttcggcgagtcaaatatcgtcatcggaattggcgataacgccttgaaaatcaattggtacaagaaggggagcagtattggaaaaatgtttgaagctactgcccgcggtgcaagaaggatggccatactgggcgacaccgcttgggatttcgggtctgtgggaggcgttctcaactccctgggtaagatggtgcatcagatctttgggagcgcctatacggcacttttctcgggcgtctcttgggtgatgaaaattggaatcggcgtactgttgacatggatcgggctcaattccaagaacacctcaatgagttttagctgcattgcgataggaatcattactctgtacttaggcgctgtggttcaggccgacatgggttgtgtcatcaattggaaagggaaggagctgaagtgcggatccggcattttcgtgacaaacgaggtgcacacctggactgaacagtataaatttcaagcagattctcccaagcggctagccaccgctatcgccggtgcatgggagaatggcgtctgtgggatacgaagcacaacgcgcatggaaaacctcctgtggaaacagatcgctaatgagcttaactacattttgtgggaaaataacatcaagctgaccgttgtggtgggagacattatcggcgtactcgagcaggggaaaagaactctgacaccacagcctatggagttaaagtattcatggaaaacctggggaaaggccaagatagtcacagcggaaactcaaaacagttccttcattatcgatggccccaataccccagagtgccccagcgtgtctagggcctggaacgtttgggaagtggaggactacggttttggggtcttcacgacaaatatttggctgaaacttcgggaagtgtatacccagttgtgtgaccaccgcctcatgtcagctgcagttaaggatgagagagccgtgcatgctgacatgggatactggatcgagagtcagaaaaacggcagctggaagctggaaaaagcctccctaatagaggtaaagacttgcacctggcctaagtctcacacactgtggtcgaatggtgtcctcgaaagcgatatgatcattccaaaatccctggcaggcccgatctcacagcataaccacaggcccgggtaccacactcaaaccgcgggaccttggcatcttggcaagttggagctggactttaattattgcgaggggacaacggtggtgattaccgaaaactgtggaactcgtggcccaagtttacggacaaccactgtctctggtaaactcatccacgagtggtgctgtcgaagctgcacactgccccctcttagatacatgggggaagatggatgttggtatggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcatatgatcgccggggtgttctttacgttcgttctactgctctccggacagattacttggcgggatatggcacacaccctgatcatgattggcagtaatgctagcgacagaatgggtatgggggtgacataccttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttatcagctttggaccgccctgatctccttgacgtgttcaaacacaatattcaccctcactgtggcctggcgaaccgctacactgatcctagccggtgttagtctgcttcctatgtgccaaagctcgtccatgcggaagactgactggctcccaatggccgtggcggctatgggcgtaccccctctgcccttgtttattttctctctgaaggataccttaaaacgtagaagctggccactcaatgagggggtaatggccgtgggactggtttcaatccttgcaagttccctgttgaggaacgacgtgcctatggccggccccctcgtcgctggtgggctgctaattgcatgttacgtgatcacgggaacatctgccgatctgaccgtagaaaaggcggctgacataacttgggaggaagaggccgaacagacaggcgtgagccataaccttatgattaccgtcgacgatgacggcactatgcgcatcaaagatgacgagacagagaatatcctcaccgttctgttgaagacggcattactgattgtgtccgggatatttccatattcaatcccggccactctcctggtgtggcacacctggcagaaacagacacaacggagcggagtcctttgggatgtgcctagtcccccagaaacccagaaggctgagctggaagagggtgtttacagaattaaacagcagggcatcttcgggaagacacaagtaggagtgggcgtccagaaggagggtgtgtttcacactatgtggcatgttaccagaggggcagtgttgacgtacaacggaaaacgactagaacccaattgggcaaacgtcaagaaagacctgatttcttatggcggcgggtggcgcctctccgctcagtggcaaaagggagaggaagtgcaggtaatcgccgtcgagcctggtaaaaatccaaagaacttccagacaatgcccggcactttccagaccacaaccggggaaataggagcgatcgccctggattttaagcctggcactagcggttcgccgattatcaatcgggaggggaaagtggttggactttacggcaacggcgtggtcaccaagaatgggggatatgtgtcaggtattgcacaaacaaacgctgagccagacggccccacgcctgaattagaggaagagatgttcaaaaagagaaatctgactatcatggatctccacccagggtctggaaaaaccaggaagtacttgcccgccatagttcgtgaagctattaagcgccggctgagaacactcatcctggcacctaccagggtggtcgccgccgagatggaggaagctcttaaaggcctgccgatccgatatcagactacagcgaccaagagtgagcatacgggtcgggaaattgtggacttgatgtgccacgcaacttttacaatgcgcctactgtcccccgtaagagtgccaaactacaatctcatcataatggatgaggcccatttcaccgaccctgctagcattgccgcaagggggtatatctctacccgggttggaatgggcgaagccgctgcgatttttatgactgccacacccccaggcaccgcagatgctttccctcagagcaacgcccccatccaggacgaggagcgagacataccagaaagatcctggaactcagggaacgagtggattacagattttgcaggaaaaactgtctggttcgtgccgagtatcaaggccggtaacgacatcgctaattgtttacgcaaaaacggcaagaaggtgattcaactgagcaggaaaacgtttgataccgaataccagaagacaaaacttaatgactgggatttcgtcgtaactaccgacatctctgagatgggggccaactttaaggcggatcgtgtgattgaccctcggagatgcctgaaacccgttatactcacagatggaccagagagggtgatcttggcaggccccatgcctgtcaccgccgcttccgccgctcagcgccgaggtagagtggggcggaatccacagaaggaaaacgaccaatacattttcactggccagcccctgaataacgatgaggaccacgcacactggacggaagccaagatgctcctggacaatatcaacacccctgagggaatcattccggctcttttcgaaccagagagggagaaatcagccgcaatagatggcgaatatcgcctaaagggggagagtcgtaaaacatttgttgaactgatgagacggggagacttgcccgtgtggttagcgcataaggtcgccagcgagggtatcaaatacactgataggaagtggtgcttcgacggccagcgcaataaccagattctggaagagaatatggatgtggagatctggaccaaagaaggggagaagaagaaactccgacctagatggctggacgctcggacatattccgatccccttgccctgaaggaatttaaagagttcgcagctggaaggaagtctattgccctcgacttggtaaccgaaatcggccgcgtgccatcgcacctggcacatagaactaggaacgccctagataatctggttatgctccacacaagcgagcacggtgggcgggcttaccgtcatgcggtcgaggaacttcctgagacgatggaaaccctgttattgctgggcctcatgatactgcttactggaggcgccatgctgtttctcatctcagggaaaggaattggtaagacatccatcggcttgatttgtgtgatcgcaagttctgggatgctgtggatggctgagatacccttacaatggattgccagcgccatcgtgctagagttctttatgatggtcctgctcattccagaacctgagaagcagcgcaccccgcaggacaaccaacttgcatatgttgtgatcggaatactgaccttggctgccatcattgcggctaatgaaatgggcctgctcgagacaactaaacgagatctgggtatgtccaaggaacccggggtagtgtcaccaacgtcttaccttgacgtcgatctccaccctgccagcgcatggaccctgtatgccgtggctacaactgttatcacccccatgttgagacatacaattgagaacagtaccgcaaacgtgtccctggccgcgatcgctaatcaggccgtcgtattaatgggcctagacaaaggatggccaataagcaagatggacctgggcgtgcctctccttgcactggggtgctactctcaggttaaccccttgactctgacggccgctgtgctcctgcttattacacactacgccatcatcggaccgggcttacaggcaaaagctaccagggaggcccaaaagcggactgcggccggtattatgaagaatccaaccgtcgatgggatcatgacaatagacctggatcctgtgatttatgactcaaaattcgaaaagcagctcggacaggtcatgttgctggtgctatgtgcagttcagctgctccttatgcgcacttcctgggctctgtgcgaggccttgaccctggcaacaggccccatcacgaccctctgggaaggtagtccaggcaaattttggaacactacaattgctgtgagcatggccaatatcttcagagggtcgtacctggccggagcgggcttagctttttctataatgaagtccgtagggaccggaaaaaggggcactggtagccaaggggagacacttggagaaaagtggaagaaaaagctgaaccagctctcacggaaagatttcgacctatataagaaaagtggcatcaccgaggtggatcgaacggaggcaaaggaaggtctgaaaagaggcgagattacccatcacgccgtctctcgcgggtccgctaagttgcagtggtttgttgaaaggaatatggtgatccccgagggacgggtcattgacctgggctgtgggcgtggaggctggagctactattgcgccggtctcaagaaagtgacagaagtaagagggtacactaagggaggccctggccacgaggagccggtgcccatgtcaacctatgggtggaacatcgttaaacttatgagtggaaaggatgtgttctacctgccacctgaaaaatgtgacacattgctgtgcgatattggtgagagctccccctctcctactgtcgaagagagcaggaccatccgcgtgctcaagatggtcgagccatggttaaagaataaccagttctgtataaaagtgctgaatccctacatgcctacagttattgaacatcttgagcggctgcaacgaaagcacggcgggatgctagtaagaaacccactctccagaaattcaacccatgaaatgtattggatctctaacggaactggcaatatcgtggcaagtgtcaacatggtgtcgcgcctgttgctgaaccggtttacgatgacacacagacgtcccaccattgagaaagacgttgatctcggtgccgggactaggcacgtgaatgctgaaccggagacccctaacatggacgtcataggagagcggatcaagcgcattaaagaagaacataatagcacatggcactacgacgatgaaaacccatataagacgtgggcgtaccatggctcctatgaggtgaaggccaccggctctgcatcaagcatgatcaatggggtagtgaaacttctgactaagccctgggacgttgtccctatggtgacacagatggctatgaccgatactacaccattcggacagcaacgagtgtttaaagaaaaggtcgacaccagaacacccaggtccatgccgggtactcggcgcgttatgggcattaccgccgagtggttatggagaacgctggggaggaacaaaaagcctcgattgtgcacccgggaggagttcacaaagaaagtgcgtactaatgcagccatgggagctgtatttaccgaggaaaaccagtgggatagtgccaaggcggcagtggaggacgaagatttctggaaactcgtcgacagagagcgcgagctgcacaagctaggcaaatgtggttcttgcgtgtacaatatgatggggaagagggagaagaaacttggagagtttggcaaagccaaaggcagccgggctatctggtatatgtggctgggggccagatacctcgagttcgaggcactgggatttttgaacgaggatcattggttctcacgcgaaaattcctacagtggtgttgagggcgaagggctgcacaagctcggatatatacttagggacatcagcaaaattcccggcggtgctatgtacgccgatgacacagctgggtgggacactcgaatcaccgaggatgacctgcacaacgaagagaagattacgcagcagatggatccagagcatcggcaattagccaatgcaatctttaaactgacatatcagaacaaggtggtcaaggtgcagagacctacccccactggaacagtaatggacataatttctaggaaagatcagcgcggctccggccaagttgggacctacggattgaatactttcaccaacatggaagcgcagctcatccgtcagatggagggtgaaggcgtgctgtcaaaggccgacctagagaacccacaccttcccgagaaaaagatcacacagtggctggagacgaaaggggtcgagcggctcaagagaatggctattagcggagatgactgcgtggtgaagcctatagatgacaggtttgccaatgcactgttggctttaaacgatatgggcaaagtccgcaaggacatcccacaatggcagccgtcgaaaggttggcatgattggcagcaggttcccttctgttctcaccacttccatgaactgattatgaaggacgggcgaaaactcgtggtaccttgccggccacaagacgagcttatcggaagggccaggattagtcagggcgcaggctggtccctgaaggaaaccgcctgtctagggaaggcgtatgctcagatgtggagcctgatgtactttcaccgcagagatctccggttggcctcaaatgcaatctgctccgccgtgcccgtccattgggtgcctacttctaggacaacctggagcatacacgctcatcaccaatggatgactacagaggacatgctgaccgtttggaaccgtgtgtggatcgaagataatccatggatggaggacaaaacgcccgtcacaacctgggagaacgtgccttatcttggaaagcgagaagatcagtggtgtggtagtctgattggcctcacttcccgcgccacctgggcacagaatatcccgacagctattcagcaagtaaggagcttaatcgggaacgaggagttcctggactacatgccatctatgaaacggtttaggaaggaggaggaatcagagggagccatttggtga

SEQ ID NO: 15271 - RNA, 9873 nt, synthetic construct
  misc_feature 1..9873: note = derived and/or modified CDS sequence (opt3) from DENV-3__GQ199862__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagcaggtgttagtctgcttcctgtgtgccaaagctcgtccatgcggaagactgactggctcccaatggccgtcgcggctatgggcgtaccccctctgcccttgtttattttctctctgaaggataccttaaaacgtagaagctggccactcaatgagggggtgatggccgttggactggtgtcaatccttgcaagttccctgttgaggaacgacgtccctatggccggccccctcgtggctggtgggctgctaattgcatgttatgtaatcacgggaacatctgccgatctgaccgtggaaaaggcggctgacataacttgggaggaagaggccgaacagacaggcgtcagccacaaccttatgattaccgttgacgatgacggcactatgcgcatcaaagatgacgagacagagaatatcctcaccgtgctgttgaagacggcattactgattgtgtccgggatatttccatactcaatcccggccactctcctggtctggcatacctggcagaaacagacacaacggagcggagtgctttgggatgttcctagtcccccagaaacccagaaggctgagctggaagagggtgtatacagaattaaacagcagggcatcttggggaagacacaagtgggagtcggcgtgcagaaggagggtgttttccacactatgtggcacgtgaccaggggggccgtcctaacgtataacggaaaacgactggaacccaattgggcatctgtgaagaaagacctcatttcctacggcggcgggtggcgcctgagcgctcagtggcaaaagggagaggaagtacaggtcatcgccgtggagcctggtaaaaacccaaagaattttcagacaatgcccggcactttccagaccacaaccggggaaataggagcgatcgcccttgatttcaagcctggcacttcgggttcaccgattatcaaccgggaggggaaagttgtgggattatatggcaatggcgtcgtgaccaagaacgggggatacgtttctggtattgcacaaacaaatgctgagccagacggccccacgcctgaactggaggaagagatgtttaaaaagagaaacctcactatcatggatttgcatccagggagtggaaaaaccaggaagtatctgcccgccatagtgcgtgaagctattaagcgccggctcagaacactgatccttgcacctaccagggtcgtggccgccgagatggaggaagctctgaaaggcttgccgatccgataccagactacagcgaccaagtccgagcacacgggtcgggaaattgtagacctaatgtgccatgcaactttcacaatgcgcctgctcagccccgtgagagttccaaattataacttaatcataatggatgaggcccactttaccgaccctgcttctattgccgcaagggggtacatcagcacccgggtcggaatgggcgaagccgctgcgattttcatgactgccacacccccaggcaccgcagatgcttttcctcagtccaatgcccccatccaggacgaggagcgagacataccagaaagatcatggaacagtgggaatgagtggattacagatttcgcaggaaaaactgtgtggtttgtgccgagcatcaaggccggtaacgacatcgctaactgtctgcgcaaaaatggcaagaaggtcattcaactttctaggaaaacgttcgataccgaataccagaagacaaaactgaacgactgggattttgtagtgactaccgacatctccgagatgggggccaatttcaaggcggatcgtgttattgaccctcggagatgcctcaaacccgtgatattgacagatggaccagagagggtcatcctggcaggccccatgcctgtgaccgccgcttcagccgctcagcgccgaggtagagttgggcggaacccacagaaggaaaatgaccaatatatttttactggccagcccctcaacaatgatgaggaccatgcacactggacggaagccaagatgctgcttgacaacatcaatacccctgagggaatcattccggctctattcgaaccagagagggagaaaagtgccgcaatagatggcgaataccgcctgaagggggagagccgtaaaacattcgtggaattgatgagacggggagacttacccgtctggctggcgcacaaggtggcctccgagggtatcaaatatactgataggaagtggtgctttgacggccagcgcaacaatcagattctcgaagagaacatggatgtagagatctggaccaaagaaggggagaagaagaaactgcgacctagatggcttgacgctcggacatactctgatcccctggccctcaaggaattcaaagagtttgcagctggaaggaagtcgattgccttggacctggtgaccgaaatcggccgcgttccaagccatctagcacacagaactaggaatgccctggataacctcgtcatgcttcatacatcagagcacggtgggcgggcttatcgtcacgcggtggaggaactgcctgagacgatggaaaccttattgctgctcggcctgatgatacttctgactggaggcgccatgctcttcttgatctccgggaaaggaattggtaagacaagtatcggcctgatttgtgtgatcgcatctagcgggatgttatggatggctgagatacccctacaatggattgcctccgccatcgtcctggagtttttcatgatggttctccttattccagaacctgagaagcagcgcaccccgcaggacaatcaactggcatacgtggtaatcggaatattgaccctggctgccatcattgcggctaacgaaatgggcctcctggagacaactaaacgagatcttggtatgtcaaaggaacccggggtggtctctccaacgagctatctcgacgtggatctgcatcctgccagtgcatggaccttgtacgccgttgctacaactgtgatcacccccatgctgagacacacaattgagaattccaccgcaaacgtcagcttagccgcgatcgctaaccaggccgtagtgctaatgggcctggacaaaggatggccaatatctaagatggacctcggcgttcctcttctggcattggggtgctactcacaggtgaatcccctgactctcacggccgctgtcctgcttttaattacacattatgccatcatcggaccgggcctgcaggcaaaagctaccagggaggcccaaaagcggactgcggccggtattatgaagaacccaaccgtggatgggatcatgacaatagacctcgatcctgtcatttacgactccaaatttgaaaagcagttgggacaggtgatgctgctagttctgtgtgcagtgcagctccttctgatgcgcactagttgggctttgtgcgaggccctgaccctcgcaacaggccccgtaacgaccctgtgggaaggtagcccaggcaaattctggaatactacaatcgctgtgtcgatggccaacatttttagagggtcttatttagccggagcgggccttgctttctccatcatgaagagcgtcgggaccggaaaaaggggcactggttcacaaggggagacactgggagaaaagtggaagaaaaagctcaatcagctaagtcggaaagattttgacctgtacaagaaatctggcataaccgaggttgatcgaacggaggcaaaggaaggtttgaaaagaggcgagatcacccaccatgccgtgtcccgcgggagcgctaagctgcagtggttcgtcgaaaggaacatggtgattcccgagggacgggtaatcgacctcggctgtgggcgtggaggctggtcatattactgcgccggtcttaagaaagtgacagaagttagagggtatactaagggaggccctggccacgaggagccggtgcccatgagtacctacgggtggaatattgtcaaactgatgagcggaaaggatgtgttttacttgccacctgaaaaatgtgacacactgctctgcgatatcggtgagtcctctcccagccctactgtcgaagagtccaggaccattcgcgtgttaaagatggttgagccatggctgaagaacaatcagttctgtatcaaagtacttaacccctatatgcctacagtgatagaacacctggagcggctacaacgaaagcatggcgggatgctcgtcagaaatccactgtcaaggaactctacccacgaaatgtactggattagtaatggaactggcaacatcgtggcatcggttaatatggtgagccgcttgctgctcaaccggttcacgatgacacatagacgtcccaccatcgagaaagacgtcgatcttggtgccgggactaggcacgtgaacgctgaaccggagacccctaatatggacgtaattggagagcggataaagcgcatcaaagaagagcacaactccacatggcattatgacgatgaaaatccatacaagacgtgggcgtatcacggctcttacgaggtgaaggccaccggctcagcaagctccatgattaacggggttgtcaaactgttaactaagccctgggacgtggtgcctatggtcacacagatggctatgaccgatactacaccatttggacagcaacgagttttcaaagaaaaggtggacaccagaacacccaggagtatgccgggtactcggcgcgtaatgggcatcaccgccgagtggctgtggagaacgttggggaggaataaaaagcctcgactctgcacccgggaggaatttacaaagaaagtgcgtactaacgcagccatgggagctgtcttcaccgaggaaaatcagtgggattctgccaaggcggcagtggaggacgaagatttttggaaactggttgacagagagcgcgagctacataagcttggcaaatgtggtagctgcgtgtataacatgatggggaagagggaaaaaaagctgggagagttcggcaaggccaaaggctcacgggctatttggtacatgtggctcggggccagatacctggaatttgaggcattgggattcctgaatgaggatcactggttttcccgcgaaaacagttatagcggtgtcgagggcgaagggctccataagcttggatacatcctgagggacatatctaaaatccccggcggtgctatgtatgccgatgacacagctgggtgggacactcgaattaccgaggatgacttacacaatgaagagaagatcacgcagcagatggatccagagcaccggcaactggccaacgcaattttcaaattgacataccagaataaggtggtaaaggttcagagacctacccccactggaacagtgatggacatcatatccaggaaagatcagcgcggctcaggccaagtcgggacctatggactcaacacttttaccaatatggaagcgcagctgattcgtcagatggagggtgaaggcgtgctaagcaaggccgaccttgagaacccacatctgcccgaaaaaaagatcacacagtggctcgagacgaaaggggtggagcggctgaagagaatggctatctcgggagatgactgcgtcgttaagcctattgatgacaggttcgccaacgcattgttagctctgaatgatatgggcaaagtgcgcaaggacataccacaatggcagccgtctaaaggttggcacgattggcagcaggtacccttttgtagtcatcacttccacgaactcatcatgaaggacgggcgaaaacttgtggtcccttgccggccacaagacgagctgattggaagagccaggatctcccagggcgcaggctggagcctaaaggaaaccgcctgtctggggaaggcgtacgctcagatgtggtcactcatgtatttccatcgcagagatttgcggctggcctccaacgcaatttgctctgccgtgcccgttcactgggtgcctactagcaggacaacctggagtatccatgctcaccatcaatggatgactacagaggacatgcttaccgtctggaatcgtgtgtggatagaagataacccatggatggaggacaaaacgcccgtaacaacctgggagaatgttccttacctgggaaagcgagaagatcagtggtgtggttccctcatcggcttaactagccgcgccacctgggcacagaacattccgacagctatccagcaagtgagatctctgattgggaatgaggaatttttggactacatgccatcaatgaaacggttcaggaaggaggaggaaagtgagggagccatctggtga

SEQ ID NO: 15272 - RNA, 9873 nt, synthetic construct
  misc_feature 1..9873: note = derived and/or modified CDS sequence (opt3) from DENV-3__GQ199863__SS-prME
  source 1..9873: mol_type = other RNA
accagcctgtgcctcatgatgatccttcccgcagctctggcattccacttgacttccagagacggcgaacctaggatgattgtggggaagaacgaacggggaaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggtcatcctcccagaatatggaactcttggcctggagtgctctccgcgaaccggtttggacttcaatgagatgatcctactgacaatgaaaaacaaggcctggatggtgcatagacagtggtttttcgatctccccctgccttggaccagcggggcgactacagaaacgccaacctggaataggaaagagcttctggtaacttttaagaacgcccacgccaagaaacaagaagttgtggtcttgggctcccaggagggagctatgcacacagccctcaccggcgctacagaaattcaaaattcagggggaacaagtatattcgccggtcatctgaagtgtcggttaaaaatggacaagctggagctaaaaggcatgagctacgcaatgtgcaccaacacgtttgtgctcaagaaagaggtctctgaaacccagcacgggacaatcctgattaaggtggagtacaagggagaagatgttccctgtaaaatccctttctccactgaggacggccaaggtaaggcccataacgggcgtcttataaccgctaatccagtggtaactaagaaggaggaacccgtcaacattgaggcggaaccgcctttcggcgagtcaaatatcgtgatcggaattggcgataacgcattgaaaatcaattggtataagaaggggagcagtattggaaaaatgtttgaagccactgctcgcggtgccagaaggatggcaatactgggcgacaccgcctgggatttcgggtctgttggaggcgtgctcaactccctgggtaagatggtccaccagatctttgggagcgcttacacggcccttttctcgggcgtgtcttgggtaatgaaaattggaatcggcgtgctgttgacatggatcgggctcaattccaagaacacctcaatgagttttagctgcattgcaataggaatcattactctgtatttaggcgcggttgtccaggctgacatgggttgtgtgatcaattggaaagggaaggagctgaagtgcggatccggcattttcgtgacaaacgaggtccatacctggactgaacagtacaaatttcaagccgattctcccaagcggctagcaaccgccatcgctggtgcctgggagaatggcgtttgtgggatacgaagcacaacgcgcatggaaaacctcctgtggaaacagatcgcaaatgagcttaactatattttgtgggaaaataacatcaagctgaccgtggtggtaggagacattatcggcgtcctcgagcaggggaaaagaactctgacaccacagcctatggagttaaagtactcatggaaaacctggggaaaggctaagatagtgacagccgaaactcaaaacagttccttcattatcgatggccccaataccccagagtgccccagcgtttctagggcgtggaacgtgtgggaagtcgaggactatggttttggggtgttcacgacaaatatttggctgaaacttcgggaagtttacacccagttgtgtgaccaccgcctcatgtcagccgctgtgaaggatgagagagcagtacacgccgacatgggatactggatcgagagtcagaaaaacggcagctggaagctggaaaaggcttccctaatagaggtcaagacttgcacctggcctaagtctcatacactgtggtcgaatggtgtgctcgaaagcgatatgatcattccaaaatccctggccggcccgatctcacagcacaaccataggcccgggtatcacactcaaaccgcaggaccttggcaccttggcaagttggagctggactttaattactgcgaggggacaacggtggtcattaccgaaaactgtggaactcgtggcccaagtttacggacaaccactgtttctggtaaactcatccatgagtggtgctgtcgaagctgcacactgccccctcttagatatatgggggaagatggatgttggtacggcatggagataaggccaatttccgaaaaggaggagaatatggtgaaatcactggtaagcgcgggttctggcaaggtggacaacttcaccatgggggtcttgtgcctcgccatcctgtttgaagaggtgatgcgcggaaagttcggcaaaaagcacatgatcgctggggttttctttacgttcgtgctactgctctccggacagattacttggcgggatatggcccataccctgatcatgattggcagtaatgcaagcgacagaatgggtatgggggtcacatatcttgctttgatagccacctttaaaatccagcccttcctggcattaggatttttcctcaggaagctgacttctcgcgaaaaccttctgctaggcgtgggcctcgccatggctacaaccctgcaattgccggaggatattgaacagatggcgaatgggatcgccctgggattaatggcactcaaactgattacacagtttgagacttaccagctttggaccgctctgatctccttgacgtgttcaaacacaatattcaccctcactgttgcctggcgaaccgccacactgatcctagctggtgtgagtctgcttcctgtctgccaaagctcgtccatgcggaagactgactggctcccaatggcagtagccgcgatgggcgtgccccctctgcccttgtttattttctctctgaaggataccttaaaacgtagaagctggccactcaatgagggggttatggctgtgggactggtctcaatccttgccagttccctgttgaggaacgacgtgcctatggcaggccccctcgtagccggtgggctgctaattgcttgttatgtgatcacgggaacatctgcagatctgaccgtcgaaaaggccgcggacataacttgggaggaagaggctgaacagacaggcgttagccacaaccttatgattaccgtggacgatgacggcactatgcgcatcaaagatgacgagacagagaatatcctcaccgtgctgttgaagacggccttactgattgtctccgggatatttccatactcaatcccggcaactctcctggtgtggcatacctggcagaaacagacacaacggagcggagttctttgggatgtacctagtcccccagaaacccagaaggccgagctggaagagggtgtgtacagaattaaacagcagggcatcttcgggaagacacaagtcggagtgggcgttcagaaggagggtgtgtttcacactatgtggcacgtcaccagaggggctgtgttgacgtataacggaaaacgactagaacccaattgggcctctgtaaagaaagacctgatttcctacggcggcgggtggcgcctcagcgcacagtggcaaaagggagaggaagtccaggtgatcgctgttgagcctggtaaaaacccaaagaatttccagacaatgcccggcactttccagaccacaaccggggaaataggagccatcgcgctggattttaagcctggcacttcgggttcaccgattatcaaccgggaggggaaagtggtcggactttatggcaatggcgtggttaccaagaacgggggatacgtgtctggtattgcccaaacaaatgcagagccagacggccccacgcctgaattagaggaagagatgttcaaaaagagaaacctgactatcatggatctccatccagggagtggaaaaaccaggaagtatttgcccgctatagtccgtgaagccattaagcgccggctgagaacactcatcctggctcctaccagggtggtagcagccgagatggaggaagcccttaaaggcctgccgatccgataccagactacagctaccaagtccgagcacacgggtcgggaaattgtggacttgatgtgccatgcgacttttacaatgcgcctactgagccccgttagagtcccaaattataacctcatcataatggatgaggcacacttcaccgaccctgcctctattgctgccagggggtacatcagcacccgggtgggaatgggcgaagcagccgctatttttatgactgcgacacccccaggcaccgccgatgcattccctcagtccaatgctcccatccaggacgaggagcgagacataccagaaagatcatggaacagtgggaatgagtggattacagattttgccggaaaaactgtgtggttcgtcccgagcatcaaggcaggtaacgacatcgccaactgtttacgcaaaaatggcaagaaggtaattcaactgtctaggaaaacgtttgataccgaataccagaagacaaaacttaacgactgggatttcgtggttactaccgacatctccgagatgggggctaattttaaggccgatcgtgtgattgaccctcggagatgcctgaaacccgtcatactcacagatggaccagagagggtgatcttggcgggccccatgcctgttaccgcagcctcagctgcccagcgccgaggtagagtggggcggaacccacagaaggaaaatgaccaatatattttcactggccagcccctgaacaatgatgaggaccatgctcactggacggaagcaaagatgctcctggacaacatcaatacccctgagggaatcattccggcccttttcgaaccagagagggagaaaagtgctgccatagatggcgaataccgcctaaagggggagagccgtaaaacatttgtcgaactgatgagacggggagacttgcccgtgtggttagcacacaaggtagcgtccgagggtatcaaatatactgataggaagtggtgcttcgacggccagcgcaacaatcagattctggaagagaacatggatgtggagatctggaccaaagaaggggagaagaagaaactccgacctagatggctggacgcccggatttactctgatccccttgctctgaaggaatttaaagagttcgccgcaggaaggaagtcgatcgctctcgacttggttacagaaataggccgcgtcccaagccatctggcccacagaaccaggaatgcactagataacctggtgatgctccatacttcagagcacggtgggcgggcctatcgtcacgctgtggaggaacttcctgagacaatggaaacgctgttattgctgggcctcatgatcctgcttaccggaggcgcgatgctgtttctcatttccgggaaaggaatcggtaagacaagtattggcttgatctgtgtcatagcctctagcgggatgctgtggatggcagagattcccttacaatggatcgcttccgccattgttctagagttctttatgatggtgctgctcatcccagaacctgagaagcagcgcacaccgcaggacaatcaacttgcctacgtagtgataggaatcctgaccttggcagctattatcgccgcgaacgaaatgggcctgctcgagaccacaaaacgagatctgggtatgtcaaaggaacccggggtcgtgtctccaactagctatcttgacgttgatctccatcctgctagtgcctggacgctgtacgcagtggccaccacagtcattactcccatgttgagacacaccatcgaaaattccacagctaacgtaagcctggcagccatagcgaaccaggctgtggttttaatgggcctagacaaaggatggccaatttctaagatggacctgggcgtgcctctccttgccctggggtgctactcacaggtcaatcccttgaccctgactgcagccgtgctcctgcttatcacgcattatgctatcattggaccgggcttacaggccaaagcaacaagggaggctcaaaagcggaccgccgcgggtatcatgaagaacccaactgtcgatgggataatgaccattgacctggatcctgtgatctacgactccaaattcgaaaagcagctcggacaggttatgttgctggtgctatgtgccgtacagctgctccttatgcgcacaagttgggcactgtgcgaggctttgactctggccaccggccccattacaacgctctgggaaggtagcccaggcaaattttggaataccactatcgcagtgtcgatggctaacatattcagagggtcttatctggccggagccggcttagcgttttccatcatgaaaagcgtcgggacaggaaaaaggggcaccggttcacaaggggagactcttggagaaaagtggaagaaaaagctgaatcagctcagtcggaaagatttcgacctatacaagaaatctggcattacagaggttgatcgaaccgaggctaaggaaggtctgaaaagaggcgagatcacgcaccatgcagtgtcccgcgggagcgccaagttgcagtggtttgtcgaaaggaacatggtgattcccgagggacgggtaatcgacctgggctgtgggcgtggaggctggtcatattactgcgctggtctcaagaaagtgaccgaagttagagggtatacaaagggaggccctggccacgaggagccggtgcccatgagtacttacgggtggaatattgtcaaacttatgagcggaaaggatgtgttctacctgccacctgaaaaatgtgacaccttgctgtgcgatatcggtgagtcctctcccagccctacagtcgaagagtccaggactatacgcgtgctcaagatggttgagccatggttaaagaacaatcagttctgtattaaagtactgaacccctatatgcctaccgtgatcgaacaccttgagcggctgcaacgaaagcatggcgggatgctagtcagaaatccactctcaaggaactctacacacgaaatgtactggatcagtaatggaaccggcaacattgtggcctcggttaatatggtgagccgcctgttgctgaaccggtttactatgacgcatagacgtcccacaatagagaaagacgtcgatctcggtgcagggaccaggcacgtgaacgccgaaccggagactcctaatatggacgtaatcggagagcggattaagcgcatcaaagaagaacacaactccacctggcattatgacgatgaaaatccatacaagacatgggcttatcacggctcttacgaggtgaaggcgacgggctcagccagctccatgattaacggggttgtcaaacttctgaccaagccctgggacgtggtgcctatggtcactcagatggcaatgacagataccactccattcggacagcaacgagtttttaaagaaaaggtggacacaagaacccccaggagtatgccgggtacacggcgcgtaatgggcatcactgctgagtggttatggagaaccctggggaggaataaaaagcctcgattgtgcacgcgggaggagttcaccaagaaagtgcgtacaaacgccgcaatgggagccgtctttactgaggaaaatcagtgggattctgctaaggccgcggtggaggacgaagatttctggaaactcgttgacagagagcgcgagctgcataagctaggcaaatgtggtagctgcgtgtataacatgatggggaagagggagaagaaacttggagagtttggcaaagcaaaaggctcacgggccatatggtacatgtggctgggggctagatacctcgagttcgaggccctgggatttttgaatgaggatcactggttctcccgcgaaaacagttatagcggtgtcgagggcgaagggctgcataagctcggatacatccttagggacatttctaaaatccccggcggtgcaatgtatgctgatgacaccgccgggtgggacacacgaattactgaggatgacctgcacaatgaagagaagatcacccagcagatggatccagagcaccggcaattagctaacgccatatttaaactgacgtaccagaataaggtggtaaaggttcagagacctacacccaccggaactgtgatggacattatctccaggaaagatcagcgcggctcaggccaagtcgggacatatggattgaacaccttcactaatatggaagcacagctcatccgtcagatggagggtgaaggcgtgctgagcaaggcggacctagagaacccacatcttcccgagaaaaagattacccagtggctggagacaaaaggggtggagcggctcaagagaatggccatatcgggagatgactgcgtcgttaagcctatcgatgacaggtttgctaacgccctgttggcattaaatgatatgggcaaagtgcgcaaggacattccacaatggcagccgtctaaaggttggcacgattggcagcaggtacccttctgtagtcatcacttccacgaactgatcatgaaggacgggcgaaaactcgtggtcccttgccggccacaagacgagcttattggaagggctaggatctcccagggcgccggctggagcctgaaggaaacggcatgtctagggaaggcctacgcgcagatgtggtcactgatgtattttcatcgcagagatctccggttggcttccaacgccatatgctctgcagtgcccgttcactgggtgcctaccagcaggactacatggagtatccatgcccaccatcaatggatgaccactgaggacatgctgacagtctggaatcgtgtgtggattgaagataacccatggatggaggacaaaacccccgtaacgacatgggagaatgttccttaccttggaaagcgagaagatcagtggtgtggttccctgatcggcctcaccagccgcgctacttgggcccagaacattccgaccgcaatccagcaagtgagatctttaattgggaatgaggagttcctggactacatgccatcaatgaaacggtttaggaaggaggaggaaagtgagggagctatatggtga

SEQ ID NO: 15273 - RNA, 9873 nt, synthetic construct
  misc_feature 1..9873: note = derived and/or modified CDS sequence (opt3) from DENV-3__GQ199864__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctgaacacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaatagagattttgttgaaggattgtcaggtgccacctgggtggacgtcgtgctggagcacggcgggtgcgtgacgactatggcgaagaacaaacccacactagatattgagctccagaagaccgaagcaactcaactggccacacttaggaaactgtgtatcgagggaaagattaccaatatcacgaccgacagccggtgccctacacagggcgaagctactttgccagaggaacaggatcagaactatgtctgtaaacacacctacgttgaccgcggttgggggaatggatgcggcctcttcggcaaggggagtctggtgacatgcgccaagtttcaatgtttagagcccatagagggaaaagtagtgcagcatgaaaacctgaagtatactgtcattatcaccgtgcacacaggtgatcagcatcaggttggcaatgagacccaaggggtgactgcagaaattacgcctcaggcttccacaaccgaggccatcctcccagaatacggaactcttggcctggagtgctctccgcgaaccggtttggacttcaacgagatgatcctactgacaatgaaaaataaggcgtggatggtccacagacagtggtttttcgacctccccctgccttggaccagcggggccactacagaaacgccaacctggaacaggaaagagcttctggtgacttttaagaatgcacacgctaaaaagcaagaagtagttgtgttgggctcccaggagggagccatgcatacagctctcaccggcgccacagaaattcagaactcagggggaactagtatattcgcaggtcacctgaagtgtcggttaaaaatggataagctggagctaaaaggcatgagctatgccatgtgcaccaacacgtttgtcctcaagaaagaggtgtctgaaacccagcatgggacaatcctgattaaggtcgagtacaagggagaagacgtgccctgtaaaatccctttctccactgaggatggccaaggtaaggctcacaatgggcgtcttataaccgcgaacccagttgtgacaaaaaaggaggaacccgtaaatattgaggcagaaccgcctttcggcgagtcaaacatcgtcatcggaattggcgacaatgccttgaaaatcaactggtacaagaaggggagcagtattggaaaaatgtttgaagctactgcccgcggtgcaagaaggatggccatactgggcgataccgcttgggacttcgggtctgtgggaggcgttctcaattccctgggtaagatggtgcatcagatctttgggagcgcctatacggcacttttctcgggcgtctcttgggtgatgaaaattggaatcggcgtactgttgacatggatcgggctcaactccaagaatacctcaatgagttttagctgcattgcgataggaatcattactctgtacttaggcgctgtggttcaggccgatatgggttgtgtcatcaactggaaagggaaggagctgaagtgcggatccggcattttcgtgacaaatgaggtgcacacctggactgaacagtataaatttcaagcagactctcccaagcggctagccaccgctatcgccggtgcatgggagaacggcgtctgtgggatacgaagcacaacgcgcatggaaaatctcctgtggaaacagatcgctaacgagcttaattacattttgtgggaaaacaacatcaagctgaccgttgtggtgggagatattatcggcgtactcgagcaggggaaaagaactctgacaccacagcctatggagttaaagtattcatggaaaacctggggaaaggccaagatagtcacagcggaaactcaaaatagttccttcattatcgacggccccaacaccccagagtgccccagcgtgtctagggcctggaatgtttgggaagtggaggattacggttttggggtcttcacgacaaacatttggctgaaacttcgggaagtgtatacccagttgtgtgaccaccgcctcatgtcagctgcagttaaggacgagagagccgtgcatgctgatatgggatactggatcgagagtcagaaaaatggcagctggaagctggaaaaagcctccctaatagaggtaaagacttgcacctggcctaagtctcacacactgtggtcgaacggtgtcctcgaaagcgacatgatcattccaaaatccctggcaggcccgatctcacagcataatcacaggcccgggtaccacactcaaaccgcgggaccttggcatcttggcaagttggagctggattttaactattgcgaggggacaacggtggtgattaccgaaaattgtggaactcgtggcccaagtttacggacaaccactgtctctggtaaactcatccacgagtggtgctgtcgaagctgcacactgccccctcttagatacatgggggaagacggatgttggtatggcatggagataaggccaatttccgaaaaggaggagaacatggttaaatcactggtgagcgccggttctggcaaggtagataatttcaccatcggggtgttgtgcctcgctatcctgtttgaagaggtcatgcgcggaaagttcggcaaaaagcatatgattgccggggtgttctttacgttcgttctactgctctccggacagatcacttggcgggacatggcacacaccctgattatgataggcagtaacgctagcgatagaatgggtatgggggtgacataccttgccttgatcgcaacctttaaaattcagcccttcctggccttaggatttttcctcaggaagctgacttctcgcgaaaatcttctgctaggcgtcggcctcgctatggcgacaaccctgcaattgccggaggacatcgaacagatggccaacgggattgcactgggattaatggctctcaaactgatcacacagtttgagacttatcagctttggaccgccctgatatccttgacgtgttcaaatacaatcttcaccctcactgtggcctggcgaaccgctacactgattctagcaggtgttagtctgcttcctgtgtgccaaagctcgtccatgcggaagactgattggctcccaatggccgtcgcggctatgggcgtaccccctctgcccttgtttatcttctctctgaaggacaccttaaaacgtagaagctggccactcaacgagggggtgatggccgttggactggtgtcaattcttgcaagttccctgttgaggaacgatgtccctatggccggccccctcgtggctggtgggctgctaatcgcatgttacgtaataacgggaacatctgccgacctgaccgtggaaaaggcggctgatattacttgggaggaagaggccgaacagacaggcgtcagccataatcttatgatcaccgttgacgacgatggcactatgcgcatcaaagacgatgagacagagaacattctcaccgtgctgttgaagacggcattactgatagtgtccgggatctttccatattcaattccggccactctcctggtctggcacacctggcagaaacagacacaacggagcggagtgctttgggacgttcctagtcccccagaaacccagaaggctgagctggaagagggtgtatacagaatcaaacagcagggcattttcgggaagacacaagtgggagtcggcgtgcagaaggagggtgtttttcacactatgtggcatgtgaccaggggggccgtcttgacgtacaatggaaaacgactagaacccaactgggcatctgtgaagaaagatctgatctcctatggcggcgggtggcgcctcagcgctcagtggcaaaagggagaggaagtacaggtcatagccgtggagcctggtaaaaatccaaagaacttccagacaatgcccggcactttccagaccacaaccggggaaatcggagcgattgccctggactttaagcctggcacttcgggttcaccgatcattaatcgggaggggaaagttgtgggactttacggcaacggcgtcgtgaccaagaatgggggatatgtttctggtatcgcacaaacaaacgctgagccagatggccccacgcctgaattagaggaagagatgttcaaaaagagaaatctgactataatggacctccacccagggagtggaaaaaccaggaagtacttgcccgccattgtgcgtgaagctatcaagcgccggctgagaacactcatcctggcacctaccagggtcgtggccgccgagatggaggaagctcttaaaggcctgccgattcgatatcagactacagcgaccaagtccgagcatacgggtcgggaaatcgtagatttgatgtgccacgcaacttttacaatgcgcctactgagccccgtgagagttccaaactacaatctcataattatggacgaggcccatttcaccgatcctgcttctatcgccgcaagggggtatattagcacccgggtcggaatgggcgaagccgctgcgatctttatgactgccacacccccaggcaccgcagacgctttccctcagtccaacgcccccatacaggatgaggagcgagacattccagaaagatcatggaatagtgggaacgagtggatcacagactttgcaggaaaaactgtgtggttcgtgccgagcatcaaggccggtaacgatattgctaattgtttacgcaaaaacggcaagaaggtcatccaactgtctaggaaaacgtttgacaccgaataccagaagacaaaacttaatgattgggacttcgtagtgactaccgatatttccgagatgggggccaactttaaggcggaccgtgttatagatcctcggagatgcctgaaacccgtgatcctcacagacggaccagagagggtcattttggcaggccccatgcctgtgaccgccgcttcagccgctcagcgccgaggtagagttgggcggaatccacagaaggaaaacgatcaatacatcttcactggccagcccctgaataacgacgaggatcacgcacactggacggaagccaagatgctcctggacaatatcaacacccctgagggaattataccggctcttttcgaaccagagagggagaaaagtgccgcaatcgacggcgaatatcgcctaaagggggagagccgtaaaacatttgtggaactgatgagacggggagatttgcccgtctggttagcgcataaggtggcctccgagggtattaaatacactgacaggaagtggtgcttcgatggccagcgcaataaccagatcctggaagagaatatggacgtagagatttggaccaaagaaggggagaagaagaaactccgacctagatggctggatgctcggacatattctgacccccttgccctgaaggaatttaaagagttcgcagctggaaggaagtcgatcgccctcgatttggtgaccgaaataggccgcgttccaagccacctggcacatagaactaggaacgccctagacaatctggtcatgctccacacatcagagcacggtgggcgggcttaccgtcatgcggtggaggaacttcctgagacgatggaaaccctgttattgctgggcctcatgatcctgcttactggaggcgccatgctgtttctcatttccgggaaaggaatcggtaagacaagtattggcttgatctgtgtgatagcatctagcgggatgctgtggatggctgagattcccttacaatggatcgcctccgccattgtcctagagttctttatgatggttctgctcatcccagaacctgagaagcagcgcaccccgcaggataaccaacttgcatatgtggtaataggaatcctgaccttggctgccattatcgcggctaatgaaatgggcctgctcgagacaactaaacgagacctgggtatgtcaaaggaacccggggtggtctctccaacgagctaccttgatgtggacctccaccctgccagtgcatggaccctgtatgccgttgctacaactgtgattacccccatgttgagacatacaatcgagaactccaccgcaaacgtcagcctggccgcgatagctaatcaggccgtagtgttaatgggcctagataaaggatggccaatttctaagatggacctgggcgttcctctccttgcactggggtgctactcacaggtgaaccccttgactctgacggccgctgtcctcctgcttatcacacactacgccatcattggaccgggcttacaggcaaaagctaccagggaggcccaaaagcggactgcggccggtatcatgaagaatccaaccgtggacgggataatgacaattgatctggaccctgtcatctatgattccaaattcgaaaagcagctcggacaggtgatgttgctggttctatgtgcagtgcagctgctccttatgcgcactagttgggctctgtgcgaggccttgaccctggcaacaggccccattacgaccctctgggaaggtagcccaggcaaattttggaacactacaatcgctgtatcgatggccaatatattcagagggtcttacctggccggagcgggcttagctttttccatcatgaagagcgtggggaccggaaaaaggggcactggttcacaaggggagacacttggagaaaagtggaagaaaaagctgaaccagctcagtcggaaagacttcgatctatataagaaatctggcattaccgaggtcgaccgaacggaggcaaaggaaggtctgaaaagaggcgagatcacccatcacgccgtttcccgcgggagcgctaagttgcagtggtttgtggaaaggaatatggtcattcccgagggacgggtgatcgatctgggctgtgggcgtggaggctggtcatactattgcgccggtctcaagaaagtaacagaagtgagagggtacactaagggaggccctggccacgaggagccggttcccatgagtacctatgggtggaacattgtgaaacttatgagcggaaaggacgtcttctacctgccacctgaaaaatgtgatacattgctgtgcgacatcggtgagtcctctcccagccctactgtggaagagtccaggaccatacgcgtcctcaagatggtggagccatggttaaagaataaccagttctgtattaaagttctgaatccctacatgcctacagtaatcgaacatcttgagcggctgcaacgaaagcacggcgggatgctagtgagaaacccactctcaaggaattctacccatgaaatgtattggatcagtaacggaactggcaatattgtcgcatcggtgaacatggttagccgcctgttgctgaaccggtttacgatgacacacagacgtcccaccatagagaaagatgtggacctcggtgccgggactaggcacgtcaatgctgaaccggagacccctaacatggatgtgatcggagagcggattaagcgcatcaaagaagagcataattccacatggcactacgacgacgaaaacccatataagacgtgggcgtaccatggctcttatgaggtaaaggccaccggctcagcaagctccatgattaatggggtggttaaacttctgactaagccctgggatgtcgtgcctatggtgacacagatggctatgaccgacactacaccattcggacagcaacgagtctttaaagaaaaggttgataccagaacacccaggagtatgccgggtactcggcgcgtgatgggcatcaccgccgagtggttatggagaacgctggggaggaacaaaaagcctcgattgtgcacccgggaggaattcacaaagaaagtacgtactaatgcagccatgggagctgtgtttaccgaggaaaaccagtgggactctgccaaggcggcagtcgaggatgaagacttctggaaactcgtggatagagagcgcgagctgcacaagctaggcaaatgtggtagctgcgtttacaatatgatggggaagagggaaaaaaagcttggagagtttggcaaggccaaaggctcacgggctatatggtatatgtggctgggggccagatacctcgaattcgaggcactgggatttttgaacgaggaccattggttctcccgcgaaaatagttacagcggtgtggagggcgaagggctgcacaagctcggatatatccttagggatatttctaaaatccccggcggtgctatgtacgccgacgatacagctgggtgggacactcgaattaccgaggacgatctgcacaacgaagagaagatcacgcagcagatggacccagagcatcggcaattagccaatgcaatatttaaactgacatatcagaacaaggtcgtgaaggtacagagacctacccccactggaacagttatggatattatctccaggaaagaccagcgcggctcaggccaagtggggacctacggattgaatactttcaccaacatggaagcgcagctcatccgtcagatggagggtgaaggcgtcctgagcaaggccgatctagagaacccacaccttcccgaaaaaaagattacacagtggctggagacgaaaggggtggagcggctcaagagaatggctatatcgggagacgattgcgtggtcaagcctatcgacgataggtttgccaatgcactgttggctttaaacgacatgggcaaagttcgcaaggatattccacaatggcagccgtctaaaggttggcatgactggcagcaggtgcccttctgtagtcaccacttccatgaactgatcatgaaggatgggcgaaaactcgtagtgccttgccggccacaagacgagcttattggaagagccaggatctcccagggcgcaggctggagcctgaaggaaaccgcctgtctagggaaggcgtatgctcagatgtggtcactgatgtactttcaccgcagagacctccggttggcctccaatgcaatatgctctgccgtccccgtgcattgggttcctactagcaggacaacctggagtatccacgctcatcaccaatggatgactacagaggatatgctgaccgtgtggaaccgtgtctggattgaagacaatccatggatggaggataaaacgcccgtgacaacctgggagaacgtaccttatcttggaaagcgagaagaccagtggtgtggttccctgatcggcctcactagccgcgccacctgggcacagaatattccgacagctatccagcaagttagatctttaattgggaacgaggaattcctggattacatgccatcaatgaaacggtttaggaaggaggaggaaagtgagggagccatatggtga

SEQ ID NO: 15274 - RNA, 9873 nt, synthetic construct
  misc_feature 1..9873: note = derived and/or modified CDS sequence (opt3) from DENV-3__GQ199865__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcagaattcagggggaactagtatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtacaagaaggggagcagtattggaaaaatgtttgaagctactgcccgcggtgcaagaaggatggccatactgggcgacaccgcttgggatttcgggtctgtgggaggcgttctcaactccctgggtaagatggtgcatcagatctttgggagcgcctatacggcacttttctcgggcgtctcttgggtgatgaaaattggaatcggcgtactgttgacatggatcgggctcaattccaagaacacctcaatgagttttagctgcattgcgataggaatcattactctgtacttaggcgctgtggttcaggccgacatgggttgtgtcatcaattggaaagggaaggagctgaagtgcggatccggcattttcgtgacaaacgaggtgcacacctggactgaacagtataaatttcaagcagattctcccaagcggctagccaccgctatcgccggtgcatgggagaatggcgtctgtgggatacgaagcacaacgcgcatggaaaacctcctgtggaaacagatcgctaatgagcttaactacattttgtgggaaaataacatcaagctgaccgttgtggtgggagacattatcggcgtactcgagcaggggaaaagaactctgacaccacagcctatggagttaaagtattcatggaaaacctggggaaaggccaagatagtcacagcggaaactcaaaacagttccttcattatcgatggccccaataccccagagtgccccagcgtgtctagggcctggaacgtttgggaagtggaggactacggttttggggtcttcacgacaaatatttggctgaaacttcgggaagtgtatacccagttgtgtgaccaccgcctcatgtcagctgcagttaaggatgagagagccgtgcatgctgacatgggatactggatcgagagtcagaaaaacggcagctggaagctggaaaaagcctccctaatagaggtaaagacttgcacctggcctaagtctcacacactgtggtcgaatggtgtcctcgaaagcgatatgatcattccaaaatccctggcaggcccgatctcacagcataaccacaggcccgggtaccacactcaaaccgcgggaccttggcatcttggcaagttggagctggactttaattattgcgaggggacaacggtggtgattaccgaaaactgtggaactcgtggcccaagtttacggacaaccactgtctctggtaaactcatccacgagtggtgctgtcgaagctgcacactgccccctcttagatacatgggggaagatggatgttggtatggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcatatgatcgccggggtgttctttacgttcgttctactgctctccggacagattacttggcgggatatggcacacaccctgatcatgattggcagtaatgctagcgacagaatgggtatgggggtgacataccttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttatcagctttggaccgccctgatctccttgacgtgttcaaacacaatattcaccctcactgtggcctggcgaaccgctacactgatcctagcaggtgttagtctgcttcctatgtgccaaagctcgtccatgcggaagactgactggctcccaatggccgtggcggctatgggcgtcccccctctgcccttgtttattttctctctgaaggataccttaaaacgtagaagctggccactcaatgagggggtaatggccgtgggactggtttcaatccttgcaagttccctgttgaggaacgacgtgcctatggccggccccctcgtcgctggtgggctgctaattgcatgttacgtgatcacgggaacatctgccgatctgaccgtagaaaaggcggctgacataacttggggcgaggaagccgagcagacaggcgtgagccatatgcttatgattaccgtcgaagacgatgggactatgcgcatcaaagacgatgagacagagaacatcctcaccgttctgttgaagacggcattactgattgtgtccggaatatttccatattcaatcccggccactctcctggtgtggcacacctggcagaaacagacacaacggagcggtgtcctttgggacgtgcctagtcccccagaaacccagaaggctgagctggaagagggcgtttacagaattaaacagcaggggatcttcggaaagacacaagtaggcgtgggtgtccagaaggagggggtgtttcacactatgtggcatgttaccaggggagccgtgttgacgtacaatggcaaacgactagaacccaactgggcatctgtcaagaaagatctgatttcctatggcgggggatggcgcctcagcgctcagtggcaaaagggtgaggaagtgcaggtaatcgccgtcgagcctggcaaaaatccaaagaacttccagacaatgcccgggactttccagaccacaaccggagaaataggcgcgatcgccctggactttaagcctggtacttcggggtcaccgattatcaatcgggagggaaaagtggttggcctttacggcaacggggtggtcaccaagaatggaggttatgtgtctggcattgcacaaacaaacgctgagccagatgggcccacgcctgaattagaggaagagatgttcaaaaagagaaatctgactatcatggacctccacccaggaagtggcaaaaccaggaagtacttgcccgccatagttcgtgaagctattaagcgccggctgagaacactcatcctggcacctaccagggtggtcgccgccgagatggaggaagctcttaaaggtctgccgatccgatatcagactacagcgaccaagtccgagcatacggggcgggaaattgtggatttgatgtgccacgcaacttttacaatgcgcctactgagccccgtaagagtgccaaactacaatctcatcataatggacgaggcccatttcaccgatcctgcttctattgccgcaaggggatatatcagcacccgggttggcatgggcgaagccgctgcgatttttatgactgccacacccccagggaccgcagacgctttccctcagtccaacgcccccatccaggatgaggagcgagacataccagaaagatcatggaatagtggaaacgagtggattacagactttgcaggtaaaactgtctggttcgtgccgagcatcaaggccggcaatgatatcgctaactgtttacgcaaaaacgggaagaaggtgattcaactgtctaggaaaacgtttgacaccgaataccagaagacaaaacttaatgattgggacttcgtcgtaactaccgatatctccgagatgggagccaactttaaggcggaccgtgtgattgatcctcggagatgcctgaaacccgttatactcacagacggcccagagagggtgatcttggcaggtcccatgcctgtcaccgccgcttcagccgctcagcgccgagggagagtgggccggaatccacagaaggaaaacgatcaatacattttcactggacagcccctgaataacgacgaggatcacgcacactggacggaagccaagatgctcctggacaatatcaacacccctgagggcatcattccggctcttttcgaaccagagagggagaaaagtgccgcaatagacggggaatatcgcctaaagggagagagccgtaaaacatttgttgaactgatgagacggggtgatttgcccgtgtggttagcgcataaggtcgcctccgagggcatcaaatacactgacaggaagtggtgcttcgatgggcagcgcaataaccagattctggaagagaatatggacgtggagatctggaccaaagaaggagagaagaagaaactccgacctagatggctggatgctcggacatattctgacccccttgccctgaaggaatttaaagagttcgcagctggcaggaagtcgattgccctcgatttggtaaccgaaatcggtcgcgtgccaagccacctggcacatagaactaggaacgccctagacaatctggttatgctccacacatcagagcacgggggccgggcttaccgtcatgcggtcgaggaacttcctgagacgatggaaaccctgttattgctgggactcatgatactgcttactggcggggccatgctgtttctcatctccggaaaaggtattggcaagacaagtatcgggttgatttgtgtgatcgcatctagcggaatgctgtggatggctgagatacccttacaatggattgcctccgccatcgtgctagagttctttatgatggtcctgctcattccagaacctgagaagcagcgcaccccgcaggataaccaacttgcatatgttgtgatcggcatactgaccttggctgccatcattgcggctaatgaaatgggtctgctcgagacaactaaacgagacctggggatgtcaaaggaacccggcgtagtgtctccaacgagctaccttgatgtcgacctccaccctgccagtgcatggaccctgtatgccgtggctacaactgttatcacccccatgttgagacatacaattgagaactccaccgcaaatgtgagcctggccgcgatcgctaaccaggccgtcgtattaatgggactagataaaggctggccaatatctaagatggacctgggggtgcctctccttgcactgggatgctactcacaggttaaccccttgactctgacggccgctgtgctcctgcttattacacactacgccatcatcggcccgggtttacaggcaaaagctaccagggaggcccaaaagcggactgcggccgggattatgaagaatccaaccgtcgacggaatcatgacaatagatctggaccctgtgatttatgattccaaattcgaaaagcagctcggccaggtcatgttgctggtgctatgtgcagttcagctgctccttatgcgcactagttgggctctgtgcgaggccttgaccctggcaacaggtcccatcacgaccctctgggaaggcagcccagggaaattttggaacactacaattgctgtgtcgatggccaatatcttcagaggatcttacctggccggcgcggggttagctttttccataatgaagagcgtaggaaccggcaaaaggggtactgggtcacaaggagagacacttggcgaaaagtggaagaaaaagctgaaccagctcagtcggaaagacttcgatctatataagaaatctggtatcaccgaggtggaccgaacggaggcaaaggaaggcctgaaaagaggggagattacccatcacgccgtctcccgcggaagcgctaagttgcagtggtttgttgaaaggaatatggtgatccccgagggccgggtcattgatctggggtgtggacgtggcggttggtcatactattgcgccgggctcaagaaagtgacagaagtaagaggatacactaagggcggccctgggcacgaggagccggtgcccatgagtacctatggatggaacatcgttaaacttatgagcggtaaggacgtgttctacctgccacctgaaaaatgtgatacattgctgtgcgacattggcgagtcctctcccagccctactgtcgaagagtccaggaccatccgcgtgctcaagatggtcgagccatggttaaagaataaccagttctgtataaaagtgctgaatccctacatgcctacagttattgaacatcttgagcggctgcaacgaaagcacgggggaatgctagtaagaaacccactctcaaggaattctacccatgaaatgtattggatcagtaacggcactggtaatatcgtggcatcggtcaacatggtgagccgcctgttgctgaatcggtttacgatgacacacagacgtcccaccattgagaaagatgttgacctcggggccggaactaggcacgtgaacgctgaaccggagacccctaacatggatgtcataggcgagcggatcaagcgcattaaagaagagcataattccacatggcactacgacgacgaaaacccatataagacgtgggcgtaccatggctcttatgaggtgaaggccaccgggtcagcaagctccatgatcaatggagtagtgaaacttctgactaagccctgggatgttgtccctatggtgacacagatggctatgaccgacactacaccattcggtcagcaacgagtgtttaaagaaaaggtcgataccagaacacccaggagtatgccgggcactcggcgcgttatggggattaccgccgagtggttatggagaacgctgggaaggaacaaaaagcctcgattgtgcacccgggaggaattcacaaagaaagtgcgtactaatgcagccatgggcgctgtatttaccgaggaaaaccagtgggactctgccaaggcggcagtggaggatgaagacttctggaaactcgtcgatagagagcgcgagctgcacaagctaggtaaatgtgggagctgcgtgtacaatatgatgggaaagagggaaaaaaagcttggcgagtttggcaaggccaaagggtcacgggctatctggtatatgtggctgggagccagatacctcgaattcgaggcactgggttttttgaacgaggaccattggttctcccgcgaaaatagttacagcggcgttgagggggaaggactgcacaagctcggctatatacttagggatatctctaaaattcccggtggggctatgtacgccgacgatacagctggatgggacactcgaatcaccgaggacgatctgcacaacgaagagaagattacgcagcagatggacccagagcatcggcaattagccaatgcaatctttaaactgacatatcagaacaaggtggtcaaggtgcagagacctacccccactggcacagtaatggatataatttccaggaaagaccagcgcggctcagggcaagttggaacctacggtttgaatactttcaccaacatggaagcgcagctcatccgtcagatggagggcgaaggggtgctgagcaaggccgatctagagaatccacaccttcccgaaaaaaagatcacacagtggctggagacgaaaggagtcgagcggctcaagagaatggctatttcgggcgacgattgcgtggtgaagcctatagacgataggtttgccaacgcactgttggctttaaacgacatgggtaaagtccgcaaggatatcccacaatggcagccgtctaaagggtggcatgactggcagcaggttcccttctgtagtcaccacttccatgaactgattatgaaggatggacgaaaactcgtggtaccttgccggccacaagacgagcttatcggcagagccaggatttcccagggcgcagggtggagcctgaaggaaaccgcctgtctaggaaaggcgtatgctcagatgtggtcactgatgtactttcaccgcagagacctccggttggcctccaatgcaatctgctctgccgtgcccgtccattgggtgcctactagcaggacaacctggagtatacacgctcatcaccaatggatgactacagaggatatgctgaccgtttggaaccgtgtgtggatcgaagacaatccatggatggaggataaaacgcccgtcacaacctgggagaacgtgccttatcttggtaagcgagaagaccagtggtgtggctccctgattgggctcactagccgcgccacctgggcacagaatatcccgacagctattcagcaagtaagatctttaatcggaaacgaggaattcctggattacatgccatcaatgaaacggtttaggaaggaggaggaaagtgagggcgccatttggtga

SEQ ID NO: 15275 - RNA, 9873 nt, synthetic construct
  misc_feature 1..9873: note = derived and/or modified CDS sequence (opt3) from DENV-3__GQ199870__SS-prME
  source 1..9873: mol_type = other RNA
accagcctgtgcctcatgatgatccttcccgcagctctggcattccacttgacatccagagacggcgaacctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagcatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgactaagaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagccggtgttagtctgcttcctgtgtgccaaagctcgtccatgcggaagactgactggctcccaatggccgtcgcggctatgggcgtaccccctctgcccttgtttattttcgggctgaaggataccttaaaacgtagatcttggccactcaatgagggagtgatggccgttggcctggtgagcatccttgcatcaagtctgttgaggaacgacgtccctatggccggtcccctcgtggctgggggactgctaattgcatgttatgtaatcacgggcacatccgccgatctgaccgtggaaaaggcggctgacataacttgggaggaagaggccgaacagacaggcgtctctcacaaccttatgattaccgttgacgatgacgggactatgcgcatcaaagatgacgagacagagaatatcctcaccgtgctgttgaagacggcattactgattgtgagcggaatatttccatactccatcccggccactctcctggtctggcatacctggcagaaacagacacaacggtcaggtgtgctttgggatgttcctagtcccccagaaacccagaaggctgagctggaagagggcgtatacagaattaaacagcaggggatcttcggaaagacacaagtgggcgtcggtgtgcagaaggagggggtttttcacactatgtggcacgtgaccaggggagccgtcttgacgtataacggcaaacgactagaacccaattgggcaagtgtgaagaaagacctgatttcttacggcgggggatggcgcctctccgctcagtggcaaaagggtgaggaagtacaggtcatcgccgtggagcctggcaaaaacccaaagaatttccagacaatgcccgggactttccagaccacaaccggagaaataggcgcgatcgccctggattttaagcctggtactagcgggtcgccgattatcaaccgggagggaaaagttgtgggcctttatggcaatggggtcgtgaccaagaacggaggttacgtttcaggcattgcacaaacaaatgctgagccagacgggcccacgcctgaattagaggaagagatgttcaaaaagagaaacctgactatcatggatctccatccaggatctggcaaaaccaggaagtatttgcccgccatagtgcgtgaagctattaagcgccggctgagaacactcatcctggcacctaccagggtcgtggccgccgagatggaggaagctcttaaaggtctgccgatccgataccagactacagcgaccaagagtgagcacacggggcgggaaattgtagacttgatgtgccatgcaacttttacaatgcgcctactgtcccccgtgagagttccaaattataacctcatcataatggatgaggcccacttcaccgaccctgctagcattgccgcaaggggatacatctctacccgggtcggcatgggcgaagccgctgcgatttttatgactgccacacccccagggaccgcagatgctttccctcagagcaatgcccccatccaggacgaggagcgagacataccagaaagatcctggaactcaggaaatgagtggattacagattttgcaggtaaaactgtgtggttcgtgccgagtatcaaggccggcaacgacatcgctaactgtttacgcaaaaatgggaagaaggtcattcaactgagcaggaaaacgtttgataccgaataccagaagacaaaacttaacgactgggatttcgtagtgactaccgacatctctgagatgggagccaattttaaggcggatcgtgttattgaccctcggagatgcctgaaacccgtgatactcacagatggcccagagagggtcatcttggcaggtcccatgcctgtgaccgccgcttccgccgctcagcgccgagggagagttggccggaacccacagaaggaaaatgaccaatatattttcactggacagcccctgaacaatgatgaggaccatgcacactggacggaagccaagatgctcctggacaacatcaatacccctgagggcatcattccggctcttttcgaaccagagagggagaaatcagccgcaatagatggggaataccgcctaaagggagagagtcgtaaaacatttgtggaactgatgagacggggtgacttgcccgtctggttagcgcacaaggtggccagcgagggcatcaaatatactgataggaagtggtgcttcgacgggcagcgcaacaatcagattctggaagagaacatggatgtagagatctggaccaaagaaggagagaagaagaaactccgacctagatggctggacgctcggacatactccgatccccttgccctgaaggaatttaaagagttcgcagctggcaggaagtctattgccctcgacttggtgaccgaaatcggtcgcgttccatcgcatctggcacacagaactaggaatgccctagataacctggtcatgctccatacaagcgagcacgggggccgggcttatcgtcacgcggtggaggaacttcctgagacgatggaaaccctgttattgctgggactcatgatactgcttactggcggggccatgctgtttctcatctcaggaaaaggtattggcaagacatccatcgggttgatttgtgtgatcgcaagttctggaatgctgtggatggctgagatacccttacaatggattgccagcgccatcgtcctagagttctttatgatggttctgctcattccagaacctgagaagcagcgcaccccgcaggacaatcaacttgcatacgtggtaatcggcatactgaccttggctgccatcattgcggctaacgaaatgggtctgctcgagacaactaaacgagatctggggatgtccaaggaacccggcgtggtctcaccaacgtcttatcttgacgtggatctccatcctgccagcgcatggaccctgtacgccgttgctacaactgtgatcacccccatgttgagacacacaattgagaatagtaccgcaaacgtctccctggccgcgatcgctaaccaggccgtagtgttaatgggactagacaaaggctggccaataagcaagatggacctgggggttcctctccttgcactgggatgctactctcaggtgaatcccttgactctgacggccgctgtcctcctgcttattacacattatgccatcatcggcccgggtttacaggcaaaagctaccagggaggcccaaaagcggactgcggccgggattatgaagaacccaaccgtggatggaatcatgacaatagacctggatcctgtcatttacgactcaaaattcgaaaagcagctcggccaggtgatgttgctggttctatgtgcagtgcagctgctccttatgcgcacttcctgggctctgtgcgaggccttgaccctggcaacaggtcccatcacgaccctctgggaaggcagtccagggaaattttggaatactacaattgctgtaagcatggccaacatcttcagaggatcgtatctggccggcgcggggttagctttttctataatgaagtccgtgggaaccggcaaaaggggtactgggagccaaggagagacacttggcgaaaagtggaagaaaaagctgaatcagctctcacggaaagatttcgacctatacaagaaaagtggtatcaccgaggtcgatcgaacggaggcaaaggaaggcctgaaaagaggggagattacccaccatgccgtttctcgcggatccgctaagttgcagtggtttgtggaaaggaacatggtcatccccgagggccgggtgattgacctggggtgtggacgtggcggttggagctattactgcgccgggctcaagaaagtaacagaagtgagaggatatactaagggcggccctgggcacgaggagccggttcccatgtcaacctacggatggaatatcgtgaaacttatgagtggtaaggatgtcttctacctgccacctgaaaaatgtgacacattgctgtgcgatattggcgagagctccccctctcctactgtggaagagagcaggaccatccgcgtcctcaagatggtggagccatggttaaagaacaatcagttctgtataaaagttctgaacccctatatgcctacagtaattgaacaccttgagcggctgcaacgaaagcatgggggaatgctagtgagaaatccactctccaggaactcaacccacgaaatgtcttggatcagtaatggcactggtaacatcgtcgcatcggtgaatatggttagccgcctgttgctgaaccggtccacgatgacacatagacgtcccaccattgagaaagacgtggatctcggggccggaccgaggcacgtcaacgctgaccctgaaccacccaatatggacgtgataggcgagcggatcaagcgcgtaaaagaggaacacaactctacttggcattacgatgacgagaatccttataagacctgggcgtaccacggctcatatgaagtgaaggccacagggagcgcatccagtatgattaacggagttgtcaaacttctgacgaagccatgggatgtggtgcccatggtcccgcagatggctatgaccgacactacaccttttggtcagcaacgagttttcaaagagaaggtggataccagaactcccaggtctatcccaggcacacggcgcgtaatggggattaccgccgaatggttatggagaacactgggaaggaataaaaagcctcgattgtgcactcgggaggagtttaccaagaaagtgcgtacgaacgcagccatgggcgctgtcttcaccgaagagaatcagtgggacagcgccaaggcggcagtggaagatgaggacttttggaaactcgttgatagagaacgcgagctgcataagctaggtaaatgtgggtcatgcgtgtacaacatgatgggaaagagggagaagaaacttggcgagttcggcaaagccaaagggtcccgggctatctggtatatgtggctgggagccagatacctcgagtttgaagcactgggtttcttgaatgaggaccactggtttagtcgcgagaacagctactctggcgtcgaaggggagggactgcataagctcggctatatacttagggatatctccaaaattcccggtggggctatgtacgccgacgacacagctggatgggatactcgaatcaccgaagacgatctgcacaatgaggaaaagattacacagcagatggacccagagcaccggcaattagccaacgcaatcttcaaactgacttatcagaataaggtggtaaaggttcagagacccacccctacgggcacagtgatggatataatttcaaggaaagaccagcgcggcagcgggcaagtcggaacctacggtttgaacacttttacaaatatggaggcgcagctcatccgtcagatggaaggcgagggggtgctgtcgaaggccgatctagaaaacccacatcttccggagaaaaagatcacccagtggctggaaactaaaggagtggagcggctcaagagaatggctatttctggcgacgattgcgtcgttaagcccatagacgataggttcgccaacgcactgttggctttaaatgacatgggtaaagtgcgcaaggatatccctcaatggcagccaagtaaagggtggcacgactggcagcaggtacccttttgttcccatcacttccacgagctgattatgaaggacggacgaaaactcgtggtcccttgccggccacaagatgaacttatcggcagagccaggattagccagggcgcagggtggtcactgaaggagaccgcctgtctaggaaaggcgtatgctcagatgtggtccctgatgtacttccatcgcagagacctccggttggcctctaacgcaatctgcagcgccgtgcccgttcactgggtgcctacaagtaggacgacctggtccatacatgctcaccatcaatggatgactacagaagatatgctgaccgtctggaatcgtgtgtggatcgaggacaacccgtggatggaagataaaactccagtaacaacctgggagaatgttccctatcttggtaagcgagaggaccagtggtgtggcagcctgattgggctcacgtctcgcgccacatgggcacagaacatccctaccgctattcagcaagtgagatcattaatcggaaatgaagagtttctggattacatgcccagtatgaaacggttcaggaaggaagaggagtccgaaggcgccatttggtga

SEQ ID NO: 15276 - RNA, 9873 nt, synthetic construct
  misc_feature 1..9873: note = derived and/or modified CDS sequence (opt3) from DENV-3__JF937630__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacgcttttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgtgtctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggtgttctttaccttcgttctactgctctccggacagattacgtggcgggatatggctcatactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatggcggtcgctgccatgggcgtaccccctctgcccttgtttattttctctctgaaggatactttaaaacgtagaagctggccactcaatgagggggtgatggcagttggactggtgtcaatccttgccagttccctgttgaggaacgacgtccctatggctggccccctcgtggcaggtgggctgctaattgcctgttatgtaatcaccggaacgtctgcggatctgacagtggaaaaggctgccgacataacctgggaggaagaggcagaacagactggcgtcagccacaaccttatgattacagttgacgatgacggcaccatgcgcatcaaagatgacgagactgagaatatcctcacagtgctgttgaagaccgccttactgattgtgtccgggatatttccatactcaatcccggctacgctcctggtctggcatacttggcagaaacagacccaacggagcggagtgctttgggatgttcctagtcccccagaaacacagaaggccgagctggaagagggtgtatacagaattaaacagcagggcatcttcgggaagacccaagtgggagtcggcgtgcagaaggagggtgtttttcacacaatgtggcacgtgactaggggggcagtcttgacctataacggaaaacgactagaacccaattgggcttctgtgaagaaagacctgatttcctacggcggcgggtggcgcctcagcgcccagtggcaaaagggagaggaagtacaggtcatcgcggtggagcctggtaaaaacccaaagaatttccagacgatgcccggcacattccagactaccacaggggaaataggagccatcgcactggattttaagcctggcacctcgggttcaccgattatcaaccgggaggggaaagttgtgggactttatggcaatggcgtcgtgactaagaacgggggatacgtttctggtattgctcaaaccaatgccgagccagacggccccacacctgaattagaggaagagatgttcaaaaagagaaacctgacgatcatggatctccatccagggagtggaaaaactaggaagtatttgcccgctatagtgcgtgaagcaattaagcgccggctgagaaccctcatcctggcccctacaagggtcgtggccgctgagatggaggaagcgcttaaaggcctgccgatccgataccagaccactgcaacaaagtccgagcacaccggtcgggaaattgtagacttgatgtgccatgccacgtttactatgcgcctactgagccccgtgagagttccaaattataacctcatcataatggatgaggctcacttcacagaccctgcctctattgcagccagggggtacatcagcacccgggtcggaatgggcgaagctgcggccatttttatgaccgcaactcccccaggcacagctgatgccttccctcagtccaatgcacccatccaggacgaggagcgagacataccagaaagatcatggaacagtgggaatgagtggattaccgattttgccggaaaaacagtgtggttcgtgccgagcatcaaggctggtaacgacatcgccaactgtttacgcaaaaatggcaagaaggtcattcaactgtctaggaaaacttttgatacggaataccagaagaccaaacttaacgactgggatttcgtagtgacaactgacatctccgagatgggggcgaattttaaggcagatcgtgttattgaccctcggagatgcctgaaacccgtgatactcaccgatggaccagagagggtcatcttggccggccccatgcctgtgacagctgcctcagctgcacagcgccgaggtagagttgggcggaacccacagaaggaaaatgaccaatatattttcaccggccagcccctgaacaatgatgaggaccatgcccactggactgaagctaagatgctcctggacaacatcaatacgcctgagggaatcattccggcccttttcgaaccagagagggagaaaagtgcagcgatagatggcgaataccgcctaaagggggagagccgtaaaacctttgtggaactgatgagacggggagacttgcccgtctggttagcccacaaggtggcttccgagggtatcaaatatacagataggaagtggtgcttcgacggccagcgcaacaatcagattctggaagagaacatggatgtagagatctggactaaagaaggggagaagaagaaactccgacctagatggctggacgcccggacctactctgatccccttgcactgaaggaatttaaagagttcgctgccggaaggaagtcgattgcactcgacttggtgacagaaatcggccgcgttccaagccatctggcccacagaaccaggaatgctctagataacctggtcatgctccatacttcagagcacggtgggcgggcgtatcgtcacgccgtggaggaacttcctgagacaatggaaacgctgttattgctgggcctcatgatactgcttaccggaggcgcaatgctgtttctcatctccgggaaaggaattggtaagactagtatcggcttgatttgtgtgatcgcttctagcgggatgctgtggatggccgagatacccttacaatggattgcctccgcaatcgtcctagagttctttatgatggttctgctcattccagaacctgagaagcagcgcacaccgcaggacaatcaacttgcttacgtggtaatcggaatactgaccttggccgcgatcattgctgccaacgaaatgggcctgctcgagaccacaaaacgagatctgggtatgtcaaaggaacccggggtggtctctccaactagctatcttgacgtggatctccatcctgcaagtgcctggacgctgtacgctgttgcaaccacagtgatcactcccatgttgagacacaccattgagaattccacagccaacgtcagcctggcggctatcgccaaccaggcagtagtgttaatgggcctagacaaaggatggccaatatctaagatggacctgggcgttcctctccttgccctggggtgctactcacaggtgaatcccttgaccctgactgctgccgtcctcctgcttattacgcattatgcaatcatcggaccgggcttacaggctaaagccacaagggaggcgcaaaagcggaccgccgcaggtattatgaagaacccaactgtggatgggatcatgaccatagacctggatcctgtcatttacgactccaaattcgaaaagcagctcggacaggtgatgttgctggttctatgtgctgtgcagctgctccttatgcgcacaagttgggccctgtgcgaggcattgactctggctaccggccccatcacaacgctctgggaaggtagcccaggcaaattttggaataccactattgccgtatcgatggccaacatcttcagagggtcttatctggcgggagctggcttagcattttccataatgaagagcgtggggacaggaaaaaggggcaccggttcacaaggggagactcttggagaaaagtggaagaaaaagctgaatcagctcagtcggaaagatttcgacctatacaagaaatctggcatcacagaggtcgatcgaaccgaggccaaggaaggtctgaaaagaggcgagattacgcaccatgctgtttcccgcgggagcgccaagttgcagtggtttgtggaaaggaacatggtcatccccgagggacgggtgattgacctgggctgtgggcgtggaggctggtcatattactgcgcaggtctcaagaaagtaaccgaagtgagagggtatacaaagggaggccctggccacgaggagccggttcccatgagtacttacgggtggaatatcgtgaaacttatgagcggaaaggatgtcttctacctgccacctgaaaaatgtgacaccttgctgtgcgatattggtgagtcctctcccagccctacagtggaagagtccaggactatccgcgtcctcaagatggtggagccatggttaaagaacaatcagttctgtataaaagttctgaacccctatatgcctaccgtaattgaacaccttgagcggctgcaacgaaagcatggcgggatgctagtgagaaatccactctcaaggaactctacacacgaaatgtactggatcagtaatggaaccggcaacatcgtcgcctcggtgaatatggttagccgcctgttgctgaaccggtttactatgacgcatagacgtcccacaattgagaaagacgtggatctcggtgctgggaccaggcacgtcaacgcggaaccggagactcctaatatggacgtgataggagagcggatcaagcgcattaaagaagagcacaactccacctggcattatgacgatgaaaatccatacaagacatgggcctatcacggctcttacgaggtaaaggcaacgggctcagctagctccatgatcaacggggtggttaaacttctgaccaagccctgggacgtcgtgcctatggtgactcagatggccatgacagataccactccattcggacagcaacgagtctttaaagaaaaggttgacacaagaacccccaggagtatgccgggtacacggcgcgtgatgggcattactgcagagtggttatggagaaccctggggaggaataaaaagcctcgattgtgcacgcgggaggaattcaccaagaaagtacgtacaaacgccgctatgggagccgtgtttactgaggaaaatcagtgggattctgcgaaggcagccgtcgaggacgaagatttctggaaactcgtggacagagagcgcgagctgcataagctaggcaaatgtggtagctgcgtttataacatgatggggaagagggaaaaaaagcttggagagtttggcaaggctaaaggctcacgggccatctggtacatgtggctgggggcaagatacctcgaattcgaggctctgggatttttgaatgaggatcactggttctcccgcgaaaacagttatagcggtgtggagggcgaagggctgcataagctcggatacatacttagggacatctctaaaattcccggcggtgccatgtatgctgatgacaccgccgggtgggacacacgaatcactgaggatgacctgcacaatgaagagaagattacccagcagatggatccagagcaccggcaattagcaaacgcgatctttaaactgacgtaccagaataaggtcgtgaaggtacagagacctacacccaccggaactgttatggacataatttccaggaaagatcagcgcggctcaggccaagtggggacatatggattgaacaccttcactaatatggaagcccagctcatccgtcagatggagggtgaaggcgtcctgagcaaggctgacctagagaacccacatcttcccgaaaaaaagatcacccagtggctggagacaaaaggggtggagcggctcaagagaatggccatttcgggagatgactgcgtggtcaagcctatagatgacaggtttgcaaacgctctgttggccttaaatgatatgggcaaagttcgcaaggacatcccacaatggcagccgtctaaaggttggcacgattggcagcaggtgcccttctgtagtcatcacttccacgaactgattatgaaggacgggcgaaaactcgtagtgccttgccggccacaagacgagcttatcggaagagcaaggatttcccagggcgccggctggagcctgaaggaaacggcgtgtctagggaaggcttacgcccagatgtggtcactgatgtattttcatcgcagagatctccggttggcatccaacgccatctgctctgctgtccccgtgcactgggttcctaccagcaggactacatggagtatacatgcccaccatcaatggatgaccactgaggacatgctgacagtgtggaatcgtgtctggatcgaagataacccatggatggaggacaaaacccccgtgacgacatgggagaatgtaccttaccttggaaagcgagaagatcagtggtgtggttccctgattggcctcaccagccgcgcaacttgggctcagaacatcccgaccgccattcagcaagttagatctttaatcgggaatgaggaattcctggactacatgccatcaatgaaacggtttaggaaggaggaggaaagtgagggagcgatttggtga

SEQ ID NO: 15277 - RNA, 9873 nt, synthetic construct
  misc_feature 1..9873: note = derived and/or modified CDS sequence (opt3) from DENV-3__JN000936__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtggttttcacgtttgtgctactgctctccggacagattacttggcgggatatggcacataccctgatcatgattggcagtaatgctagcgacagaatgggtatgggggtcacatatcttgccttgatagcaaccttcaaaatccagccctttctggccttaggattctttctcaggaagctgacttctcgcgaaaaccttctgctaggcgtgggcctcgctatggcgacaaccctgcaattgccggaggatattgaacagatggccaatgggatcgcactgggattaatggctctcaaactgattacacagttcgagatctaccagctttggactgccctgatatccttgacctgttcaaacacgatctttacactcaccgttgcctggcgaactgctaccctgattctagcaggtgtgagtctgcttcctatgtgccaaagctcgtccatgcggaagacagactggctcccaatggccgtcgcggctatgggcgtaccccctctgcccttgttcatcttttctctgaaggatactttaaaacgtagaagctggccactcaatgagggggtgatggccgttggactggtgtcaattcttgcaagttccctgttgaggaacgacgtccctatggccggccccctcgtggctggtgggctgctaatcgcatgttatgtaataaccggaacgtctgccgatctgacagtggaaaaggcggctgacattacctgggaggaagaggccgaacagactggcgtcagccacaaccttatgatcacagttgacgatgacggcaccatgcgcatcaaagatgacgagactgagaatattctcacagtgctgttgaagaccgcattactgatagtgtccgggatcttcccatactcaattccggccacgctcctggtctggcatacttggcagaaacagacccaacggagcggagtgctttgggatgttcctagtcccccagaaacacagaaggctgagctggaagagggtgtatacagaatcaaacagcagggcatttttgggaagacccaagtgggagtcggcgtgcagaaggagggtgttttccacacaatgtggcacgtgactaggggggccgtcttgacctataacggaaaacgactagaacccaattgggcatctgtgaagaaagacctgatctcctacggcggcgggtggcgcctcagcgctcagtggcaaaagggagaggaagtacaggtcatagccgtggagcctggtaaaaacccaaagaattttcagacgatgcccggcacattccagactaccacaggggaaatcggagcgattgccctggatttcaagcctggcacctcgggttcaccgatcattaaccgggaggggaaagttgtgggactttatggcaatggcgtcgtgactaagaacgggggatacgtttctggtatcgcacaaaccaatgctgagccagacggccccacacctgaattagaggaagagatgtttaaaaagagaaacctgacgataatggatctccatccagggagtggaaaaactaggaagtatttgcccgccattgtgcgtgaagctatcaagcgccggctgagaaccctcatcctggcacctacaagggtcgtggccgccgagatggaggaagctcttaaaggcctgccgattcgataccagaccactgcgacaaagtccgagcacaccggtcgggaaatcgtagacttgatgtgccatgcaacgttcactatgcgcctactgagccccgtgagagttccaaattataacctcataattatggatgaggcccactttacagaccctgcttctatcgccgcaagggggtacattagcacccgggtcggaatgggcgaagccgctgcgatcttcatgaccgccactcccccaggcacagcagatgcttttcctcagtccaatgcccccatacaggacgaggagcgagacattccagaaagatcatggaacagtgggaatgagtggatcaccgatttcgcaggaaaaacagtgtggtttgtgccgagcatcaaggccggtaacgacattgctaactgtttacgcaaaaatggcaagaaggtcatccaactgtctaggaaaactttcgatacggaataccagaagaccaaacttaacgactgggattttgtagtgacaactgacatttccgagatgggggccaatttcaaggcggatcgtgttatagaccctcggagatgcctgaaacccgtgatcctcaccgatggaccagagagggtcattttggcaggccccatgcctgtgacagccgcttcagccgctcagcgccgaggtagagttgggcggaacccacagaaggaaaatgaccaatatatctttaccggccagcccctgaacaatgatgaggaccatgcacactggactgaagccaagatgctcctggacaacatcaatacgcctgagggaattataccggctcttttcgaaccagagagggagaaaagtgccgcaatcgatggcgaataccgcctaaagggggagagccgtaaaaccttcgtggaactgatgagacggggagacttgcccgtctggttagcgcacaaggtggcctccgagggtattaaatatacagataggaagtggtgctttgacggccagcgcaacaatcagatcctggaagagaacatggatgtagagatttggactaaagaaggggagaagaagaaactccgacctagatggctggacgctcggacctactctgatccccttgccctgaaggaattcaaagagtttgcagctggaaggaagtcgatcgccctcgacttggtgacagaaataggccgcgttccaagccatctggcacacagaaccaggaatgccctagataacctggtcatgctccatacttcagagcacggtgggcgggcttatcgtcacgcggtggaggaacttcctgagacaatggaaacgctgttattgctgggcctcatgatcctgcttaccggaggcgccatgctgttcctcatttccgggaaaggaatcggtaagactagtattggcttgatctgtgtgataacatctagcgggatgctgtggatggcagagattcccttacaatggatcgcttccgccattgtcctagagtttttcatgatggttctgctcatcccagaacctgagaagcagcgcaccccgcaggacaatcaacttgcctacgtggtaataggaatcctgaccttggcagctattatcgccgcgaacgaaatgggcctgctcgagacaactaaacgagatctgggtatgtcaaaggaacccggggtggtctctccaacgagctatcttgacgtggatctccatcctgctagtgcctggaccctgtacgcagttgccacaactgtgattacccccatgttgagacacacaatcgagaattccaccgctaacgtcagcctggcagccatagcgaaccaggctgtagtgttaatgggcctagacaaaggatggccaatttctaagatggacctgggcgttcctctccttgccctggggtgctactcacaggtgaatcccttgactctgacggcagccgtcctcctgcttatcacacattatgctatcattggaccgggcttacaggccaaagcaaccagggaggctcaaaagcggactgccgcgggtatcatgaagaacccaaccgtggatgggataatgacaattgacctggatcctgtcatctacgactccaaatttgaaaagcagctcggacaggtgatgttgctggttctatgtgccgtgcagctgctccttatgcgcactagttgggcactgtgcgaggctttgaccctggccacaggccccattacgaccctctgggaaggtagcccaggcaaattctggaatactacaatcgcagtatcgatggctaacatatttagagggtcttatctggccggagccggcttagcgttctccatcatgaagagcgtggggaccggaaaaaggggcactggttcacaaggggagacacttggagaaaagtggaagaaaaagctgaatcagctcagtcggaaagattttgacctatacaagaaatctggcattaccgaggtcgatcgaacggaggctaaggaaggtctgaaaagaggcgagatcacccaccatgcagtttcccgcgggagcgccaagttgcagtggttcgtggaaaggaacatggtcattcccgagggacgggtgatcgacctgggctgtgggcgtggaggctggtcatattactgcgctggtctcaagaaagtaacagaagtgagagggtatactaagggaggccctggccacgaggagccggttcccatgagtacctacgggtggaatattgtgaaacttatgagcggaaaggatgtcttttacctgccacctgaaaaatgtgacacattgctgtgcgatatcggtgagtcctctcccagccctactgtggaagagtccaggaccatacgcgtcctcaagatggtggagccatggttaaagaacaatcagttctgtattaaagttctgaacccctatatgcctacagtaatcgaacaccttgagcggctgcaacgaaagcatggcgggatgctagtgagaaatccactctcaaggaactctacccacgaaatgtactggatcagtaatggaactggcaacattgtcgcctcggtgaatatggttagccgcctgttgctgaaccggttcacgatgacacatagacgtcccaccatagagaaagacgtggatctcggtgcagggactaggcacgtcaacgccgaaccggagacccctaatatggacgtgatcggagagcggattaagcgcatcaaagaagagcacaactccacatggcattatgacgatgaaaatccatacaagacgtgggcttatcacggctcttacgaggtaaaggcgaccggctcagccagctccatgattaacggggtggttaaacttctgactaagccctgggacgtcgtgcctatggtgacacagatggcaatgaccgatactacaccatttggacagcaacgagtcttcaaagaaaaggttgacaccagaacacccaggagtatgccgggtactcggcgcgtgatgggcatcaccgctgagtggttatggagaacgctggggaggaataaaaagcctcgattgtgcacccgggaggaatttacaaagaaagtacgtactaacgccgcaatgggagccgtgttcaccgaggaaaatcagtgggattctgctaaggccgcggtcgaggacgaagatttttggaaactcgtggacagagagcgcgagctgcataagctaggcaaatgtggtagctgcgtttataacatgatggggaagagggaaaaaaagcttggagagttcggcaaggcaaaaggctcacgggccatatggtacatgtggctgggggctagatacctcgaatttgaggccctgggattcttgaatgaggatcactggttttcccgcgaaaacagttatagcggtgtggagggcgaagggctgcataagctcggatacatccttagggacatttctaaaatccccggcggtgcaatgtatgctgatgacacagccgggtgggacactcgaattaccgaggatgacctgcacaatgaagagaagatcacgcagcagatggatccagagcaccggcaattagctaacgccatattcaaactgacataccagaataaggtcgtgaaggtacagagacctacccccactggaacagttatggacattatctccaggaaagatcagcgcggctcaggccaagtggggacctatggattgaacacttttaccaatatggaagcacagctcatccgtcagatggagggtgaaggcgtcctgagcaaggcggacctagagaacccacatcttcccgaaaaaaagattacacagtggctggagacgaaaggggtggagcggctcaagagaatggccatatcgggagatgactgcgtggtcaagcctatcgatgacaggttcgctaacgccctgttggcattaaatgatatgggcaaagttcgcaaggacattccacaatggcagccgtctaaaggttggcacgattggcagcaggtgcccttttgtagtcatcacttccacgaactgatcatgaaggacgggcgaaaactcgtagtgccttgccggccacaagacgagcttattggaagagctaggatctcccagggcgccggctggagcctgaaggaaaccgcatgtctagggaaggcctacgcgcagatgtggtcactgatgtatttccatcgcagagatctccggttggcttccaacgccatatgctctgcagtccccgtgcactgggttcctactagcaggacaacctggagtatccatgcccaccatcaatggatgactacagacgatatgctgaccgtgtggaatcgtgtctggattgaggacaacccatggatggaagataaaacgcccgtgacaacctgggagaatgtaccttaccttggaaagcgagaggaccagtggtgtggttccctgatcggcctcactagccgcgctacctgggcccagaacattccgacagcaatccagcaagttagatctttaattgggaatgaagagtttctggattacatgccatcaatgaaacggttcaggaaggaagaggagagtgaaggagctatatggtga

SEQ ID NO: 15278 - RNA, 9873 nt, synthetic construct
  misc_feature 1..9873: note = derived and/or modified CDS sequence (opt3) from DENV-3__HQ541796__SS-prME
  source 1..9873: mol_type = other RNA
accagcctgtgcctcatgatgatccttcccgcagctctggcattccacttgacatccagagacggcgaacctagaatgattgtggggaagaacgaacggggtaaatctttactgtttaagactgcctcaggtataaatatgtgtacgctaatcgcgatggatctcggcgaaatgtgcgacgataccgtcacctacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagcatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgactaagaaggaggaacccgtaaacattgaggcagaaccgcctttcggcgagtcaaatactgtcatcggaatcggcgataacgccttgaaaattaattggtataagaaggggagcagtatcggaaaaatgtttgaagctaccgcccgcggtgcaagaaggatggccattctgggcgacacggcttgggatttcgggtctgtgggaggcgttctcaactccctgggtaagatggtgcaccagatatttgggagcgcctacacagcacttttctcgggcgtctcttgggtgatgaaaatcggaattggcgtactgttgacctggatcgggctcaattccaagaacacttcaatgagttttagctgcatcgcgattggaataatcacactgtatttaggcgctgtggttcaggccgacatgggttgtgtcattaattggaaagggaaggagctgaagtgcggatccggcatcttcgtgaccaacgaggtgcatacttggaccgaacagtacaaatttcaagcagattctcccaagcggctagccacagctattgccggtgcatgggagaatggcgtctgtgggatccgaagcacgacccgcatggaaaacctcctgtggaaacagatagctaatgagcttaactatatcttgtgggaaaataacattaagctgactgttgtggtgggagacatcattggcgtactcgagcaggggaaaagaacactgaccccacagcctatggagttaaagtactcatggaaaacatggggaaaggccaagatcgtcactgcggaaacccaaaacagttccttcataattgatggccccaatacgccagagtgccccagcgtgtctagggcctggaacgtttgggaagtggaggactatggttttggggtcttcacaaccaatatctggctgaaacttcgggaagtgtacactcagttgtgtgaccaccgcctcatgtcagctgcagttaaggatgagagagccgtgcacgctgacatgggatactggattgagagtcagaaaaacggcagctggaagctggaaaaagcctccctaatcgaggtaaagacctgcacatggcctaagtctcatactctgtggtcgaatggtgtcctcgaaagcgatatgataatcccaaaatccctggcaggcccgatttcacagcacaaccataggcccgggtatcacacccaaacagcgggaccttggcaccttggcaagttggagctggactttaattactgcgaggggacgaccgtggtgatcactgaaaactgtggaacacgtggcccaagtttacggaccactacagtctctggtaaactcattcatgagtggtgctgtcgaagctgcaccctgccccctcttagatatatgggggaagatggatgttggtacggcatggagatcaggccaatatccgaaaaggaggagaatatggttaaatcactggtgagcgccggttctggcaaggtagacaacttcacgatgggggtgttgtgcctcgctattctgtttgaagaggtcatgcgcggaaagttcggcaaaaagcacatgatcgccggggtgttctttactttcgttctactgctctccggacagatcacctggcgggatatggcacatacactgattatgatcggcagtaatgctagcgacagaatgggtatgggggtgacctatcttgccttgattgcaacttttaaaatacagcccttcctggccttaggatttttcctcaggaagctgacatctcgcgaaaaccttctgctaggcgtcggcctcgctatggcgaccacactgcaattgccggaggatatcgaacagatggccaatgggattgcactgggattaatggctctcaaactgatcactcagtttgagacctaccagctttggacggccctgatttccttgacatgttcaaacaccatcttcactctcaccgtggcctggcgaacagctactctgatactagccggtgttagtctgcttcctgtgtgccaaagctcgtccatgcggaagaccgactggctcccaatggccgtcgcggctatgggcgtaccccctctgcccttgtttatcttcgggctgaaggatacgttaaaacgtagatcttggccactcaatgagggagtgatggccgttggcctggtgagcattcttgcatcaagtctgttgaggaacgacgtccctatggccggtcccctcgtggctgggggactgctaatcgcatgttatgtaattacaggcacctccgccgatctgactgtggaaaaggcggctgacatcacatgggaggaagaggccgaacagaccggcgtctctcacaaccttatgataactgttgacgatgacgggacaatgcgcattaaagatgacgagaccgagaatatcctcacggtgctgttgaagactgcattactgatcgtgagcggaatttttccatactccataccggccaccctcctggtctggcatacatggcagaaacagacccaacggtcaggtgtgctttgggatgttcctagtcccccagaaacacagaaggctgagctggaagagggcgtatacagaatcaaacagcaggggattttcggaaagactcaagtgggcgtcggtgtgcagaaggagggggtttttcacaccatgtggcacgtgacgaggggagccgtcttgacatataacggcaaacgactagaacccaattgggcaagtgtgaagaaagacctgatctcttacggcgggggatggcgcctctccgctcagtggcaaaagggtgaggaagtacaggtcattgccgtggagcctggcaaaaacccaaagaatttccagactatgcccgggaccttccagacaaccactggagaaatcggcgcgatagccctggattttaagcctggtaccagcgggtcgccgatcattaaccgggagggaaaagttgtgggcctttatggcaatggggtcgtgacaaagaacggaggttacgtttcaggcatcgcacaaacgaatgctgagccagacgggcccactcctgaattagaggaagagatgttcaaaaagagaaacctgaccattatggatctccatccaggatctggcaaaacaaggaagtatttgcccgccatcgtgcgtgaagctataaagcgccggctgagaaccctcattctggcacctactagggtcgtggccgccgagatggaggaagctcttaaaggtctgccgatccgataccagacaaccgcgacgaagagtgagcacactgggcgggaaatcgtagacttgatgtgccatgcaacatttaccatgcgcctactgtcccccgtgagagttccaaattataacctcattatcatggatgaggcccacttcaccgaccctgctagcatagccgcaaggggatacatttctactcgggtcggcatgggcgaagccgctgcgatctttatgacagccacacccccagggacagcagatgctttccctcagagcaatgcccccattcaggacgaggagcgagacatcccagaaagatcctggaactcaggaaatgagtggataactgattttgcaggtaaaacggtgtggttcgtgccgagtattaaggccggcaacgacatcgctaactgtttacgcaaaaatgggaagaaggtcatccaactgagcaggaaaacctttgatacagaataccagaagactaaacttaacgactgggatttcgtagtgaccacagacatttctgagatgggagccaattttaaggcggatcgtgttatcgaccctcggagatgcctgaaacccgtgattctcaccgatggcccagagagggtcatattggcaggtcccatgcctgtgactgccgcttccgccgctcagcgccgagggagagttggccggaacccacagaaggaaaatgaccaatatatcttcacgggacagcccctgaacaatgatgaggaccatgcacactggaccgaagccaagatgctcctggacaacattaatacacctgagggcatcatcccggctcttttcgaaccagagagggagaaatcagccgcaattgatggggaataccgcctaaagggagagagtcgtaaaacttttgtggaactgatgagacggggtgacttgaccgtctggttagcgcacaaggtggccagcgagggcataaaatatacagataggaagtggtgcttcgacgggcagcgcaacaatcagatcctggaagagaacatggatgtagagatttggaccaaagaaggagagaagaagaaactccgacccagatggctggacgctcggacttactccgatcctcttgccctgaaggaatttaaagagttcgcagctggcaggaagtctatcgccctcgacttggtgacagaaattggtcgcgttccctcgcatctggcacacagaacgaggaatgccctagataacctggtcatgctccataccagcgagcacgggggccgggcttatcgtcacgcggtggaggaacttccagagactatggaaacactgttattgctgggactcatgatcctgcttaccggcggggccatgctgtttctcatatcaggaaaaggtatcggcaagacctccattgggttgatctgtgtgattgcaagttctggaatgctgtggatggctgagatccctttacaatggatagccagcgccattgtcctagagttctttatgatggttctgctcatccccgaaccagagaagcagcgcacacctcaggacaatcaacttgcatacgtggtaattggcatcctgactttggctgccataatcgcggctaacgaaatgggtctgctcgagacgaccaaacgagatctggggatgtccaaggaaccgggcgtggtctcacccacatcttatcttgacgtggatctccatccagccagcgcatggactctgtacgccgttgctaccacagtgattacccctatgttgagacacactatcgagaatagtacggcaaacgtctccctggccgcgattgctaaccaggccgtagtgttaatgggactagacaaaggctggcccatcagcaagatggacctgggggttccactccttgcactgggatgctactctcaggtgaatcctttgacactgaccgccgctgtcctcctgcttataactcattatgccattatcggccccggtttacaggcaaaagctaccagggaggcccaaaagcggacagcggccgggatcatgaagaacccgactgtggatggaattatgaccatcgacctggatccagtcatatacgactcaaaattcgaaaagcagctcggccaggtgatgttgctggttctatgtgcagtgcagctgctccttatgcgcacatcctgggctctgtgcgaggccttgacgctggcaaccggtcctattactacactctgggaaggcagtcccgggaaattttggaataccactatcgctgtaagcatggccaacattttcagaggatcgtatctggccggcgcggggttagctttttctatcatgaagtccgtgggaacaggcaaaaggggtaccgggagccaaggagagacgcttggcgaaaagtggaagaaaaagctgaatcagctctcacggaaagatttcgacctatacaagaaaagtggtataaccgaggtcgatcgaacagaggcaaaggaaggcctgaaaagaggggagatcactcaccatgccgtttctcgcggatccgctaagttgcagtggtttgtggaaaggaacatggtcattccagagggccgggtgatcgacctggggtgtggacgtggcggttggagctattactgcgccgggctcaagaaagtaaccgaagtgagaggatatacaaagggcggccccgggcacgaggagcctgttccgatgtcaacttacggatggaatattgtgaaacttatgagtggtaaggatgtcttctacctgcccccagaaaaatgtgacaccttgctgtgcgatatcggcgagagctccccttctcccacagtggaagagagcaggaccattcgcgtcctcaagatggtggagccttggttaaagaacaatcagttctgtatcaaagttctgaacccatatatgcccactgtaatagaacaccttgagcggctgcaacgaaagcatgggggaatgctagtgagaaatcctctctccaggaactcaacgcacgaaatgtactggatttctaatggcacaggtaacatcgtcgcaagtgtgaatatggtttcgcgcctgttgctgaaccggtttaccatgactcatagacgtccaaccatcgagaaagacgtggatctcggggccggaacaaggcacgtcaacgctgaacccgagacgccgaatatggacgtgattggcgagcggataaagcgcatcaaagaagaacacaacagcacctggcattatgacgatgaaaatccttacaagacttgggcgtatcacggctcctacgaggtaaaggccacagggtctgcatcaagcatgattaacggagtggttaaacttctgaccaagccatgggacgtcgtgcccatggtgactcagatggctatgacagataccacacctttcggtcagcaacgagtctttaaagaaaaggttgacactagaaccccaaggtccatgcccggcacgcggcgcgtgatggggatcaccgccgagtggttatggagaacactgggaaggaataaaaagccgcgattgtgcactcgggaggagttcaccaagaaagtacgtacaaacgcagccatgggcgctgtgtttactgaggaaaatcagtgggatagtgccaaggcggcagtcgaggacgaagatttctggaaactcgtggacagagagcgcgagctgcataagctaggtaaatgtgggtcttgcgtttataacatgatgggaaagagggagaagaaacttggcgagtttggcaaagccaaagggagccgggctatttggtacatgtggctgggagccagatacctcgagttcgaggcactgggatttttgaatgaggatcactggttctcacgcgaaaactcctatagtggcgtggagggggaaggactgcataagctcggctacatccttagggacataagcaaaatccctggtggggctatgtatgccgatgacaccgctggatgggacacgcgaattacagaggatgacctgcacaatgaagagaagatcacccagcagatggatcccgagcaccggcaattagccaacgcaatttttaaactgacttaccagaataaggtcgtgaaggtacagagaccaacacctaccggcactgttatggacatcatatctaggaaagatcagcgcggctccgggcaagtgggaacctatggtttgaacacattcacgaatatggaagcgcagctcattcgtcagatggagggcgaaggggtcctgtcaaaggccgacctagagaacccccatcttccagagaaaaagatcacccagtggctggagactaaaggagtggagcggctcaagagaatggctatcagcggcgatgactgcgtggtcaagcccattgatgacaggtttgccaacgcactgttggctttaaatgatatgggtaaagttcgcaaggacatacctcaatggcagccatcgaaagggtggcacgattggcaacaggtgccgttctgttctcatcacttccacgaactgatcatgaaggacggacgaaaactcgtagtgccctgccggcctcaagacgagcttattggcagagccaggatcagtcagggcgcagggtggtccctgaaggaaacagcctgtctaggaaaggcgtacgctcagatgtggagcctgatgtattttcatcgcagagatctccggttggcctcaaacgcaatttgctccgccgtcccagtgcactgggttcccacctctaggactacatggagcatccatgctcaccatcaatggatgaccacggaggacatgctgacagtgtggaatcgtgtctggatagaagataacccttggatggaggacaaaaccccagtgactacctgggagaatgtaccctaccttggtaagcgagaagatcagtggtgtggcagtctgatcgggctcacatcccgcgccacttgggcacagaacattcctaccgctatccagcaagttaggagcttaattggaaatgaggagttcctggactacatgccgtctatgaaacggtttaggaaggaggaggaatcagagggcgccatctggtga

SEQ ID NO: 15279 - RNA, 9873 nt, synthetic construct
  misc_feature 1..9873: note = derived and/or modified CDS sequence (opt3) from DENV-3__HQ166034__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcagaattcagggggaactagtatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtacaagaaggggagcagtattggaaaaatgtttgaagctactgcccgcggtgcaagaaggatggccatactgggcgacaccgcttgggatttcgggtctgtgggaggcgttctcaactccctgggtaagatggtgcatcagatctttgggagcgcctatacggcacttttctcgggcgtctcttgggtgatgaaaattggaatcggcgtactgttgacatggatcgggctcaattccaagaacacctcaatgagttttagctgcattgcgataggaatcattactctgtacttaggcgctgtggttcaggccgacatgggttgtgtcatcaattggaaagggaaggagctgaagtgcggatccggcattttcgtgacaaacgaggtgcacacctggactgaacagtataaatttcaagcagattctcccaagcggctagccaccgctatcgccggtgcatgggagaatggcgtctgtgggatacgaagcacaacgcgcatggaaaacctcctgtggaaacagatcgctaatgagcttaactacattttgtgggaaaataacatcaagctgaccgttgtggtgggagacattatcggcgtactcgagcaggggaaaagaactctgacaccacagcctatggagttaaagtattcatggaaaacctggggaaaggccaagatagtcacagcggaaactcaaaacagttccttcattatcgatggccccaataccccagagtgccccagcgtgtctagggcctggaacgtttgggaagtggaggactacggttttggggtcttcacgacaaatatttggctgaaacttcgggaagtgtatacccagttgtgtgaccaccgcctcatgtcagctgcagttaaggatgagagagccgtgcatgctgacatgggatactggatcgagagtcagaaaaacggcagctggaagctggaaaaagcctccctaatagaggtaaagacttgcacctggcctaagtctcacacactgtggtcgaatggtgtcctcgaaagcgatatgatcattccaaaatccctggcaggcccgatctcacagcataaccacaggcccgggtaccacactcaaaccgcgggaccttggcatcttggcaagttggagctggactttaattattgcgaggggacaacggtggtgattaccgaaaactgtggaactcgtggcccaagtttacggacaaccactgtctctggtaaactcatccacgagtggtgctgtcgaagctgcacactgccccctcttagatacatgggggaagatggatgttggtatggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcatatgatcgccggggtgttctttacgttcgttctactgctctccggacagattacttggcgggatatggcacacaccctgatcatgattggcagtaatgctagcgacagaatgggtatgggggtgacataccttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagatctatcagctttggactgccctgatatccttgacctgttcaaacacgatcttcacactcaccgtggcctggcgaactgctaccctgattctagcaggtgttagtctgcttcctatgtgccaaagctcgtccatgcggaagacagactggctcccaatggccgtggcggctatgggcgtcccccctctgcccttgtttatcttctctctgaaggatactttaaaacgtagaagctggccactcaatgagggggtaatggccgtgggactggtttcaattcttgcaagttccctgttgaggaacgacgtgcctatggccggccccctcgtcgctggtgggctgctaatcgcatgttacgtgataaccggaacgtctgccgatctgacagtagaaaaggcggctgacattacctgggaggaagaggccgaacagactggcgtgagccataaccttatgatcacagtcgacgatgacggcaccatgcgcatcaaagatgacgagactgagaatattctcacagttctgttgaagaccgcattactgatagtgtccgggatctttccatattcaattccggccacgctcctggtgtggcacacttggcagaaacagacccaacggagcggagtcctttgggatgtgcctagtcccccagaaacacagaaggctgagctggaagagggtgtttacagaatcaaacagcagggcattttcgggaagacccaagtaggagtgggcgtccagaaggagggtgtgtttcacacaatgtggcatgttactaggggggccgtgttgacctacaacggaaaacgactagaacccaattgggcatctgtcaagaaagacctgatctcctatggcggcgggtggcgcctcagcgctcagtggcaaaagggagaggaagtgcaggtaatagccgtcgagcctggtaaaaacccaaagaatttccagacgatgcccggcacattccagactaccacaggggaaatcggagcgattgccctggattttaagcctggcacctcgggttcaccgatcattaaccgggaggggaaagtggttggactttacggcaatggcgtggtcactaagaacgggggatatgtgtctggtatcgcacaaaccaatgctgagccagacggccccacacctgaattagaggaagagatgttcaaaaagagaaacctgacgataatggatctccacccagggagtggaaaaactaggaagtacttgcccgccattgttcgtgaagctatcaagcgccggctgagaaccctcatcctggcacctacaagggtggtcgccgccgagatggaggaagctcttaaaggcctgccgattcgatatcagaccactgcgacaaagtccgagcataccggtcgggaaatcgtggacttgatgtgccacgcaacgtttactatgcgcctactgagccccgtaagagtgccaaattacaacctcataattatggatgaggcccatttcacagaccctgcttctatcgccgcaagggggtatattagcacccgggttggaatgggcgaagccgctgcgatctttatgaccgccactcccccaggcacagcagatgctttccctcagtccaatgcccccatacaggacgaggagcgagacattccagaaagatcatggaacagtgggaatgagtggatcaccgattttgcaggaaaaacagtctggttcgtgccgagcatcaaggccggtaacgacattgctaactgtttacgcaaaaatggcaagaaggtgatccaactgtctaggaaaacttttgatacggaataccagaagaccaaacttaacgactgggatttcgtcgtaacaactgacatttccgagatgggggccaattttaaggcggatcgtgtgatagaccctcggagatgcctgaaacccgttatcctcaccgatggaccagagagggtgattttggcaggccccatgcctgtcacagccgcttcagccgctcagcgccgaggtagagtggggcggaacccacagaaggaaaatgaccaatacatcttcaccggccagcccctgaacaatgatgaggaccacgcacactggactgaagccaagatgctcctggacaacatcaatacgcctgagggaattataccggctcttttcgaaccagagagggagaaaagtgccgcaatcgatggcgaatatcgcctaaagggggagagccgtaaaacctttgttgaactgatgagacggggagacttgcccgtgtggttagcgcataaggtcgcctccgagggtattaaatacacagataggaagtggtgcttcgacggccagcgcaacaatcagatcctggaagagaacatggatgtggagatttggactaaagaaggggagaagaagaaactccgacctagatggctggacgctcggacctattctgatccccttgccctgaaggaatttaaagagttcgcagctggaaggaagtcgatcgccctcgacttggtaacagaaataggccgcgtgccaagccacctggcacatagaaccaggaatgccctagataacctggttatgctccacacttcagagcacggtgggcgggcttaccgtcatgcggtcgaggaacttcctgagacaatggaaacgctgttattgctgggcctcatgatcctgcttaccggaggcgccatgctgtttctcatttccgggaaaggaatcggtaagactagtattggcttgatctgtgtgatagcatctagcgggatgctgtggatggctgagattcccttacaatggatcgcctccgccattgtgctagagttctttatgatggtcctgctcatcccagaacctgagaagcagcgcacaccgcaggacaatcaacttgcatatgttgtgataggaatcctgaccttggctgccattatcgcggctaacgaaatgggcctgctcgagaccacaaaacgagatctgggtatgtcaaaggaacccggggtagtgtctccaactagctaccttgacgtcgatctccaccctgccagtgcatggacgctgtatgccgtggctaccacagttattactcccatgttgagacataccatcgagaattccacagcaaacgtgagcctggccgcgatagctaaccaggccgtcgtattaatgggcctagacaaaggatggccaatttctaagatggacctgggcgtgcctctccttgcactggggtgctactcacaggttaatcccttgaccctgactgccgctgtgctcctgcttatcacgcactacgccatcattggaccgggcttacaggcaaaagctacaagggaggcccaaaagcggaccgcggccggtatcatgaagaacccaactgtcgatgggataatgaccattgacctggatcctgtgatctatgactccaaattcgaaaagcagctcggacaggtcatgttgctggtgctatgtgttgtgcagctgctccttatgcgcacaagttgggcactgtgcgaggctttgactctggccaccggccccattacaacgctctgggaaggtagcccaggcaaattttggaataccactatcgcagtatcgatggctaacatattcagagggtcttacctggccggagccggcttagcgttttccatcatgaagagcgtggggacaggaaaaaggggcaccggttcacaaggggagactcttggagaaaagtggaagaaaaagctgaatcagctcagtcggaaagatttcgacctatataagaaatctggcattacagaggtcgatcgaaccgaggctaaggaaggtctgaaaagaggcgagatcacgcatcacgcagtttcccgcgggagcgccaagttgcagtggtttgtggaaaggaacatggtcattcccgagggacgggtgatcgacctgggctgtgggcgtggaggctggtcatactattgcgctggtctcaagaaagtaaccgaagtgagagggtacacaaagggaggccctggccacgaggagccggttcccatgagtacttatgggtggaatattgtgaaacttatgagcggaaaggatgtcttctacctgccacctgaaaaatgtgacaccttgctgtgcgatatcggtgagtcctctcccagccctacagtggaagagtccaggactatacgcgtcctcaagatggtggagccatggttaaagaacaatcagttctgtattaaagttctgaacccctacatgcctaccgtaatcgaacatcttgagcggctgcaacgaaagcacggcgggatgctagtgagaaatccactctcaaggaactctacacatgaaatgtattggatcagtaatggaaccggcaacattgtcgcctcggtgaatatggttagccgcctgttgctgaaccggtttactatgacgcacagacgtcccacaatagagaaagacgtggatctcggtgcagggaccaggcacgtcaacgccgaaccggagactcctaatatggacgtgatcggagagcggattaagcgcatcaaagaagagcataactccacctggcactacgacgatgaaaatccatataagacatgggcttaccatggctcttatgaggtaaaggcgacgggctcagccagctccatgattaacggggtggttaaacttctgaccaagccctgggacgtcgtgcctatggtgactcagatggcaatgacagataccactccattcggacagcaacgagtctttaaagaaaaggttgacacaagaacccccaggagtatgccgggtacacggcgcgtgatgggcatcactgctgagtggttatggagaaccctggggaggaataaaaagcctcgattgtgcacgcgggaggaattcaccaagaaagtacgtacaaacgccgcaatgggagccgtgtttactgaggaaaatcagtgggattctgctaaggccgcggtcgaggacgaagatttctggaaactcgtggacagagagcgcgagctgcacaagctaggcaaatgtggtagctgcgtttacaacatgatggggaagagggaaaaaaagcttggagagtttggcaaggcaaaaggctcacgggccatatggtatatgtggctgggggctagatacctcgaattcgaggccctgggatttttgaatgaggatcattggttctcccgcgaaaacagttacagcggtgtggagggcgaagggctgcacaagctcggatatatccttagggacatttctaaaatccccggcgcagctatgtacgccgatgacaccgctggttgggacacacgaattactgaggatgacctgcacaatgaagagaagatcacccagcagatggatccagagcatcggcaattagccaacgcaatatttaaactgacgtatcagaataaggtcgtgaaggtacagagacctacacccaccgggactgttatggacattatctccaggaaagatcagcgcggatcaggccaagtgggcacatacgggttgaacaccttcactaatatggaagcgcagctcatccgtcagatggagggagaaggtgtcctgagcaaggccgacctagagaacccacaccttcccgaaaaaaagattacccagtggctggagacaaaaggcgtggagcggctcaagagaatggctatatcgggggatgactgcgtggtcaagcctatcgatgacaggtttgccaacgcactgttggctttaaatgatatgggaaaagttcgcaaggacattccacaatggcagccgtctaaaggctggcatgattggcagcaggtgcccttctgtagtcaccacttccatgaactgatcatgaaggacggtcgaaaactcgtagtgccttgccggccacaagacgagcttattgggagagccaggatctcccagggagcaggctggagcctgaaggaaacggcctgtctaggcaaggcgtatgctcagatgtggtcactgatgtactttcaccgcagagatctccggttggcctccaacgcaatatgctctgccgtccccgtgcattgggttcctaccagcaggactacatggagtatccacgctcatcaccaatggatgaccactgaggacatgctgacagtgtggaatcgtgtctggattgaagataacccatggatggaggacaaaacccccgtgacgacatgggagaatgtaccttatcttgggaagcgagaagatcagtggtgtggatccctgatcggtctcaccagccgcgccacttgggcacagaacattccgaccgctatccagcaagttagatctttaattggcaatgaggaattcctggactacatgccatcaatgaaacggtttaggaaggaggaggaaagtgagggggccatatggtga

SEQ ID NO: 15280 - RNA, 9873 nt, synthetic construct
  misc_feature 1..9873: note = derived and/or modified CDS sequence (opt3) from DENV-3__HM756274__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacgcttttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgtgtctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggtgttctttaccttcgttctactgctctccggacagattacgtggcgggatatggctcatactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatggcggtcgctgccatgggcgtaccccctctgcccttgtttattttcgggctgaaggatactttaaaacgtagatcttggccactcaatgagggagtgatggcagttggcctggtgagcatccttgcctcaagtctgttgaggaacgacgtccctatggctggtcccctcgtggcagggggactgctaattgcctgttatgtaatcaccggcacgtccgcggatctgacagtggaaaaggctgccgacataacctgggaggaagaggcagaacagactggcgtctctcacaaccttatgattacagttgacgatgacgggaccatgcgcatcaaagatgacgagactgagaatatcctcacagtgctgttgaagaccgccttactgattgtgagcggaatatttccatactccatcccggctacgctcctggtctggcatacttggcagaaacagacccaacggtcaggtgtgctttgggatgttcctagccccccagaaacacagaaggccgagctggaagagggcgtatacagaattaaacagcaggggatcttcggaaagacccaagtgggcgtcggtgtgcagaaggagggggtttttcacacaatgtggcacgtgactaggggagcagtcttgacccataacggcaaacgactagaacccaattgggctagtgtgaagaaagacctgatttcttatggcgggggatggcgcctctccgcccagtggcaaaagggtgaggaagtacaggtcatcgcggtggagcctggcaaaaacccaaagaatttccagacgatgcccgggacattccagactaccacaggagaaataggcgccatcgcactggattttaagcctggtaccagcgggtcgccgattatcaaccgggagggaaaagttgtgggcctttacggcaatggggtcgtgactaagaacggaggttatgtttcaggcattgctcaaaccaatgccgagccagacgggcccacacctgaattagaggaagagatgttcaaaaagagaaacctgacgatcatggatctccacccaggatctggcaaaactaggaagtacttgcccgctatagtgcgtgaagcaattaagcgccggctgagaaccctcatcctggcccctacaagggtcgtggccgctgagatggaggaagcgcttaaaggtctgccgatccgatatcagaccactgcaacaaagagtgagcataccgggcgggaaattgtagacttgatgtgccacgccacgtttactatgcgcctactgtcccccgtgagagttccaaattacaacctcatcataatggatgaggctcatttcacagaccctgccagcattgcagccaggggatatatctctacccgggtcggcatgggcgaagctgcggccatttttatgaccgcaactcccccagggacagctgatgccttccctcagagcaatgcacccatccaggacgaggagcgagacataccagaaagatcctggaactcaggaaatgagtggattaccgattttgccggtaaaacagtgtggttcgtgccgagtatcaaggctggcaacgacatcgccaactgtttacgcaaaaatgggaagaaggtcattcaactgagcaggaaaacttttgatacggaataccagaagaccaaacttaacgactgggatttcgtagtgacaactgacatctctgagatgggagcgaattttaaggcagatcgtgttattgaccctcggagatgcctgaaacccgtgatactcaccgatggcccagagagggtcatcttggccggtcccatgcctgtgacagctgcctccgctgcacagcgccgagggagagttggccggaacccacagaaggaaaatgaccaatacattttcaccggacagcccctgaacaatgatgaggaccacgcccactggactgaagctaagatgctcctggacaacatcaatacgcctgagggcatcattccggcccttttcgaaccagagagggagaaatcagcagcgatagatggggaatatcgcctaaagggagagagtcgtaaaacctttgtggaactgatgagacggggtgacttgcccgtctggttagcccataaggtggctagcgagggcatcaaatacacagataggaagtggtgcttcgacgggcagcgcaacaatcagattctggaagagaacatggatgtagagatctggactaaagaaggagagaagaagaaactccgacctagatggctggacgcccggacctattccgatccccttgcactgaaggaatttaaagagttcgctgccggcaggaagtctattgcactcgacttggtgacagaaatcggtcgcgttccatcgcacctggcccatagaaccaggaatgctctagataacctggtcatgctccacactagcgagcacgggggccgggcgtaccgtcatgccgtggaggaacttcctgagacaatggaaacgctgttattgctgggactcatgatactgcttaccggcggggcaatgctgtttctcatctcaggaaaaggtattggcaagacttccatcgggttgatttgtgtgatcgctagttctggaatgctgtggatggccgagatacccttacaatggattgccagcgcaatcgtcctagagttctttatgatggttctgctcattccagaacctgagaagcagcgcacaccgcaggacaatcaacttgcttatgtggtaatcggcatactgaccttggccgcgatcattgctgccaacgaaatgggtctgctcgagaccacaaaacgagatctggggatgtccaaggaacccggcgtggtctcaccaacttcttaccttgacgtggatctccaccctgcaagcgcctggacgctgtatgctgttgcaaccacagtgatcactcccatgttgagacataccattgagaatagtacagccaacgtctccctggcggctatcgccaaccaggcagtagtgttaatgggactagacaaaggctggccaataagcaagatggacctgggggttcctctccttgccctgggatgctactctcaggtgaatcccttgaccctgactgctgccgtcctcctgcttattacgcactacgcaatcatcggcccgggtttacaggctaaagccacaagggaggcgcaaaagcggaccgccgcagggattatgaagaacccaactgtggatggaatcatgaccatagacctggatcctgtcatttatgactcaaaattcgaaaagcagctcggccaggtgatgttgctggttctatgtgctgtgcagctgctccttatgcgcacatcctgggccctgtgcgaggcattgactctggctaccggtcccatcacaacgctctgggaaggcagtccagggaaattttggaataccactattgccgtaagcatggccaacatcttcagaggatcgtacctggcgggcgctgggttagcattttctataatgaagtccgtgggaacaggcaaaaggggtaccgggagccaaggagagactcttggcgaaaagtggaagaaaaagctgaatcagctctcacggaaagatttcgacctatataagaaaagtggtatcacagaggtcgatcgaaccgaggccaaggaaggcctgaaaagaggggagattacgcatcacgctgtttctcgcggatccgccaagttgcagtggtttgtggaaaggaacatggtcatccccgagggccgggtgattgacctggggtgtggacgtggcggttggagctactattgcgcagggctcaagaaagtaaccgaagtgagaggatacacaaagggcggccctgggcacgaggagccggttcccatgtcaacttatggatggaatatcgtgaaacttatgagtggtaaggatgtcttctacctgccacctgaaaaatgtgacaccttgctgtgcgatattggcgagagctccccctctcctacagtggaagagagcaggactatccgcgtcctcaagatggtggagccatggttaaagaacaatcagttctgtataaaagttctgaacccctacatgcctaccgtaattgaacatcttgagcggctgcaacgaaagcacgggggaatgctagtgagaaatccactctccaggaactcaacacatgaaatgtattggatctctaatggcaccggtaacatcgtcgccagtgtgaatatggtttcgcgcctgttgctgaaccggtttactatgacgcacagacgtcccacaattgagaaagacgtggatctcggggctggaaccaggcacgtcaacgcggaaccggagactcctaatatggacgtgataggcgagcggatcaagcgcattaaagaagagcataacagcacctggcactacgacgatgaaaatccatataagacatgggcctaccatggctcctatgaggtaaaggcaacggggtctgcttcaagcatgatcaacggagtggttaaacttctgaccaagccctgggacgtcgtgcctatggtgactcagatggccatgacagataccactccattcggtcagcaacgagtctttaaagaaaaggttgacacaagaacccccaggtccatgccgggcacacggcgcgtgatggggattactgcagagtggttatggagaaccctgggaaggaataaaaagcctcgattgtgcacgcgggaggaattcaccaagaaagtacgtacaaacgccgctatgggcgccgtgtttactgaggaaaatcagtgggatagtgcgaaggcagccgtcgaggacgaagatttctggaaactcgtggacagagagcgcgagctgcacaagctaggtaaatgtgggtcttgcgtttacaacatgatgggaaagagggaaaaaaagcttggcgagtttggcaaggctaaagggagccgggccatctggtatatgtggctgggagcaagatacctcgaattcgaggctctgggttttttgaatgaggatcattggttctcacgcgaaaactcctacagtggcgtggagggggaaggactgcacaagctcggctatatacttagggacatcagcaaaattcccggtggggccatgtacgctgatgacaccgccggatgggacacacgaatcactgaggatgacctgcacaatgaagagaagattacccagcagatggatccagagcatcggcaattagcaaacgcgatctttaaactgacgtatcagaataaggtcgtgaaggtacagagacctacacccaccggcactgttatggacataatttctaggaaagatcagcgcggctccgggcaagtgggaacatacggtttgaacaccttcactaatatggaagcccagctcatccgtcagatggagggcgaaggggtcctgtcaaaggctgacctagagaacccacaccttcccgaaaaaaagatcacccagtggctggagacaaaaggagtggagcggctcaagagaatggccattagcggcgatgactgcgtggtcaagcctatagatgacaggtttgcaaacgctctgttggccttaaatgatatgggtaaagttcgcaaggacatcccacaatggcagccgtcgaaagggtggcatgattggcagcaggtgcccttctgttctcaccacttccatgaactgattatgaaggacggacgaaaactcgtagtgccttgccggccacaagacgagcttatcggcagagcaaggattagtcagggcgccgggtggtccctgaaggaaacggcgtgtctaggaaaggcttatgcccagatgtggagcctgatgtactttcaccgcagagatctccggttggcatcaaacgccatctgctccgctgtccccgtgcattgggttcctacctctaggactacatggagcatacacgcccatcaccaatggatgaccactgaggacatgctgacagtgtggaatcgtgtctggatcgaagataacccatggatggaggacaaaacccccgtgacgacatgggagaatgtaccttatcttggtaagcgagaagatcagtggtgtggcagtctgattgggctcacctcccgcgcaacttgggctcagaacatcccgaccgccattcagcaagttagaagcttaatcggaaatgaggaattcctggactacatgccatctatgaaacggtttaggaaggaggaggaatcagagggcgcgatttggtga

SEQ ID NO: 15281 - RNA, 9873 nt, synthetic construct
  misc_feature 1..9873: note = derived and/or modified CDS sequence (opt3) from DENV-3__HM756275__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcagaattcagggggaactagtatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtacaagaaggggagcagtattggaaaaatgtttgaagctactgcccgcggtgcaagaaggatggccatactgggcgacaccgcttgggatttcgggtctgtgggaggcgttctcaactccctgggtaagatggtgcatcagatctttgggagcgcctatacggcacttttctcgggcgtctcttgggtgatgaaaattggaatcggcgtactgttgacatggatcgggctcaattccaagaacacctcaatgagttttagctgcattgcgataggaatcattactctgtacttaggcgctgtggttcaggccgacatgggttgtgtcatcaattggaaagggaaggagctgaagtgcggatccggcattttcgtgacaaacgaggtgcacacctggactgaacagtataaatttcaagcagattctcccaagcggctagccaccgctatcgccggtgcatgggagaatggcgtctgtgggatacgaagcacaacgcgcatggaaaacctcctgtggaaacagatcgctaatgagcttaactacattttgtgggaaaataacatcaagctgaccgttgtggtgggagacattatcggcgtactcgagcaggggaaaagaactctgacaccacagcctatggagttaaagtattcatggaaaacctggggaaaggccaagatagtcacagcggaaactcaaaacagttccttcattatcgatggccccaataccccagagtgccccagcgtgtctagggcctggaacgtttgggaagtggaggactacggttttggggtcttcacgacaaatatttggctgaaacttcgggaagtgtatacccagttgtgtgaccaccgcctcatgtcagctgcagttaaggatgagagagccgtgcatgctgacatgggatactggatcgagagtcagaaaaacggcagctggaagctggaaaaagcctccctaatagaggtaaagacttgcacctggcctaagtctcacacactgtggtcgaatggtgtcctcgaaagcgatatgatcattccaaaatccctggcaggcccgatctcacagcataaccacaggcccgggtaccacactcaaaccgcgggaccttggcatcttggcaagttggagctggactttaattattgcgaggggacaacggtggtgattaccgaaaactgtggaactcgtggcccaagtttacggacaaccactgtctctggtaaactcatccacgagtggtgctgtcgaagctgcacactgccccctcttagatacatgggggaagatggatgttggtatggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcatatgatcgccggggtgttctttacgttcgttctactgctctccggacagattacttggcgggatatggcacacaccctgatcatgattggcagtaatgctagcgacagaatgggtatgggggtgacataccttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagatctatcagctttggactgccctgatatccttgacctgttcaaacacgatcttcacactcaccgtggcctggcgaactgctaccctgattctagcaggtgttagtctgcttcctatgtgccaaagctcgtccatgcggaagacagactggctcccaatggccgtggcggctatgggcgtcccccctctgcccttgtttatcttctctctgaaggatactttaaaacgtagaagctggccactcaatgagggggtaatggccgtgggactggtttcaattcttgcaagttccctgttgaggaacgacgtgcctatggccggccccctcgtcgctggtgggctgctaatcgcatgttacgtgataaccggaacgtctgccgatctgacagtagaaaaggcggctgacattacctgggaggaagaggccgaacagactggcgtgagccataaccttatgatcacagtcgacgatgacggcaccatgcgcatcaaagatgacgagactgagaatattctcacagttctgttgaagaccgcattactgatagtgtccgggatctttccatattcaattccggccacgctcctggtgtggcacacttggcagaaacagacccaacggagcggagtcctttgggatgtgcctagtcccccagaaacacagaaggctgagctggaagagggtgtttacagaatcaaacagcagggcattttcgggaagacccaagtaggagtgggcgtccagaaggagggtgtgtttcacacaatgtggcatgttactaggggggccgtgttgacctacaacggaaaacgactagaacccaattgggcatctgtcaagaaagacctgatctcctatggcggcgggtggcgcctcagcgctcagtggcaaaagggagaggaagtgcaggtaatagccgtcgagcctggtaaaaacccaaagaatttccagacgatgcccggcacattccagactaccacaggggaaatcggagcgattgccctggattttaagcctggcacctcgggttcaccgatcattaaccgggaggggaaagtggttggactttacggcaatggcgtggtcactaagaacgggggatatgtgtctggtatcgcacaaaccaatgctgagccagacggccccacacctgaattagaggaagagatgttcaaaaagagaaacctgacgataatggatctccacccagggagtggaaaaactaggaagtacttgcccgccattgttcgtgaagctatcaagcgccggctgagaaccctcatcctggcacctacaagggtggtcgccgccgagatggaggaagctcttaaaggcctgccgattcgatatcagaccactgcgacaaagtccgagcataccggtcgggaaatcgtggacttgatgtgccacgcaacgtttactatgcgcctactgagccccgtaagagtgccaaattacaacctcataattatggatgaggcccatttcacagaccctgcttctatcgccgcaagggggtatattagcacccgggttggaatgggcgaagccgctgcgatctttatgaccgccactcccccaggcacagcagatgctttccctcagtccaatgcccccatacaggacgaggagcgagacattccagaaagatcatggaacagtgggaatgagtggatcaccgattttgcaggaaaaacagtctggttcgtgccgagcatcaaggccggtaacgacattgctaactgtttacgcaaaaatggcaagaaggtgatccaactgtctaggaaaacttttgatacggaataccagaagaccaaacttaacgactgggatttcgtcgtaacaactgacatttccgagatgggggccaattttaaggcggatcgtgtgatagaccctcggagatgcctgaaacccgttatcctcaccgatggaccagagagggtgattttggcaggccccatgcctgtcacagccgcttcagccgctcagcgccgaggtagagtggggcggaacccacagaaggaaaatgaccaatacatcttcaccggccagcccctgaacaatgatgaggaccacgcacactggactgaagccaagatgctcctggacaacatcaatacgcctgagggaattataccggctcttttcgaaccagagagggagaaaagtgccgcaatcgatggcgaatatcgcctaaagggggagagccgtaaaacctttgttgaactgatgagacggggagacttgcccgtgtggttagcgcataaggtcgcctccgagggtattaaatacacagataggaagtggtgcttcgacggccagcgcaacaatcagatcctggaagagaacatggatgtggagatttggactaaagaaggggagaagaagaaactccgacctagatggctggacgctcggacctattctgatccccttgccctgaaggaatttaaagagttcgcagctggaaggaagtcgatcgccctcgacttggtaacagaaataggccgcgtgccaagccacctggcacatagaaccaggaatgccctagataacctggttatgctccacacttcagagcacggtgggcgggcttaccgtcatgcggtcgaggaacttcctgagacaatggaaacgctgttattgctgggcctcatgatcctgcttaccggaggcgccatgctgtttctcatttccgggaaaggaatcggtaagactagtattggcttgatctgtgtgatagcatctagcgggatgctgtggatggctgagattcccttacaatggatcgcctccgccattgtgctagagttctttatgatggtcctgctcatcccagaacctgagaagcagcgcacaccgcaggacaatcaacttgcatatgttgtgataggaatcctgaccttggctgccattatcgcggctaacgaaatgggcctgctcgagaccacaaaacgagatctgggtatgtcaaaggaacccggggtagtgtctccaactagctaccttgacgtcgatctccaccctgccagtgcatggacgctgtatgccgtggctaccacagttattactcccatgttgagacataccatcgagaattccacagcaaacgtgagcctggccgcgatagctaaccaggccgtcgtattaatgggcctagacaaaggatggccaatttctaagatggacctgggcgtgcctctccttgcactggggtgctactcacaggttaatcccttgaccctgactgccgctgtgctcctgcttatcacgcactacgccatcattggaccgggcttacaggcaaaagctacaagggaggcccaaaagcggaccgcggccggtatcatgaagaacccaactgtcgatgggataatgaccattgacctggatcctgtgatctatgactccaaattcgaaaagcagctcggacaggtcatgttgctggtgctatgtgttgtgcagctgctccttatgcgcacaagttgggcactgtgcgaggctttgactctggccaccggccccattacaacgctctgggaaggtagcccaggcaaattttggaataccactatcgcagtatcgatggctaacatattcagagggtcttacctggccggagccggcttagcgttttccatcatgaagagcgtggggacaggaaaaaggggcaccggttcacaaggggagactcttggagaaaagtggaagaaaaagctgaatcagctcagtcggaaagatttcgacctatataagaaatctggcattacagaggtcgatcgaaccgaggctaaggaaggtctgaaaagaggcgagatcacgcatcacgcagtttcccgcgggagcgccaagttgcagtggtttgtggaaaggaacatggtcattcccgagggacgggtgatcgacctgggctgtgggcgtggaggctggtcatactattgcgctggtctcaagaaagtaaccgaagtgagagggtacacaaagggaggccctggccacgaggagccggttcccatgagtacttatgggtggaatattgtgaaacttatgagcggaaaggatgtcttctacctgccacctgaaaaatgtgacaccttgctgtgcgatatcggtgagtcctctcccagccctacagtggaagagtccaggactatacgcgtcctcaagatggtggagccatggttaaagaacaatcagttctgtattaaagttctgaacccctacatgcctaccgtaatcgaacatcttgagcggctgcaacgaaagcacggcgggatgctagtgagaaatccactctcaaggaactctacacatgaaatgtattggatcagtaatggaaccggcaacattgtcgcctcggtgaatatggttagccgcctgttgctgaaccggtttactatgacgcacagacgtcccacaatagagaaagacgtggatctcggtgcagggaccaggcacgtcaacgccgaaccggagactcctaatatggacgtgatcggagagcggattaagcgcatcaaagaagagcataactccacctggcactacgacgatgaaaatccatataagacatgggcttaccatggctcttatgaggtaaaggcgacgggctcagccagctccatgattaacggggtggttaaacttctgaccaagccctgggacgtcgtgcctatggtgactcagatggcaatgacagataccactccattcggacagcaacgagtctttaaagaaaaggttgacacaagaacccccaggagtatgccgggtacacggcgcgtgatgggcatcactgctgagtggttatggagaaccctggggaggaataaaaagcctcgattgtgcacgcgggaggaattcaccaagaaagtacgtacaaacgccgcaatgggagccgtgtttactgaggaaaatcagtgggattctgctaaggccgcggtcgaggacgaagatttctggaaactcgtggacagagagcgcgagctgcacaagctaggcaaatgtggtagctgcgtttacaacatgatggggaagagggaaaaaaagcttggagagtttggcaaggcaaaaggctcacgggccatatggtatatgtggctgggggctagatacctcgaattcgaggccctgggatttttgaatgaggatcattggttctcccgcgaaaacagttacagcggtgtggagggcgaagggctgcacaagctcggatatatccttagggacatttctaaaatccccggcggtgcaatgtacgctgatgacaccgccgggtgggacacacgaattactgaggatgacctgcacaatgaagagaagatcacccagcagatggatccagagcatcggcaattagctaacgccatatttaaactgacgtatcagaataaggtcgtgaaggtacagagacctacacccaccggaactgttatggacattatctccaggaaagatcagcgcggctcaggccaagtggggacatacggattgaacaccttcactaatatggaagcacagctcatccgtcagatggagggtgaaggcgtcctgagcaaggcggacctagagaacccacaccttcccgaaaaaaagattacccagtggctggagacaaaaggggtggagcggctcaagagaatggccatatcgggagatgactgcgtggtcaagcctatcgatgacaggtttgctaacgccctgttggcattaaatgatatgggcaaagttcgcaaggacattccacaatggcagccgtctaaaggttggcatgattggcagcaggtgcccttctgtagtcaccacttccatgaactgatcatgaaggacgggcgaaaactcgtagtgccttgccggccacaagacgagcttattggaagagctaggatctcccagggcgccggctggagcctgaaggaaacggcatgtctagggaaggcctatgcgcagatgtggtcactgatgtactttcaccgcagagatctccggttggcttccaacgccatatgctctgcagtccccgtgcattgggttcctaccagcaggactacatggagtatccacgcccatcaccaatggatgaccactgaggacatgctgacagtgtggaatcgtgtctggattgaagataacccatggatggaggacaaaacccccgtgacgacatgggagaatgtaccttatcttggaaagcgagaagatcagtggtgtggttccctgatcggcctcaccagccgcgctacttgggcccagaacattccgaccgcaatccagcaagttagatctttaattgggaatgaggaattcctggactacatgccatcaatgaaacggtttaggaaggaggaggaaagtgagggagctatatggtga

SEQ ID NO: 15282 - RNA, 9873 nt, synthetic construct
  misc_feature 1..9873: note = derived and/or modified CDS sequence (opt3) from DENV-3__JF937632__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatataggggaagatggatgttggtacggcatggagattaggccaatctccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgattgccggggtgttctttacgttcgttctactgctctccggacagatcacttggcgggatatggcacataccctgattatgataggcagtaatgctagcgacagaatgggtatgggggtgacatatcttgccttgatcgcaacctttaaaattcagcccttcctggccttaggatttttcctcaggaagctgacttctcgcgaaaaccttctgctaggcgtcggcctcgctatggcgacaaccctgcaattgccggaggatatcgaacagatggccaatgggattgcactgggattaatggctctcaaactgatcacacagtttgagacttaccagctttggaccgccctgatatccttgacgtgttcaaacacaatcttcaccctcactgtggcctggcgaaccgctacactgattctagcaggtgttagtctgcttcctgtgtgccaaagctcgtccatgcggaagactgactggctcccaatggccgtcgcggctatgggcgtaccccctctgcccttgtttatcttctctctgaaggataccttaaaacgtagaagctggccactcaatgagggggtgatggccgttggactggtgtcaattcttgcaagttccctgttgaggaacgacgtccctatggccggccccctcgtggctggtgggctgctaatcgcatgttatgtaataacgggaacatctgccgatctgaccgtggaacgcgcggctgacattacttgggaggaagaggccgaacagacaggcgtcagccacaaccttatgatcaccgttgacgatgacggcactatgcggatcaaggatgacgagacagagaatattctcaccgtgctgttgaaaacggcattactgatagtgtccgggatctttccatactcaattccggccactctcctggtctggcatacctggcagaagcagacacaaagaagcggagtgctttgggatgttcctagtcccccagaaacccagaaagctgagctggaagagggtgtatacaggatcaagcagcagggcattttcgggaaaacacaagtgggagtcggcgtgcagaaggagggtgtttttcacactatgtggcacgtgacccgaggggccgtcttgacgtataacggaaagcgcctagaacccaattgggcatctgtgaaaaaggacctgatctcctacggcggcgggtggcggctcagcgctcagtggcaaaaaggagaggaagtacaggtcatagccgtggagcctggtaagaacccaaaaaatttccagacaatgcccggcactttccagaccacaaccggggaaatcggagcgattgccctggattttaagcctggcacttcgggttcaccgatcattaacagagaggggaaggttgtgggactttatggcaatggcgtcgtgaccaaaaacgggggatacgtttctggtatcgcacaaacaaatgctgagccagacggccccacgcctgaattagaggaagagatgttcaagaaaaggaacctgactataatggatctccatccagggagtggaaagacccgtaaatatttgcccgccattgtgcgcgaagctatcaagcggagactgaggacactcatcctggcacctacccgagtcgtggccgccgagatggaggaagctcttaagggcctgccgattcggtaccagactacagcgaccaaatccgagcacacgggtcgcgaaatcgtagacttgatgtgccatgcaacttttacaatgagactactgagccccgtgagggttccaaattataacctcataattatggatgaggcccacttcaccgaccctgcttctatcgccgcacgggggtacattagcacccgagtcggaatgggcgaagccgctgcgatctttatgactgccacacccccaggcaccgcagatgctttccctcagtccaatgcccccatacaggacgaggagagagacattccagaacgctcatggaacagtgggaatgagtggatcacagattttgcaggaaagactgtgtggttcgtgccgagcatcaaagccggtaacgacattgctaactgtttaaggaagaatggcaaaaaggtcatccaactgtctcgtaagacgtttgataccgaataccagaaaacaaagcttaacgactgggatttcgtagtgactaccgacatttccgagatgggggccaattttaaagcggatcgggttatagaccctagaaggtgcctgaagcccgtgatcctcacagatggaccagagcgcgtcattttggcaggccccatgcctgtgaccgccgcttcagccgctcagcgaagaggtcgggttgggaggaacccacagaaagaaaatgaccaatatatcttcactggccagcccctgaacaatgatgaggaccatgcacactggacggaagccaagatgctcctggacaacatcaatacccctgagggaattataccggctcttttcgaaccagagcgcgagaagagtgccgcaatcgatggcgaataccgtctaaaaggggagagcagaaagacatttgtggaactgatgcggaggggagacttgcccgtctggttagcgcacaaagtggcctccgagggtattaagtatactgatcgcaaatggtgcttcgacggccagcgaaacaatcagatcctggaagagaacatggatgtagagatttggaccaaggaaggggagaaaaagaagctcagacctcggtggctggacgctaggacatactctgatccccttgccctgaaagaatttaaggagttcgcagctggacgcaaatcgatcgccctcgacttggtgaccgaaataggcagagttccaagccatctggcacacaggactcggaatgccctagataacctggtcatgctccatacatcagagcacggtgggcgtgcttatcgccacgcggtggaggaacttcctgagacgatggaaaccctgttattgctgggcctcatgatcctgcttactggaggcgccatgctgtttctcatttccgggaagggaatcggtaaaacaagtattggcttgatctgtgtgatagcatctagcgggatgctgtggatggctgagattcccttacaatggatcgcctccgccattgtcctagagttctttatgatggttctgctcatcccagaacctgagaagcagcgaaccccgcaggacaatcaacttgcatacgtggtaataggaatcctgaccttggctgccattatcgcggctaacgaaatgggcctgctcgagacaactaagagagatctgggtatgtcaaaagaacccggggtggtctctccaacgagctatcttgacgtggatctccatcctgccagtgcatggaccctgtacgccgttgctacaactgtgattacccccatgttgaggcacacaatcgagaattccaccgcaaacgtcagcctggccgcgatagctaaccaggccgtagtgttaatgggcctagacaagggatggccaatttctaaaatggacctgggcgttcctctccttgcactggggtgctactcacaggtgaatcccttgactctgacggccgctgtcctcctgcttatcacacattatgccatcattggaccgggcttacaggcaaaggctacccgggaggcccaaaaacgcactgcggccggtatcatgaagaacccaaccgtggatgggataatgacaattgacctggatcctgtcatctacgactccaagttcgaaaaacagctcggacaggtgatgttgctggttctatgtgcagtgcagctgctccttatgagaactagttgggctctgtgcgaggccttgaccctggcaacaggccccattacgaccctctgggaaggtagcccaggcaagttttggaatactacaatcgctgtatcgatggccaacatattcagggggtcttatctggccggagcgggcttagctttttccatcatgaaaagcgtggggaccggaaagcggggcactggtccccaaggggagacacttggagaaaaatggaagaagaaactgaatcagctctcacgaaaggatttcgacctatacaaaaagagtggcattaccgaggtcgatagaacggaggcaaaagaaggtctgaagcgcggcgagatcacccaccatgccgtttctagggggtccgctaaattgcagtggtttgtggaacggaacatggtcattcctgagggacgtgtgatcgacctgggctgtgggagaggaggctggagctattactgcgccggtctcaagaaggtaacagaagtgagggggtatactaaaggaggcccgggccacgaggagcccgttccaatgtcaacctacgggtggaatattgtgaagcttatgagtggaaaagatgtcttctacctgcctcccgaaaagtgtgacacattgctgtgcgatatcggtgagagctccccttctccaactgtggaagagagccgcaccatacgggtcctcaaaatggtggagccctggttaaagaacaatcagttctgtattaaggttctgaacccttatatgccaacagtaatcgaacaccttgagcgactgcaaagaaaacatggcgggatgctagtgaggaatcccctctcccgcaactcaacccacgaaatgtactggatctctaatggaactggcaacattgtcgcaagtgtgaatatggtttcgcggctgttgctgaacagatttacgatgacacatcgtaggccgaccatagagaaggacgtggatctcggtgccgggactcggcacgtcaacgctgaacctgagaccccaaatatggacgtgatcggagagcgcattaaacgaatcaaggaagagcacaacagcacatggcattatgacgatgaaaatccctacaaaacgtgggcgtatcacggctcctacgaggtaaaggccaccggctctgcatcaagcatgattaacggggtggttaagcttctgactaaaccttgggacgtcgtgccaatggtgacacagatggctatgaccgatactacacccttcggacagcaaagagtctttaaggaaaaagttgacaccaggacaccgcggtccatgcctggtactcgcagagtgatgggcatcaccgccgagtggttatggaggacgctggggcgaaataagaaaccccggttgtgcacccgtgaggaattcacaaagaaggtaagaactaacgcagccatgggagctgtgtttaccgaggaaaatcagtgggatagtgccaaagcggcagtcgaggacgaagatttctggaagctcgtggaccgcgagagggagctgcataaactaggcaagtgtggttcttgcgtttataacatgatggggaaacgggaaaagaaacttggagagtttggcaaggccaagggcagcagagctatatggtacatgtggctgggggcccgctacctcgaattcgaggcactgggatttttgaatgaggatcactggttctcaagggaaaactcctatagtggtgtggagggcgaagggctgcatcgactcggatacatccttcgggacattagcaaaatcccaggcggtgctatgtatgccgatgacacagctgggtgggacactagaattaccgaggatgacctgcacaatgaagagaagatcacgcagcagatggatcctgagcacaggcaattagccaacgcaatatttaaactgacataccagaataaggtcgtgaaagtacagcgccccaccccaactggaacagttatggacattatctctcgtaaggatcagcggggctccggccaagtggggacctatggattgaacactttcaccaatatggaagcgcagctcatcagacagatggagggtgaaggcgtcctgtcaaaggccgacctagagaacccccatcttcctgaaaaaaagattacacagtggctggagacgaaaggggtggagaggctcaagcgcatggctataagcggagatgactgcgtggtcaaaccaatcgatgaccgatttgccaacgcactgttggctttaaatgatatgggcaaggttcggaaggacattccgcaatggcagccctcgaaaggttggcacgattggcagcaggtgcctttctgttctcatcacttccacgaactgatcatgaaggacgggagaaaactcgtagtgccatgcaggccccaagacgagcttattggacgcgccagaatcagtcagggcgcaggctggtccctgaaggaaaccgcctgtctagggaaagcgtacgctcagatgtggagcctgatgtattttcatcggagggatctccgtttggcctcaaacgcaatatgctccgccgtccctgtgcactgggttccaacttctcgaacaacctggagcatccatgctcaccatcaatggatgactacagaggacatgctgaccgtgtggaatcgcgtctggattgaagataacccctggatggaggacaagacgcctgtgacaacctgggagaatgtaccgtaccttggaaagagagaagatcagtggtgtggtagtctgatcggcctcacttcccgggccacctgggcacagaacattccaacagctatccagcaagttaggagcttaattgggaatgaggaattcctggactacatgccctctatgaaacgctttagaaaggaggaggaatcagagggagccatatggtga

SEQ ID NO: 15283 - RNA, 9873 nt, synthetic construct
  misc_feature 1..9873: note = derived and/or modified CDS sequence (opt3) from DENV-3__HM756281__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcgtgaattggaaagggaaggagctgaagtgcggatccggcatcttcgtgacaaacgaggtccatacctggactgaacagtacaaatttcaagcagattctcccaagcggctagccaccgctattgccggtgcatgggagaatggcgtttgtgggatccgaagcacaacgcgcatggaaaacctcctgtggaaacagatagctaatgagcttaactatatcttgtgggaaaataacattaagctgaccgtggtggtaggagacatcattggcgtcctcgagcaggggaaaagaactctgacaccacagcctaaggagttaaaatactcatggaagacctggggaaaggccaaaatcgtgacagcggaaactcaaaacagttccttcataattgatggccccaataccccagagtgccccagcgtttctagggcctggaacgtgtgggaagtcgaggactatggttttggggtgttcacgacaaatatctggctgaagcttcgggaagtttacacccagttgtgtgaccaccgcctcatgtcagctgcagtgaaagatgagagagccgtacacgctgacatgggatactggattgagagtcagaagaacggcagctggaaactggaaaaggcctccctaatcgaggtcaagacttgcacctggcctaaatctcatacactgtggtcgaatggtgtgctcgaaagcgatatgataatcccaaagtccctggcaggcccgatttcacagcacaaccataggcccgggtatcacactcaaaccgcgggaccttggcaccttggcaaattggagctggactttaattactgcgaggggacaacggtggtcatcaccgaaaactgtggaactcgtggcccaagtttacggacaaccactgtttctggtaagctcattcatgagtggtgctgtcgaagctgcacactgccccctcttagatatatgggggaagatggatgttggtacggcatggagatcaggccaatatccgaaaaagaggagaatatggtgaagtcactggtaagcgccggttctggcaaggtggacaacttcaccatgggggtcttgtgcctcgctattctgtttgaagaggtgatgcgcggaaaattcggcaagaaacacatgatcgccggggttttctttacgttcgtgctactgctctccggacagatcacttggcgggatatggcacataccctgattatgatcggcagtaatgctagcgacagaatgggtatgggggtcacatatcttgccttgattgcaacctttaagatacagcccttcctggccttaggatttttcctcaggaaactgacttctcgcgaaaaccttctgctaggcgtgggcctcgctatggcgacaaccctgcaattgccggaggatatcgaacagatggccaatgggattgcactgggattaatggctctcaagctgatcacacagtttgagacttaccagctttggaccgccctgatttccttgacgtgttcaaacacaatcttcaccctcactgttgcctggcgaaccgctacactgatactagcaggtgtgagtctgcttcctgtctgccaaagctcgtccatgcggaagactgactggctcccaatggccgtagcggctatgggcgtgccccctctgcccttgtttatcttctctctgaaagataccttaaagcgtagaagctggccactcaatgagggggttatggccgtgggactggtctcaattcttgcaagttccctgttgaggaacgacgtgcctatggccggccccctcgtagctggtgggctgctaatcgcatgttatgtgattacgggaacatctgccgatctgaccgtcgaaaaagcggctgacatcacttgggaggaagaggccgaacagacaggcgttagccacaaccttatgataaccgtggacgatgacggcactatgcgcattaaggatgacgagacagagaatatcctcaccgtgctgttgaaaacggcattactgatcgtctccgggatttttccatactcaataccggccactctcctggtgtggcatacctggcagaagcagacacaacggagcggagttctttgggatgtacctagtcccccagaaacccagaaagctgagctggaagagggtgtgtacagaatcaagcagcagggcattttcgggaagacacaagtcggagtgggcgttcagaaagagggtgtgtttcacactatgtggcacgtcaccaggggggccgtgttgacgtataacggaaagcgactagaacccaattgggcatctgtaaaaaaggacctgatctcctacggcggcgggtggcgcctcagcgctcagtggcaaaaaggagaggaagtccaggtgattgccgttgagcctggtaagaacccaaagaatttccagacaatgcccggcactttccagaccacaaccggggaaatcggagcgatagccctggattttaaacctggcacttcgggttcaccgatcattaaccgggaggggaaggtggtcggactttatggcaatggcgtggttaccaaaaacgggggatacgtgtctggtatcgcacaaacaaatgctgagccagacggccccacgcctgaattagaggaagagatgttcaagaaaagaaacctgactattatggatctccatccagggagtggaaagaccaggaagtatttgcccgccatcgtccgtgaagctataaaacgccggctgagaacactcattctggcacctaccagggtggtagccgccgagatggaggaagctcttaagggcctgccgatccgataccagactacagcgaccaaatccgagcacacgggtcgggaaatcgtggacttgatgtgccatgcaacttttacaatgcgcctactgagccccgttagagtcccaaattataacctcattatcatggatgaggcccacttcaccgaccctgcttctatagccgcaagggggtacattagcacccgggtgggaatgggcgaagccgctgcgatctttatgactgccacacccccaggcaccgcagatgctttccctcagtccaatgcccccattcaggacgaggagcgagacatcccagaaagatcatggaacagtgggaatgagtggataacagattttgcaggaaagactgtgtggttcgtcccgagcattaaagccggtaacgacatcgctaactgtttacgcaagaatggcaagaaagtaatccaactgtctaggaagacgtttgataccgaataccagaaaacaaagcttaacgactgggatttcgtggttactaccgacatttccgagatgggggccaattttaaagcggatcgtgtgatcgaccctcggagatgcctgaagcccgtcattctcacagatggaccagagagggtgatattggcaggccccatgcctgttaccgccgcttcagccgctcagcgccgaggtagagtggggcggaacccacagaaggaaaatgaccaatatatcttcactggccagcccctgaacaatgatgaggaccatgcacactggacggaagccaaaatgctcctggacaacattaatacccctgagggaatcatcccggctcttttcgaaccagagagggagaagagtgccgcaattgatggcgaataccgcctaaaaggggagagccgtaagacatttgtcgaactgatgagacggggagacttgcccgtgtggttagcgcacaaagtagcctccgagggtataaagtatactgataggaaatggtgcttcgacggccagcgcaacaatcagatcctggaagagaacatggatgtggagatttggaccaaggaaggggagaagaaaaagctccgacctagatggctggacgctcggacatactctgatccccttgccctgaaagaatttaaggagttcgcagctggaaggaaatcgatcgccctcgacttggttaccgaaattggccgcgtcccaagccatctggcacacagaactaggaatgccctagataacctggtgatgctccatacatcagagcacggtgggcgggcttatcgtcacgcggtggaggaacttcctgagacgatggaaaccctgttattgctgggcctcatgatcctgcttactggaggcgccatgctgtttctcatatccgggaagggaatcggtaagacaagtattggcttgatctgtgtcattgcatctagcgggatgctgtggatggctgagatccccttacaatggatagcctccgccattgttctagagttctttatgatggtgctgctcatcccagaacctgagaaacagcgcaccccgcaggacaatcaacttgcatacgtagtgattggaatcctgaccttggctgccataatcgcggctaacgaaatgggcctgctcgagacaactaagcgagatctgggtatgtcaaaagaacccggggtcgtgtctccaacgagctatcttgacgttgatctccatcctgccagtgcatggaccctgtacgccgtggctacaactgtcattacccccatgttgagacacacaatcgagaattccaccgcaaacgtaagcctggccgcgattgctaaccaggccgtggttttaatgggcctagacaagggatggccaatctctaaaatggacctgggcgtgcctctccttgcactggggtgctactcacaggtcaatcccttgactctgacggccgctgtgctcctgcttataacacattatgccattatcggaccgggcttacaggcaaaggctaccagggaggcccaaaagcggactgcggccggtatcatgaaaaacccaaccgtcgatgggattatgacaatcgacctggatcctgtgatatacgactccaagttcgaaaaacagctcggacaggttatgttgctggtgctatgtgcagtacagctgctccttatgcgcactagttgggctctgtgcgaggccttgaccctggcaacaggccccattacgaccctctgggaaggtagcccaggcaagttttggaatactacaatcgctgtgtcgatggccaacattttcagagggtcttatctggccggagcgggcttagctttttccatcatgaaaagcgtcgggaccggaaagaggggcactggttcacaaggggagacacttggagaaaagtggaaaaagaaactgaatcagctcagtcggaaggatttcgacctatacaaaaagtctggcataaccgaggttgatcgaacggaggcaaaagaaggtctgaagagaggcgagatcacccaccatgccgtgtcccgcgggagcgctaagttgcagtggtttgtcgaaaggaacatggtgattcccgagggacgggtaatcgacctgggctgtgggcgtggaggctggtcatattactgcgccggtctcaaaaaggtgacagaagttagagggtatactaaaggaggccctggccacgaggagccggtgcccatgagtacctacgggtggaatattgtcaagcttatgagcggaaaagatgtgttctacctgccacctgaaaagtgtgacacattgctgtgcgatatcggtgagtcctctcccagccctactgtcgaagagtccaggaccattcgcgtgctcaagatggttgagccatggttaaaaaacaatcagttctgtatcaaggtactgaacccctatatgcctacagtgatagaacaccttgagcggctgcaacgaaaacatggcgggatgctagtcagaaatccactctcaaggaactctacccacgaaatgtactggattagtaatggaactggcaacatcgtggcatcggttaatatggtgagccgcctgttgctgaaccggtttacgatgacacatagacgtcccaccatcgagaaggacgtcgatctcggtgccgggactaggcacgtgaacgctgaaccggagacccctaatatggacgtaattggagagcggataaaacgcatcaaggaagagcacaactccacatggcattatgacgatgaaaatccatacaagacgtgggcgtatcacggctcttacgaggtgaaagccaccggctcagcaagctccatgattaacggggttgtcaagcttctgactaaaccctgggacgtggtgcctatggtcacacagatggctatgaccgatactacaccattcggacagcaacgagtttttagagaaaaggtggacaccaggacaccccggagtatgccgggtactcgcagagtaatgggcatcaccgccgagtggttatggaggacgctggggcgaaataaaaagcctcggttgtgcacccgtgaggaattcacaaagaaagtgagaactaacgcagccatgggagctgtctttaccgaggaaaatcagtgggattctgccaaggcggcagtggaggacgaagatttctggaaactcgttgaccgcgagagggagctgcataagctaggcaaatgtggtagctgcgtgtataacatgatggggaagcgggaaaaaaagcttggagagtttggcaaggccaaaggctcaagagctatttggtacatgtggctgggggcccgctacctcgaattcgaggcactgggatttttgaatgaggatcactggttctccagggaaaacagttatagcggtgtcgagggcgaagggctgcataagctcggatacatccttcgagacatatctaaaatccccggcggtgctatgtatgccgatgacacagctgggtgggacactcggattaccgaggatgacctgcacaatgaagagaagatcacgcagcagatggatccagagcacagacaattagccaacgcaatttttaaactgacataccagaataaggtggtaaaggttcagaggcctacccccactggaacagtgatggacatcatatcccgcaaagatcagcgtggctcaggccaagtcgggacctatggattgaacactttcaccaatatggaagcgcagctcattcggcagatggagggtgaaggcgtgctgagcaaggccgacctagagaacccacatcttcccgaaaaaaagatcacacagtggctggagacgaaaggggtggagagactcaagaggatggctatctcgggagatgactgcgtcgttaagcctattgatgaccgctttgccaacgcactgttggctttaaatgatatgggcaaagtgcgaaaggacataccacaatggcagccgtctaaaggttggcacgattggcagcaggtacccttctgtagtcatcacttccacgaactgatcatgaaggacgggcggaaactcgtggtcccttgcagaccacaagacgagcttattggaagggcccgcatctcccagggcgcaggctggagcctgaaggaaaccgcctgtctagggaaggcgtacgctcagatgtggtcactgatgtattttcatagacgggatctcaggttggcctccaacgcaatttgctctgccgtgcccgttcactgggtgcctactagccgtacaacctggagtatccatgctcaccatcaatggatgactacagaggacatgctgaccgtctggaatcgagtgtggatagaagataacccatggatggaggacaaaacgcccgtaacaacctgggagaatgttccttaccttggaaagcgcgaagatcagtggtgtggttccctgatcggcctcactagcagagccacctgggcacagaacattccgacagctatccagcaagtgcggtctttaattgggaatgaggaattcctggactacatgccatcaatgaaaaggtttcgcaaggaggaggaaagtgagggagccatctggtga

SEQ ID NO: 15284 - RNA, 9873 nt, synthetic construct
  misc_feature 1..9873: note = derived and/or modified CDS sequence (opt3) from DENV-3__JF937643__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagaaagccgtgcacgctgacatgggatactggatcgagagtcagaagaacggcagctggaaactggaaaaggcctccctaatagaggtaaagacttgcacctggcctaaatctcatacactgtggtcgaatggtgtcctcgaaagcgatatgatcattccaaagtccctggcaggcccgatctcacagcacaaccatagacccgggtatcacactcaaaccgcgggaccttggcaccttggcaaattggagctggactttaattactgcgaggggacaacggtggtgattaccgaaaactgtggaactaggggcccaagtttacgtacaaccactgtctctggtaagctcatccatgagtggtgctgtcggagctgcacactgccccctcttcgatatatgggggaagatggatgttggtacggcatggagataagaccaatttccgaaaaagaggagaatatggttaagtcactggtgagcgccggttctggcaaggtagacaacttcaccatgggggtgttgtgcctcgctatcctgtttgaagaggtcatgaggggaaaattcggcaagaaacacatgatcgccggggtgttctttacgttcgttctactgctctccggacagattacttggcgcgatatggcacataccctgatcatgattggcagtaatgctagcgaccggatgggtatgggggtgacatatcttgccttgatagcaacctttaagatccagcccttcctggccttaggatttttcctcagaaaactgacttctagggaaaaccttctgctaggcgtcggcctcgctatggcgacaaccctgcaattgccggaggatattgaacagatggccaatgggatcgcactgggattaatggctctcaagctgattgcccagtttgagacataccagctttggactgccctgatctccttgacctgttcaaacacgatattcacactcaccgtggcttggcgcactgcaaccctgatcctagccggtgttagtctgcttcctgtgtgccaaagctcgtccatgcgaaagacagactggctcccaatggcggtcgctgccatgggcgtaccccctctgcccttgtttattttctctctgaaagatactttaaagcggcgtagctggccactcaatgagggggtgatggcagttggactggtgtcaatccttgccagttccctgttgagaaacgacgtccctatggctggccccctcgtggcaggtgggctgctaattgcctgttatgtaatcaccggaacgtctgcggatctgacagtggaaaaagctgccgacataacctgggaggaagaggcagaacagactggcgtcagccacaaccttatgattgccgttgacgatgacggcacaatgaggatcaaggatgacgagaccgagaatatcctcactgtgctgttgaaaacagctttactgattgtgtccgggatatttccatactcaatcccggccaccctcctggtctggcatacgtggcagaagcagactcaacgcagcggagtgctttgggatgttcctagtcccccagaaacccagaaagcagagctggaagagggtgtataccggattaagcagcagggcatcttcgggaagacacaagtgggagtcggcgtgcagaaagagggtgtttttcacaccatgtggcacgtgacaagaggggctgtcttgacttataacggaaagaggctagaacccaattgggcctctgtgaaaaaggacctgatttcctacggcggcgggtggcgactcagcgcgcagtggcaaaaaggagaggaagtacaggtcatcgccgtggagcctggtaagaacccaaagaatttccagaccatgcccggcacgttccagacaactaccggggaaataggagcaatcgctctggattttaaacctggcacatcgggttcaccgattatcaaccgcgaggggaaggttgtgggactttatggcaatggcgtcgtgaccaaaaacgggggatacgtttctggtattgcccaaactaatgctgagccagacggccccacccctgaattagaggaagagatgttcaagaaacggaacctgacaatcatggatctccatccagggagtggaaagacgagaaagtatttgcccgcaatagtgagggaagccattaaacgtcgcctgcggactctcatcctggcccctaccagagtcgtggctgcggagatggaggaagcacttaagggcctgccgatcaggtaccagacaaccgccactaaatccgagcacacaggtcgagaaattgtagacttgatgtgccatgctacctttacgatgcggctactgagccccgtgcgcgttccaaattataacctcatcataatggatgaggcccacttcactgaccctgcatctattgccgctagagggtacatcagcacaagggtcggaatgggcgaagcggccgcaatttttatgaccgctacccccccaggcactgccgatgcattccctcagtccaatgcccccatccaggacgaggagcgggacataccagaacgatcatggaacagtgggaatgagtggattacagattttgctggaaagaccgtgtggttcgtgccgagcatcaaagccggtaacgacatcgcgaactgtttaagaaagaatggcaagaaagtcattcaactgtctcgcaagacatttgatactgaataccagaaaacgaagcttaacgactgggatttcgtagtgaccacagacatctccgagatgggggcaaattttaaagccgatagggttattgaccctcgtcggtgcctgaagcccgtgatactcactgatggaccagagagagtcatcttggctggccccatgcctgtgaccgccgcttcagcagcccagaggcgcggtcgagttgggagaaacccacagaaggaaaatgaccaatatattttcacaggccagcccctgaacaatgatgaggaccatgctcactggaccgaagccaaaatgctcctggacaacatcaatactcctgagggaatcattccggcacttttcgaaccagagcgggagaagagtgcggccatagatggcgaatacaggctaaaaggggagagccgcaagacgtttgtggaactgatgcgtagaggagacttgcccgtctggttagctcacaaagtggcctccgagggtatcaagtataccgatcggaaatggtgcttcgacggccagaggaacaatcagattctggaagagaacatggatgtagagatctggacaaaggaaggggagaagaaaaagctccgccctcgatggctggacgcaagaacttactctgatccccttgctctgaaagaatttaaggagttcgccgcaggacggaaatcgattgccctcgacttggtgaccgaaatcggcagggttccaagccatctggctcaccgcacaagaaatgcgctagataacctggtcatgctccatacctcagagcacggtgggagggcctatcggcacgcagtggaggaacttcctgagactatggaaacactgttattgctgggcctcatgatactgcttacgggaggcgctatgctgtttctcatctccgggaagggaattggtaagaccagtatcggcttgatttgtgtgatcgcctctagcgggatgctgtggatggccgagatacccttacaatggattgcatccgctatcgtcctagagttctttatgatggttctgctcattccagaacctgagaaacagcgtactccgcaggacaatcaacttgcctacgtggtaatcggaatactgacattggcggctgtgatcgccgcaaacgaaatgggcctgctcgagaccaccaagcgcgatctgggtatgtcaaaagaacccggggtcgtgtctccaacaagctatcttgacgttgatctccatcctgccagtgcttggactctgtacgcagtggccacgaccgtcattacacccatgttgcgacacactatcgagaattccaccgcgaacgtaagcctggctgccattgcaaaccaggccgtggttttaatgggcctagacaagggatggccaatctctaaaatggacctgggcgtgcctctccttgctctggggtgctactcacaggtcaatcccttgacactgaccgccgcagtgctcctgcttataactcattatgctattatcggaccgggcttacaggccaaggcgacgagagaggcccaaaagaggacagcagctggtatcatgaaaaacccaaccgtcgatgggattatgactatcgacctggatcctgtgatatacgactccaagttcgaaaaacagctcggacaggttatgttgctggtgctatgtgccgtacagctgctccttatgcggaccagttgggcactgtgcgaggctttgacactggccactggccccattaccacactctgggaaggtagcccaggcaagttttggaatacgaccatcgccgtgtcgatggcgaacattttccgcgggtcttatctggctggagcaggcttagccttttccatcatgaaaagcgtcgggactggaaagagaggcacaggttcacaaggggagacccttggagaaaagtggaaaaagaaactgaatcagctcagtaggaaggatttcgacctatacaaaaagtctggcataactgaggttgatcggacagaggctaaagaaggtctgaagcgaggcgagatcacccaccatgccgtgtccagagggagcgcaaagttgcagtggtttgtcgaacgcaacatggtgattcccgagggaagggtaatcgacctgggctgtgggcggggaggctggtcatattactgcgccggtctcaaaaaggtgacggaagttcgtgggtataccaaaggaggccctggccacgaggagccggtgcccatgagtacatacgggtggaatattgtcaagcttatgagcggaaaagatgtgttctacctgccacctgaaaagtgtgacactttgctgtgcgatatcggtgagtcctctcccagccctaccgtcgaagagtccagaacaattagggtgctcaagatggttgagccatggttaaaaaacaatcagttctgtatcaaggtactgaacccctatatgcctactgtgatagaacaccttgagcgcctgcaacggaaacatggcgggatgctagtccgaaatccactctcaagaaactctacccacgaaatgtactggattagtaatggaacaggcaacatcgtggcttcggttaatatggtgagcaggctgttgctgaaccgctttaccatgactcatcggagacccacgatcgagaaggacgtcgatctcggtgcggggacacgtcacgtgaacgccgaaccggagacccctaatatggacgtaattggagagaggataaaacggatcaaggaagagcacaactccacttggcattatgacgatgaaaatccatacaagacctgggcatatcacggctcttacgaggtgaaagctacaggctcagccagctccatgattaacggggttgtcaagcttctgacgaaaccctgggacgtggtgcctatggtcacccagatggcaatgactgatacaaccccattcggacagcaacgcgtttttaaggaaaaagtggacactcgaacacccagaagtatgccgggtaccaggcgggtaatgggcatcacagccgagtggttatggcgcactctggggagaaataagaagcctaggttgtgcacccgagaggaattcacgaaaaaggtgcggaccaacgctgccatgggagcggtctttacagaggaaaatcagtgggattctgcaaaagccgctgtggaggacgaagatttctggaagctcgttgaccgtgagagagagctgcataaactaggcaagtgtggtagctgcgtgtataacatgatggggaaacgcgaaaagaagcttggagagtttggcaaagccaagggctcaagggcaatttggtacatgtggctgggggctcggtacctcgaattcgaggccctgggatttttgaatgaggatcactggttctccagagaaaacagttatagcggtgtcgagggcgaagggctgcataaactcggatacatccttcgcgacatatctaagatccccggcggtgctatgtatgccgatgacactgcagggtgggacaccaggattacagaggatgacctgcacaatgaagagaaaatcactcagcagatggatccagagcaccgacaattagcgaacgccatttttaagctgacctaccagaataaggtggtaaaagttcagcggcctacgcccacaggaaccgtgatggacatcatatccagaaaggatcagaggggctcaggccaagtcgggacttatggattgaacacattcaccaatatggaagctcagctcattcgccagatggagggtgaaggcgtgctgagcaaagccgacctagagaacccacatcttcccgaaaagaaaatcactcagtggctggagaccaagggggtggagcgtctcaagcggatggcaatctcgggagatgactgcgtcgttaaacctattgatgacagatttgctaacgccctgttggcattaaatgatatgggcaaggtgaggaaagacataccacaatggcagccgtctaagggttggcacgattggcagcaggtacccttctgtagtcatcacttccacgaactgatcatgaaagacgggcgcaagctcgtggtcccttgccgaccacaagacgagcttattggacgggccagaatctcccagggcgcgggctggagcctgaaggaaacagcttgtctagggaaagcctacgcacagatgtggtcactgatgtattttcataggcgcgatctcagattggcctccaacgctatttgctctgccgtgcccgttcactgggtgcctacgagccggaccacttggagtatccatgcacaccatcaatggatgacaaccgacgatatgctgactgtctggaatagggtgtggatagaggacaacccatggatggaagataagacacccgtaaccacgtgggagaatgttccttaccttggaaaacgtgaggaccagtggtgtggttccctgatcggcctcacaagccgagctacctgggcccagaacattccgactgcgatccagcaagtgcgctctttaattgggaatgaagagttcctggattacatgccatcaatgaagagatttcggaaagaagaggagagtgaaggagctatctggtga

SEQ ID NO: 15285 - RNA, 9873 nt, synthetic construct
  misc_feature 1..9873: note = derived and/or modified CDS sequence (opt3) from DENV-3__HM181972__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggtcttaggatttttcctcaggaagctgacttctcgcgaaaaccttctgctaggcgtgggcctcgccatggctacaaccctgcaattgccggaggatattgaacagatggcgaatgggatcgccctgggattaatggcactcaaactgattacacagtttgagacttaccagctttggaccgctctgatctccttgacgtgttcaaacacaatattcaccctcactgttgcctggcgaaccgccacactgatcctagctggtgtgagtctgcttcctgtctgccaaagctcgtccatgcggaagactgactggctcccaatggcagtagccgcgatgggcgtgccccctctgcccttgtttattttctctctgaaggataccttaaaacgtagaagctggccactcaatgagggggttatggctgtgggactggtctcaatccttgccagttccctgttgaggaacgacgtgcctatggcaggccccctcgtagccggtgggctgctaattgcttgttatgtgatcacgggaacatctgcagatctgaccgtcgaaaaggccgcggacataacttgggaggaagaggctgaacagacaggcgttagccacaaccttatgattaccgtggacgatgacggcactatgcgcatcaaagatgacgagacagagaatatcctcaccgtgctgttgaagacggccttactgattgtctccgggatatttccatactcaatcccggcaactctcctggtgtggcatacctggcagaaacagacacaacggagcggagttctttgggatgtacctagtcccccagaaacccagaaggccgagctggaagagggtgtgtacagaattaaacagcagggcatcttcgggaagacacaagtcggagtgggcgttcagaaggagggtgtgtttcacactatgtggcacgtcaccaggggggctgtgttgacgtataacggaaaacgactagaacccaattgggcctctgtaaagaaagacctgatttcctacggcggcgggtggcgcctcagcgcacagtggcaaaagggagaggaagtccaggtgatcgctgttgagcctggtaaaaacccaaagaatttccagacaatgcccggcactttccagaccacaaccggggaaataggagccatcgcgctggattttaagcctggcacttcgggttcaccgattatcaaccgggaggggaaagtggtcggactttatggcaatggcgtggttaccaagaacgggggatacgtgtctggtattgcccaaacaaatgcagagccagacggccccacgcctgaattagaggaagagatgttcaaaaagagaaacctgactatcatggatctccatccagggagtggaaaaaccaggaagtatttgcccgctatagtccgtgaagccattaagcgccggctgagaacactcatcctggctcctaccagggtggtagcagccgagatggaggaagcccttaaaggcctgccgatccgataccagactacagctaccaagtccgagcacacgggtcgggaaattgtggacttgatgtgccatgcgacttttacaatgcgcctactgagccccgttagagtcccaaattataacctcatcataatggatgaggcacacttcaccgaccctgcctctattgctgccagggggtacatcagcacccgggtgggaatgggcgaagcagccgctatttttatgactgcgacacccccaggcaccgccgatgcattccctcagtccaatgctcccatccaggacgaggagcgagacataccagaaagatcatggaacagtgggaatgagtggattacagattttgccggaaaaactgtgtggttcgtcccgagcatcaaggcaggtaacgacatcgccaactgtttacgcaaaaatggcaagaaggtaattcaactgtctaggaaaacgtttgataccgaataccagaagacaaaacttaacgactgggatttcgtggttactaccgacatctccgagatgggggctaattttaaggccgatcgtgtgattgaccctcggagatgcctgaaacccgtcatactcacagatggaccagagagggtgatcttggcgggccccatgcctgttaccgcagcctcagctgcccagcgccgaggtagagtggggcggaacccacagaaggaaaatgaccaatatattttcactggccagcccctgaacaatgatgaggaccatgctcactggacggaagcaaagatgctcctggacaacatcaatacccctgagggaatcattccggcccttttcgaaccagagagggagaaaagtgctgccatagatggcgaataccgcctaaagggggagagccgtaaaacatttgtcgaactgatgagacggggagacttgcccgtgtggttagcacacaaggtagcgtccgagggtatcaaatatactgataggaagtggtgcttcgacggccagcgcaacaatcagattctggaagagaacatggatgtggagatctggaccaaagaaggggagaagaagaaactccgacctagatggctggacgcccggacatactctgatccccttgctctgaaggaatttaaagagttcgccgcaggaaggaagtcgattgctctcgacttggttaccgaaatcggccgcgtcccaagccatctggcccacagaactaggaatgcactagataacctggtgatgctccatacatcagagcacggtgggcgggcctatcgtcacgctgtggaggaacttcctgagacgatggaaaccctgttattgctgggcctcatgatactgcttactggaggcgcgatgctgtttctcatctccgggaaaggaattggtaagacaagtatcggcttgatttgtgtcatcgcctctagcgggatgctgtggatggcagagatacccttacaatggattgcttccgccatcgttctagagttctttatgatggtgctgctcattccagaacctgagaagcagcgcaccccgcaggacaatcaacttgcctacgtagtgatcggaatactgaccttggcagctatcattgccgcgaacgaaatgggcctgctcgagacaactaaacgagatctgggtatgtcaaaggaacccggggtcgtgtctccaacgagctatcttgacgttgatctccatcctgctagtgcctggaccctgtacgcagtggccacaactgtcatcacccccatgttgagacacacaattgagaattccaccgctaacgtaagcctggcagccatcgcgaaccaggctgtggttttaatgggcctagacaaaggatggccaatatctaagatggacctgggcgtgcctctccttgccctggggtgctactcacaggtcaatcccttgactctgacggcagccgtgctcctgcttattacacattatgctatcatcggaccgggcttacaggccaaagcaaccagggaggctcaaaagcggactgccgcgggtattatgaagaacccaaccgtcgatgggatcatgacaatagacctggatcctgtgatttacgactccaaattcgaaaagcagctcggacaggttatgttgctggtgctatgtgccgtacagctgctccttatgcgcactagttgggcactgtgcgaggctttgaccctggccacaggccccatcacgaccctctgggaaggtagcccaggcaaattttggaatactacaattgcagtgtcgatggctaacatcttcagagggtcttatctggccggagccggcttagcgttttccataatgaagagcgtcgggaccggaaaaaggggcactggttcacaaggggagacacttggagaaaagtggaagaaaaagctgaatcagctcagtcggaaagatttcgacctatacaagaaatctggcatcaccgaggttgatcgaacggaggctaaggaaggtctgaaaagaggcgagattacccaccatgcagtgtcccgcgggagcgccaagttgcagtggtttgtcgaaaggaacatggtgatccccgagggacgggtaattgacctgggctgtgggcgtggaggctggtcatattactgcgctggtctcaagaaagtgacagaagttagagggtatactaagggaggccctggccacgaggagccggtgcccatgagtacctacgggtggaatatcgtcaaacttatgagcggaaaggatgtgttctacctgccacctgaaaaatgtgacacattgctgtgcgatattggtgagtcctctcccagccctactgtcgaagagtccaggaccatccgcgtgctcaagatggttgagccatggttaaagaacaatcagttctgtataaaagtactgaacccctatatgcctacagtgattgaacaccttgagcggctgcaacgaaagcatggcgggatgctagtcagaaatccactctcaaggaactctacccacgaaatgtactggatcagtaatggaactggcaacatcgtggcctcggttaatatggtgagccgcctgttgctgaaccggtttacgatgacacatagacgtcccaccattgagaaagacgtcgatctcggtgcagggactaggcacgtgaacgccgaaccggagacccctaatatggacgtaataggagagcggatcaagcgcattaaagaagagcacaactccacatggcattatgacgatgaaaatccatacaagacgtgggcttatcacggctcttacgaggtgaaggcgaccggctcagccagctccatgatcaacggggttgtcaaacttctgactaagccctgggacgtggtgcctatggtcacacagatggcaatgaccgatactacaccattcggacagcaacgagtttttaaagaaaaggtggacaccagaacacccaggagtatgccgggtactcggcgcgtaatgggcattaccgctgagtggttatggagaacgctggggaggaataaaaagcctcgattgtgcacccgggaggaattcacaaagaaagtgcgtactaacgccgcaatgggagccgtctttaccgaggaaaatcagtgggattctgctaaggccgcggtggaggacgaagatttctggaaactcgttgacagagagcgcgagctgcataagctaggcaaatgtggtagctgcgtgtataacatgatggggaagagggaaaaaaagcttggagagtttggcaaggcaaaaggctcacgggccatctggtacatgtggctgggggctagatacctcgaattcgaggccctgggatttttgaatgaggatcactggttctcccgcgaaaacagttatagcggtgtcgagggcgaagggctgcataagctcggatacatacttagggacatctctaaaattcccggcggtgcaatgtatgctgatgacacagccgggtgggacactcgaatcaccgaggatgacctgcacaatgaagagaagattacgcagcagatggatccagagcaccggcaattagctaacgccatctttaaactgacataccagaataaggtggtaaaggttcagagacctacccccactggaacagtgatggacataatttccaggaaagatcagcgcggctcaggccaagtcgggacctatggattgaacactttcaccaatatggaagcacagctcatccgtcagatggagggtgaaggcgtgctgagcaaggcggacctagagaacccacatcttcccgaaaaaaagatcacacagtggctggagacgaaaggggtggagcggctcaagagaatggccatttcgggagatgactgcgtcgttaagcctatagatgacaggtttgctaacgccctgttggcattaaatgatatgggcaaagtgcgcaaggacatcccacaatggcagccgtctaaaggttggcacgattggcagcaggtacccttctgtagtcatcacttccacgaactgattatgaaggacgggcgaaaactcgtggtcccttgccggccacaagacgagcttatcggaagagctaggatttcccagggcgccggctggagcctgaaggaaaccgcatgtctagggaaggcctacgcgcagatgtggtcactgatgtattttcatcgcagagatctccggttggcttccaacgccatctgctctgcagtgcccgttcactgggtgcctactagcaggacaacctggagtatacatgcccaccatcaatggatgactacagaggacatgctgaccgtctggaatcgtgtgtggatcgaagataacccatggatggaggacaaaacgcccgtaacaacctggggaaatgttccttaccttggtaagcgagaggatcagtggtgtggctccctgattgggctcactagccgcgctacctgggcccagaacatcccgacagcaattcagcaagtgagatctttaatcggaaatgaagagttcctggactacatgccatcaatgaaacggtttaggaaggaagaggagagtgaaggcgctatttggtga

SEQ ID NO: 15286 - RNA, 9873 nt, synthetic construct
  misc_feature 1..9873: note = derived and/or modified CDS sequence (opt3) from DENV-3__HM631857__SS-prME
  source 1..9873: mol_type = other RNA
accagcctgtgcctcatgatgatccttcccgcagctctggcattccacttgacatccagagacggcgaacctagaatgattgtggggaagaacgaacggggtaaatctttactgtttaagactgcctcaggtataaatatgtgtacgctaatcgcgatggatctcggcgaaatgtgcgacgataccgtcacctacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagcatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgactaagaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggataccgcacatacactgatcatgattggcagtaatgctagcgacagaatgggtatgggggtgacctatcttgccttgatagcaacttttaaaatccagcccttcctggccttaggatttttcctcaggaagctgacatctcgcgaaaaccttctgctaggcgtcggcctcgctatggcgaccacactgcaattgccggaggatattgaacagatggccaatgggatcgcactgggattaatggctctcaaactgattactcagtttgagacctaccagctttggacggccctgatctccttgacatgttcaaacaccatattcactctcaccgtggcctggcgaacagctactctgatcctagccggtgttagtctgcttcctgtgtgccaaagctcgtccatgcggaagaccgactggctcccaatggccgtcgcggctatgggcgtaccccctctgcccttgtttattttcgggctgaaggatacgttaaaacgtagatcttggccactcaatgagggagtgatggccgttggcctggtgagcatccttgcatcaagtctgttgaggaacgacgtccctatggccggtcccctcgtggctgggggactgctaattgcatgttatgtaatcacaggcacctccgccgatctgactgtggaaaaggcggctgacataacatgggaggaagaggccgaacagaccggcgtctctcacaaccttatgattactgttgacgatgacgggacaatgcgcatcaaagatgacgagaccgagaatatcctcacggtgctgttgaagactgcattactgattgtgagcggaatatttccatactccatcccggccaccctcctggtctggcatacatggcagaaacagacccaacggtcaggtgtgctttgggatgttcctagtcccccagaaacacagaaggctgagctggaagagggcgtatacagaattaaacagcaggggatcttcggaaagactcaagtgggcgtcggtgtgcagaaggagggggtttttcacaccatgtggcacgtgacgaggggagccgtcttgacatataacggcaaacgactagaacccaattgggcaagtgtgaagaaagacctgatttcttacggcgggggatggcgcctctccgctcagtggcaaaagggtgaggaagtacaggtcatcgccgtggagcctggcaaaaacccaaagaatttccagactatgcccgggaccttccagacaaccactggagaaataggcgcgatcgccctggattttaagcctggtaccagcgggtcgccgattatcaaccgggagggaaaagttgtgggcctttatggcaatggggtcgtgacaaagaacggaggttacgtttcaggcattgcacaaacgaatgctgagccagacgggcccactcctgaattagaggaagagatgttcaaaaagagaaacctgaccatcatggatctccatccaggatctggcaaaacaaggaagtatttgcccgccatagtgcgtgaagctattaagcgccggctgagaaccctcatcctggcacctactagggtcgtggccgccgagatggaggaagctcttaaaggtctgccgatccgataccagacaaccgcgacgaagagtgagcacactgggcgggaaattgcagacttgatgtgccatgccacatttaccatgcgcctactgtcccccgtaagagtgccaaattataacctcatcataatggatgaggctcacttcaccgaccctgccagcattgcagccaggggatacatctctactcgggttggcatgggcgaagctgcggccatttttatgacagcaacacccccagggacagctgatgccttccctcagagcaatgcacccatccaggacgaggagcgagacataccagaaagatcctggaactcaggaaatgagtggattactgattttgccggtaaaacggtctggttcgtgccgagtatcaaggctggcaacgacatcgccaactgtttacgcaaaaatgggaagaaggtgattcaactgagcaggaaaacctttgatacagaataccagaagactaaacttaacgactgggatttcgtcgtaaccacagacatctctgagatgggagcgaattttaaggcagatcgtgtgattgaccctcggagatgcctgaaacccgttatactcaccgatggcccagagagggtgatcttggccggtcccatgcctgtcactgctgcctccgctgcacagcgccgagggagagtgggccggaacccacagaaggaaaatgaccaatatattttcacgggacagcccctgaacaatgatgaggaccatgcccactggaccgaagctaagatgctcctggacaacatcaatacacctgagggcatcattccggcccttttcgaaccagagagggagaaatcagcagcgatagatggggaataccgcctaaagggagagagtcgtaaaacttttgttgaactgatgagacggggtgacttgcccgtgtggttagcccacaaggtcgctagcgagggcatcaaatataccgataggaagtggtgcttcgacgggcagcgcaacaatcagattctggaagagaacatggatgtggagatctggacaaaagaaggagagaagaagaaactccgacctagatggctggacgcccggacctactccgatccccttgcactgaaggaatttaaagagttcgctgccggcaggaagtctattgcactcgacttggtaactgaaatcggtcgcgtgccatcgcatctggcccacagaacaaggaatgctctagataacctggttatgctccatacgagcgagcacgggggccgggcgtatcgtcacgccgtcgaggaacttcctgagaccatggaaactctgttattgctgggactcatgatactgcttacaggcggggcaatgctgtttctcatctcaggaaaaggtattggcaagacctccatcgggttgatttgtgtgatcgctagttctggaatgctgtggatggccgagatacccttacaatggattgccagcgcaatcgtgctagagttctttatgatggtcctgctcattccagaacctgagaagcagcgcaccccgcaggacaatcaacttgcttacgttgtgatcggcatactgacattggccgcggtaatcgctgccaacgaaatgggtctgctcgagactacgaaacgagatctggggatgtccaaggaacccggcgtggtctcaccaacctcttatcttgacgtggatctccatcctgcaagcgcctggacactgtacgctgttgcaactaccgtgattacacccatgttgagacacaccatcgagaatagtactgccaacgtctccctggcggctattgccaaccaggcagtagtgttaatgggactagacaaaggctggccaatcagcaagatggacctgggggttcctctccttgccctgggatgctactctcaggtgaatcccttgacgctgacagctgccgtcctcctgcttataacccattatgcaattatcggcccgggtttacaggctaaagccactagggaggcgcaaaagcggaccgccgcagggatcatgaagaacccaacagtggatggaattatgactatcgacctggatcctgtcatatacgactcaaaattcgaaaagcagctcggccaggtgatgttgctggttctatgtgctgtgcagctgctccttatgcgcacctcctgggccctgtgcgaggcattgacactggctacgggtcccattaccactctctgggaaggcagtccagggaaattttggaatacaaccatcgccgtaagcatggccaacattttcagaggatcgtatctggcgggcgctgggttagcattttctatcatgaagtccgtgggaactggcaaaaggggtacagggagccaaggagagacccttggcgaaaagtggaagaaaaagctgaatcagctctcacggaaagatttcgacctatacaagaaaagtggtataacggaggtcgatcgaaccgaggccaaggaaggcctgaaaagaggggagatcacacaccatgctgtttctcgcggatccgccaagttgcagtggtttgtggaaaggaacatggtcattcccgagggccgggtgatcgacctggggtgtggacgtggcggttggagctattactgcgcagggctcaagaaagtaactgaagtgagaggatataccaagggcggccctgggcacgaggagccggttcccatgtcaacatacggatggaatattgtgaaacttatgagtggtaaggatgtcttctacctgccacctgaaaaatgtgacactttgctgtgcgatatcggcgagagctccccctctcctaccgtggaagagagcaggacaattcgcgtcctcaagatggtggagccatggttaaagaacaatcagttctgtatcaaagttctgaacccctatatgcctaccgtaatagaacaccttgagcggctgcaacgaaagcatgggggaatgctagtgagaaatccactctccaggaactcaactcacgaaatgtactggatttctaatggcacgggtaacatcgtcgccagtgtgaatatggtttcgcgcctgttgctgaaccggtttacaatgacccatagacgtcccactatcgagaaagacgtggatctcggggctggaaccaggcacgtcaacgtggaaccggagacacctaatatggacgtaattggcgagcggataaagcgcatcaaagaagaacacaacagcacgtggcattatgacgatgaaaatccatacaagacctgggcgtatcacggctcctacgaggtgaaggccactgggtctgcatcaagcatgattaacggagttgtcaaacttctgacaaagccctgggacgtggtgcctatggtcacccagatggctatgactgatacaaccccattcggtcagcaacgagtttttaaagaaaaggtggacacaagaactcccaggtccatgccgggcacccggcgcgtaatggggatcacggccgagtggttatggagaaccctgggaaggaataaaaagcctcgattgtgcacacgggaggagttcactaagaaagtgcgtaccaacgcagccatgggcgctgtctttacagaggaaaatcagtgggatagtgccaaggcggcagtggaggacgaagatttctggaaactcgttgacagagagcgcgagctgcataagctaggtaaatgtgggtcttgcgtgtataacatgatgggaaagagggagaagaaacttggcgagtttggcaaagccaaagggagccgggctatttggtacatgtggctgggagccagatacctcgagttcgaggcactgggatttttgaatgaggatcactggttctcacgcgaaaactcctatagtggcgtcgagggggaaggactgcataagctcggctacatccttagggacataagcaaaatccccggtggggctatgtatgccgatgacactgctggatgggacacccgaattacggaggatgacctgcacaatgaagagaagatcacacagcagatggatccagagcaccggcaattagccaacgcaatttttaaactgacctaccagaataaggtggtaaaggttcagagacctactcccacaggcaccgtgatggacatcatatctaggaaagatcagcgcggctccgggcaagtcggaacttatggtttgaacaccttcacaaatatggaagcgcagctcattcgtcagatggagggcgaaggggtgctgtcaaaggccgacctagagaacccacatcttcccgagaaaaagatcacgcagtggctggagaccaaaggagtggagcggctcaagagaatggctatcagcggcgatgactgcgtcgttaagcctattgatgacaggtttgccaacgcactgttggctttaaatgatatgggtaaagtgcgcaaggacataccacaatggcagccgtcgaaagggtggcacgattggcagcaggtacccttctgttctcatcacttccacgaactgatcatgaaggacggacgaaaactcgtggtcccttgccggccacaagacgagcttattggcagagccaggatcagtcagggcgcagggtggtccctgaaggaaactgcctgtctaggaaaggcgtacgctcagatgtggagcctgatgtattttcatcgcagagatctccggttggcctcaaacgcaatttgctccgccgtgcccgttcactgggtgcctacatctaggaccacttggagcatccatgctcaccatcaatggatgacaaccgaggacatgctgacggtctggaatcgtgtgtggatagaagataacccatggatggaggacaaaacacccgtaaccacttgggagaatgttccttaccttggtaagcgagaagatcagtggtgtggcagtctgatcgggctcacctcccgcgccacatgggcacagaacattccgactgctatccagcaagtgaggagcttaattggaaatgaggagttcctggactacatgccatctatgaaacggtttaggaaggaggaggaatcagagggcgccatctggtga

SEQ ID NO: 15287 - RNA, 9873 nt, synthetic construct
  misc_feature 1..9873: note = derived and/or modified CDS sequence (opt3) from DENV-3__HM631860__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcgtgaattggaaagggaaggagctgaagtgcggatccggcatcttcgtgacaaacgaggtccatacctggactgaacagtacaaatttcaagcagattctcccaagcggctagccaccgctattgccggtgcatgggagaatggcgtttgtgggatccgaagcacaacgcgcatggaaaacctcctgtggaaacagatagctaatgagcttaactatatcttgtgggaaaataacattaagctgaccgtggtggtaggagacatcattggcgtcctcgagcaggggaaaagaactctgacaccacagcctaaggagttaaaatactcatggaagacctggggaaaggccaaaatcgtgacagcggaaactcaaaacagttccttcataattgatggccccaataccccagagtgccccagcgtttctagggcctggaacgtgtgggaagtcgaggactatggttttggggtgttcacgacaaatatctggctgaagcttcgggaagtttacacccagttgtgtgaccaccgcctcatgtcagctgcagtgaaagatgagagagccgtacacgctgacatgggatactggattgagagtcagaagaacggcagctggaaactggaaaaggcctccctaatcgaggtcaagacttgcacctggcctaaatctcatacactgtggtcgaatggtgtgctcgaaagcgatatgataatcccaaagtccctggcaggcccgatttcacagcacaaccataggcccgggtatcacactcaaaccgcgggaccttggcaccttggcaaattggagctggactttaattactgcgaggggacaacggtggtcatcaccgaaaactgtggaactcgtggcccaagtttacggacaaccactgtttctggtaagctcattcatgagtggtgctgtcgaagctgcacactgccccctcttagatatatgggggaagatggatgttggtacggcatggagatcaggccaatatccgaaaaagaggagaatatggtgaagtcactggtaagcgccggttctggcaaggtggacaacttcaccatgggggtcttgtgcctcgctattctgtttgaagaggtgatgcgcggaaaattcggcaagaaacacatgatcgccggggttttctttacgttcgtgctactgctctccggacagatcacttggcgggatatggcacataccctgattatgatcggcagtaatgctagcgacagaatgggtatgggggtcacatatcttgccttgattgcaacctttaagatacagcccttcctggccttaggatttttcctcaggaaactgacttctcgcgaaaaccttctgctaggcgtgggcctcgctatggcgacaaccctgcaattgccggaggatatcgaacagatggccaatgggattgcactgggattaatggctctcaagctgatcacacagtttgagacttaccagctttggaccgccctgatttccttgacgtgttcaaacacatatttcaccctcactgttgcctggcgaaccgctacactgatcctagcaggtgtgagtctgcttcctgtctgccaaagctcgtccatgcggaagactgactggctcccaatggccgtagcggctatgggcgtgccccctctgcccttgtttatattctctctgaaagataccttaaagcgtagaagctggccactcaatgagggggttatggccgtgggactggtctcaatccttgcaagttccctgttgaggaacgacgtgcctatggccggccccctcgtagctggtgggctgctaattgcatgttacgtgatcacgggaacatctgccgatctgaccgtcgaaaaagcggctgacattacttgggaggaagaggccgaacagacaggcgttagccacaaccttatgatcaccgtggacgatgacggcactatgcgcataaaggatgacgagacagagaatattctcaccgtgctgttgaaaacggcattactgatcgtctccgggatctttccatactcaattccggccactctcctggtgtggcatacctggcagaagcagacacaacggagcggagttctttgggatgtacctagtcccccagaaacccagaaagctgagctggaagagggtgtgtatagaataaagcagcagggcatcttcgggaagacacaagtcggagtgggcgttcagaaagagggtgtgtttcacactatgtggcacgtcaccaggggggccgtgttgacgtacaacggaaagcgactagaacccaattgggcatctgtaaaaaaggacctgatttcctatggcggcgggtggcgcctcagcgctcagtggcaaaaaggagaggaagtccaggtgatcgccgttgagcctggtaagaacccaaagaatttccagacaatgcccggcactttccagaccacaaccggggaaattggagcgatcgccctggattttaaacctggcacttcgggttcaccgataatcaaccgggaggggaaggtggtcggactttacggcaatggcgtggttaccaaaaacgggggatatgtgtctggtattgcacaaacaaatgctgagccagacggccccacgcctgaattagaggaagagatgttcaagaaaagaaacctgactatcatggatctccatccagggagtggaaagaccaggaagtacttgcccgccattgtccgtgaagctatcaaacgccggctgagaacactcatactggcacctaccagggtggtagccgccgagatggaggaagctcttaagggcctgccgattcgatatcagactacagcgaccaaatccgagcacacgggtcgggaaatcgtggacttgatgtgccatgcaacttttacaatgcgcctactgagccccgttagagtcccaaattacaacctcatcattatggatgaggcccacttcaccgaccctgcttctatcgccgcaagggggtacataagcacccgggtgggaatgggcgaagccgctgcgatttttatgactgccacacccccaggcaccgcagatgctttccctcagtccaatgcccccatccaggacgaggagcgagacattccagaaagatcatggaacagtgggaatgagtggatcacagattttgcaggaaagactgtgtggttcgtcccgagcataaaagccggtaacgacattgctaactgtttacgcaagaatggcaagaaagtaatccaactgtctaggaagacgtttgataccgaatatcagaaaacaaagcttaacgactgggatttcgtggttactaccgacatctccgagatgggggccaattttaaagcggatcgtgtgattgaccctcggagatgcctgaagcccgtcatcctcacagatggaccagagagggtgattttggcaggccccatgcctgttaccgccgcttcagccgctcagcgccgaggtagagtggggcggaacccacagaaggaaaatgaccaatacatattcactggccagcccctgaacaatgatgaggaccatgcacactggacggaagccaaaatgctcctggacaacatcaatacccctgagggaattatcccggctcttttcgaaccagagagggagaagagtgccgcaatcgatggcgaatatcgcctaaaaggggagagccgtaagacatttgtcgaactgatgagacggggagacttgcccgtgtggttagcgcacaaagtagcctccgagggtattaagtacactgataggaaatggtgcttcgacggccagcgcaacaatcagatactggaagagaacatggatgtggagatctggaccaaggaaggggagaagaaaaagctccgacctagatggctggacgctcggacatattctgatccccttgccctgaaagaatttaaggagttcgcagctggaaggaaatcgattgccctcgacttggttaccgaaatcggccgcgtcccaagccatctggcacacagaactaggaatgccctagataacctggtgatgctccatacatcagagcacggtgggcgggcttaccgtcacgcggtggaggaacttcctgagacgatggaaaccctgttattgctgggcctcatgattctgcttactggaggcgccatgctgtttctcatctccgggaagggaataggtaagacaagtatcggcttgatttgtgtcatcgcatctagcgggatgctgtggatggctgagattcccttacaatggatcgcctccgccatagttctagagttctttatgatggtgctgctcattccagaacctgagaaacagcgcaccccgcaggacaatcaacttgcatatgtagtgatcggaattctgaccttggctgccatcatagcggctaacgaaatgggcctgctcgagacaactaagcgagatctgggtatgtcaaaagaacccggggtcgtgtctccaacgagctaccttgacgttgatctccatcctgccagtgcatggaccctgtacgccgtggctacaactgtcatcacccccatgttgagacacacaattgagaattccaccgcaaacgtaagcctggccgcgatcgctaaccaggccgtggttttaatgggcctagacaagggatggccaatttctaaaatggacctgggcgtgcctctccttgcactggggtgctattcacaggtcaatcccttgactctgacggccgctgtgctcctgcttatcacacattacgccataattggaccgggcttacaggcaaaggctaccagggaggcccaaaagcggactgcggccggtatcatgaaaaacccaaccgtcgatgggatcatgacaattgacctggatcctgtgatctatgactccaagttcgaaaaacagctcggacaggttatgttgctggtgctatgtgcagtacagctgctccttatgcgcactagttgggctctgtgcgaggccttgaccctggcaacaggccccataacgaccctctgggaaggtagcccaggcaagttttggaatactacaattgctgtgtcgatggccaacatcttcagagggtcttacctggccggagcgggcttagctttttccattatgaaaagcgtcgggaccggaaagaggggcactggttcacaaggggagacacttggagaaaagtggaaaaagaaactgaatcagctcagtcggaaggatttcgacctatataaaaagtctggcatcaccgaggttgatcgaacggaggcaaaagaaggtctgaagagaggcgagataacccaccatgccgtgtcccgcgggagcgctaagttgcagtggtttgtcgaaaggaacatggtgatccccgagggacgggtaattgacctgggctgtgggcgtggaggctggtcatactattgcgccggtctcaaaaaggtgacagaagttagagggtacactaaaggaggccctggccacgaggagccggtgcccatgagtacctacgggtggaatatcgtcaagcttatgagcggaaaagatgtgttctatctgccacctgaaaagtgtgacacattgctgtgcgatattggtgagtcctctcccagccctactgtcgaagagtccaggaccatccgcgtgctcaagatggttgagccatggttaaaaaacaatcagttctgtattaaggtactgaacccctacatgcctacagtgatcgaacaccttgagcggctgcaacgaaaacatggcgggatgctagtcagaaatccactctcaaggaactctacccacgaaatgtattggataagtaatggaactggcaacattgtggcatcggttaatatggtgagccgcctgttgctgaaccggtttacgatgacacatagacgtcccaccatcgagaaggacgtcgatctcggtgccgggactaggcacgtgaacgctgaaccggagacccctaatatggacgtaatcggagagcggattaaacgcataaaggaagagcacaactccacatggcattacgacgatgaaaatccatataagacgtgggcgtaccacggctcttatgaggtgaaagccaccggctcagcaagctccatgatcaacggggttgtcaagcttctgactaaaccctgggacgtggtgcctatggtcacacagatggctatgaccgatactacaccattcggacagcaacgagtttttaaggaaaaagtggacaccagaacacccaggagtatgccgggtactcggcgcgtaatgggcattaccgccgagtggttatggagaacgctggggaggaataagaagcctcgattgtgcacccgggaggaattcacaaaaaaggtgcgtactaacgcagccatgggagctgtctttaccgaggaaaatcagtgggattctgccaaagcggcagtggaggacgaagatttctggaagctcgttgacagagagcgcgagctgcataaactaggcaagtgtggtagctgcgtgtacaacatgatggggaaaagggaaaagaagcttggagagtttggcaaagccaagggctcacgggctatctggtacatgtggctgggggccagatatctcgaattcgaggcactgggatttttgaatgaggatcactggttctcccgcgaaaacagttacagcggtgtcgagggcgaagggctgcataaactcggatatattcttagggacatctctaagatacccggcggtgctatgtacgccgatgacacagctgggtgggacactcgaatcaccgaggatgacctgcacaatgaagagaaaattacgcagcagatggatccagagcaccggcaattagccaacgcaatctttaagctgacatatcagaataaggtggtaaaagttcagagacctacccccactggaacagtgatggacattatctccaggaaggatcagcgcggctcaggccaagtcgggacctacggattgaacactttcaccaatatggaagcgcagctcatacgtcagatggagggtgaaggcgtgctgagcaaagccgacctagagaacccacatcttcccgaaaagaaaattacacagtggctggagacgaagggggtggagcggctcaagagaatggctatctcgggagatgactgcgtcgttaaacctatcgatgacaggtttgccaacgcactgttggctttaaatgatatgggcaaggtgcgcaaagacattccacaatggcagccgtctaagggttggcacgattggcagcaggtacccttctgtagtcatcacttccacgaactgataatgaaagacgggcgaaagctcgtggtcccttgccggccacaagacgagcttatcggaagagccaggatttcccagggcgcaggctggagcctgaaggaaaccgcctgtctagggaaagcgtatgctcagatgtggtcactgatgtactttcatcgcagagatctccggttggcctccaacgcaatctgctctgccgtgcccgttcactgggtgcctactagcaggacaacctggagtattcatgctcaccatcaatggatgactacagaggacatgctgaccgtctggaatcgtgtgtggatcgaagataacccatggatggaggacaagacgcccgtaacaacctgggagaatgttccttaccttggaaaacgagaagatcagtggtgtggttccctgataggcctcactagccgcgccacctgggcacagaacatcccgacagctattcagcaagtgagatctttaatcgggaatgaggaattcctggactatatgccatcaatgaagcggtttaggaaagaggaggaaagtgagggagccatttggtga

SEQ ID NO: 15288 - RNA, 9873 nt, synthetic construct
  misc_feature 1..9873: note = derived and/or modified CDS sequence (opt3) from DENV-3__HM181977__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcgtgaattggaaagggaaggagctgaagtgcggatccggcatcttcgtgacaaacgaggtccatacctggactgaacagtacaaatttcaagcagattctcccaagcggctagccaccgctattgccggtgcatgggagaatggcgtttgtgggatccgaagcacaacgcgcatggaaaacctcctgtggaaacagatagctaatgagcttaactatatcttgtgggaaaataacattaagctgaccgtggtggtaggagacatcattggcgtcctcgagcaggggaaaagaactctgacaccacagcctaaggagttaaaatactcatggaagacctggggaaaggccaaaatcgtgacagcggaaactcaaaacagttccttcataattgatggccccaataccccagagtgccccagcgtttctagggcctggaacgtgtgggaagtcgaggactatggttttggggtgttcacgacaaatatctggctgaagcttcgggaagtttacacccagttgtgtgaccaccgcctcatgtcagctgcagtgaaagatgagagagccgtacacgctgacatgggatactggattgagagtcagaagaacggcagctggaaactggaaaaggcctccctaatcgaggtcaagacttgcacctggcctaaatctcatacactgtggtcgaatggtgtgctcgaaagcgatatgataatcccaaagtccctggcaggcccgatttcacagcacaaccataggcccgggtatcacactcaaaccgcgggaccttggcaccttggcaaattggagctggactttaattactgcgaggggacaacggtggtcatcaccgaaaactgtggaactcgtggcccaagtttacggacaaccactgtttctggtaagctcattcatgagtggtgctgtcgaagctgcacactgccccctcttagatatatgggggaagatggatgttggtacggcatggagatcaggccaatatccgaaaaagaggagaatatggtgaagtcactggtaagcgccggttctggcaaggtggacaacttcaccatgggggtcttgtgcctcgctattctgtttgaagaggtgatgcgcggaaaattcggcaagaaacacatgatcgccggggttttctttacgttcgtgctactgctctccggacagatcacttggcgggatatggcacataccctgattatgatcggcagtaatgctagcgacagaatgggtatgggggtcacatatcttgccttgattgcaacctttaagatacagcccttcctggccttaggatttttcctcaggaaactgacttctcgcgaaaaccttctgctaggcgtgggcctcgctatggcgacaaccctgcaattgccggaggatatcgaacagatggccaatgggattgcactgggattaatggctctcaagctgatcacacagtttgagacttaccagctttggaccgccctgatttccttgacgtgttcaaacacaatcttcaccctcactgttgcctggcgaaccgctacactgatactagcaggtgtgagtctgcttcctgtctgccaaagctcgtccatgcggaagactgactggctcccaatggccgtagcggctatgggcgtgccccctctgcccttgtttatcttctctctgaaagataccttaaagcgtagaagctggccactcaatgagggggttatggccgtgggactggtctcaattcttgcaagttccctgttgaggaacgacgtgcctatggccggccccctcgtagctggtgggctgctaatcgcatgttatgtgattacgggaacatctgccgatctgaccgtcgaaaaagcggctgacatcacttgggaggaagaggccgaacagacaggcgttagccacaaccttatgataaccgtggacgatgacggcactatgcgcattaaggatgacgagacagagaatatcctcaccgtgctgttgaaaacggcattactgatcgtctccgggatttttccatactcaataccggccactctcctggtgtggcatacctggcagaagcagacacaacggagcggagttctttgggatgtacctagtcccccagaaacccagaaagctgagctggaagagggtgtgtacagaatcaagcagcagggcattttcgggaagacacaagtcggagtgggcgttcagaaagagggtgtgtttcacactatgtggcacgtcaccaggggggccgtgttgacgtataacggaaagcgactagaacccaattgggcatctgtaaaaaaggacctgatctcctacggcggcgggtggcgcctcagcgctcagtggcaaaaaggagaggaagtccaggtgattgccgttgagcctggtaagaacccaaagaatttccagacaatgcccggcactttccagaccacaaccggggaaatcggagcgatagccctggattttaaacctggcacttcgggttcaccgatcattaaccgggaggggaaggtggtcggactttatggcaatggcgtggttaccaaaaacgggggatacgtgtctggtatcgcacaaacaaatgctgagccagacggccccacgcctgaattagaggaagagatgttcaagaaaagaaacctgactattatggatctccatccagggagtggaaagaccaggaagtatttgcccgccatcgtccgtgaagctataaaacgccggctgagaacactcattctggcacctaccagggtggtagccgccgagatggaggaagctcttaagggcctgccgatccgataccagactacagcgaccaaatccgagcacacgggtcgggaaatcgtggacttgatgtgccatgcaacttttacaatgcgcctactgagccccgttagagtcccaaattataacctcattatcatggatgaggcccacttcaccgaccctgcttctatagccgcaagggggtacattagcacccgggtgggaatgggcgaagccgctgcgatctttatgactgccacacccccaggcaccgcagatgctttccctcagtccaatgcccccattcaggacgaggagcgagacatcccagaaagatcatggaacagtgggaatgagtggataacagattttgcaggaaagactgtgtggttcgtcccgagcattaaagccggtaacgacatcgctaactgtttacgcaagaatggcaagaaagtaatccaactgtctaggaagacgtttgataccgaataccagaaaacaaagcttaacgactgggatttcgtggttactaccgacatttccgagatgggggccaattttaaagcggatcgtgtgatcgaccctcggagatgcctgaagcccgtcattctcacagatggaccagagagggtgatattggcaggccccatgcctgttaccgccgcttcagccgctcagcgccgaggtagagtggggcggaacccacagaaggaaaatgaccaatatatcttcactggccagcccctgaacaatgatgaggaccatgcacactggacggaagccaaaatgctcctggacaacattaatacccctgagggaatcatcccggctcttttcgaaccagagagggagaagagtgccgcaattgatggcgaataccgcctaaaaggggagagccgtaagacatttgtcgaactgatgagacggggagacttgcccgtgtggttagcgcacaaagtagcctccgagggtataaagtatactgataggaaatggtgcttcgacggccagcgcaacaatcagatcctggaagagaacatggatgtggagatttggaccaaggaaggggagaagaaaaagctccgacctagatggctggacgctcggacatactctgatccccttgccctgaaagaatttaaggagttcgcagctggaaggaaatcgatcgccctcgacttggttaccgaaattggccgcgtcccaagccatctggcacacagaactaggaatgccctagataacctggtgatgctccatacatcagagcacggtgggcgggcttatcgtcacgcggtggaggaacttcctgagacgatggaaaccctgttattgctgggcctcatgatcctgcttactggaggcgccatgctgtttctcatatccgggaagggaatcggtaagacaagtattggcttgatctgtgtcattgcatctagcgggatgctgtggatggctgagatccccttacaatggatagcctccgccattgttctagagttctttatgatggtgctgctcatcccagaacctgagaaacagcgcaccccgcaggacaatcaacttgcatacgtagtgattggaatcctgaccttggctgccataatcgcggctaacgaaatgggcctgctcgagacaactaagcgagatctgggtatgtcaaaagaacccggggtcgtgtctccaacgagctatcttgacgttgatctccatcctgccagtgcatggaccctgtacgccgtggctacaactgtcattacccccatgttgagacacacaatcgagaattccaccgcaaacgtaagcctggccgcgattgctaaccaggccgtggttttaatgggcctagacaagggatggccaatctctaaaatggacctgggcgtgcctctccttgcactggggtgctactcacaggtcaatcccttgactctgacggccgctgtgctcctgcttataacacattatgccattatcggaccgggcttacaggcaaaggctaccagggaggcccaaaagcggactgcggccggtatcatgaaaaacccaaccgtcgatgggattatgacaatcgacctggatcctgtgatatacgactccaagttcgaaaaacagctcggacaggttatgttgctggtgctatgtgcagtacagctgctccttatgcgcactagttgggctctgtgcgaggccttgaccctggcaacaggccccattacgaccctctgggaaggtagcccaggcaagttttggaatactacaatcgctgtgtcgatggccaacattttcagagggtcttatctggccggagcgggcttagctttttccatcatgaaaagcgtcgggaccggaaagaggggcactggttcacaaggggagacacttggagaaaagtggaaaaagaaactgaatcagctcagtcggaaggatttcgacctatacaaaaagtctggcataaccgaggttgatcgaacggaggcaaaagaaggtctgaagagaggcgagatcacccaccatgccgtgtcccgcgggagcgctaagttgcagtggtttgtcgaaaggaacatggtgattcccgagggacgggtaatcgacctgggctgtgggcgtggaggctggtcatattactgcgccggtctcaaaaaggtgacagaagttagagggtatactaaaggaggccctggccacgaggagccggtgcccatgagtacctacgggtggaatattgtcaagcttatgagcggaaaagatgtgttctacctgccacctgaaaagtgtgacacattgctgtgcgatatcggtgagtcctctcccagccctactgtcgaagagtccaggaccattcgcgtgctcaagatggttgagccatggttaaaaaacaatcagttctgtatcaaggtactgaacccctatatgcctacagtgatagaacaccttgagcggctgcaacgaaaacatggcgggatgctagtcagaaatccactctcaaggaactctacccacgaaatgtactggattagtaatggaactggcaacatcgtggcatcggttaatatggtgagccgcctgttgctgaaccggtttacgatgacacatagacgtcccaccatcgagaaggacgtcgatctcggtgccgggactaggcacgtgaacgctgaaccggagacccctaatatggacgtaattggagagcggataaaacgcatcaaggaagagcacaactccacatggcattatgacgatgaaaatccatacaagacgtgggcgtatcacggctcttacgaggtgaaagccaccggctcagcaagctccatgattaacggggttgtcaagcttctgactaaaccctgggacgtggtgcctatggtcacacagatggctatgaccgatactacaccattcggacagcaacgagtttttaaggaaaaagtggacaccagaacacccaggagtatgccgggtactcggcgcgtaatgggcatcaccgccgagtggttatggagaacgctggggaggaataagaagcctcgattgtgcacccgggaggaattcacaaaaaaggtgcgtactaacgcagccatgggagctgtctttaccgaggaaaatcagtgggattctgccaaagcggcagtggaggacgaagatttctggaagctcgttgacagagagcgcgagctgcataaactaggcaagtgtggtagctgcgtgtataacatgatggggaaaagggaaaagaagcttggagagtttggcaaagccaagggctcacgggctatttggtacatgtggctgggggccagatacctcgaattcgaggcactgggatttttgaatgaggatcactggttctcccgcgaaaacagttatagcggtgtcgagggcgaagggctgcataaactcggatacatccttagggacatatctaagatccccggcggtgctatgtatgccgatgacacagctgggtgggacactcgaattaccgaggatgacctgcacaatgaagagaaaatcacgcagcagatggatccagagcaccggcaattagccaacgcaatttttaagctgacataccagaataaggtggtaaaagttcagagacctacccccactggaacagtgatggacatcatatccaggaaggatcagcgcggctcaggccaagtcgggacctatggattgaacactttcaccaatatggaagcgcagctcattcgtcagatggagggtgaaggcgtgctgagcaaagccgacctagagaacccacatcttcccgaaaagaaaatcacacagtggctggagacgaagggggtggagcggctcaagagaatggctatctcgggagatgactgcgtcgttaaacctattgatgacaggtttgccaacgcactgttggctttaaatgatatgggcaaggtgcgcaaagacataccacaatggcagccgtctaagggttggcacgattggcagcaggtacccttctgtagtcatcacttccacgaactgatcatgaaagacgggcgaaagctcgtggtcccttgccggccacaagacgagcttattggaagagccaggatctcccagggcgcaggctggagcctgaaggaaaccgcctgtctagggaaagcgtacgctcagatgtggtcactgatgtattttcatcgcagagatctccggttggcctccaacgcaatttgctctgccgtgcccgttcactgggtgcctactagcaggacaacctggagtatccatgctcaccatcaatggatgactacagaggacatgctgaccgtctggaatcgtgtgtggatagaagataacccatggatggaggacaagacgcccgtaacaacctgggagaatgttccttaccttggaaaacgagaagatcagtggtgtggttccctgatcggcctcactagccgcgccacctgggcacagaacattccgacagctatccagcaagtgagatctttaattgggaatgaggaattcctggactacatgccatcaatgaagcggtttaggaaagaggaggaaagtgagggagccatctggtga

SEQ ID NO: 15289 - RNA, 9873 nt, synthetic construct
  misc_feature 1..9873: note = derived and/or modified CDS sequence (opt3) from DENV-3__HM181978__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtagcgcttctgacagaatgggtatgggggtgacatatcttgccttgatagcaacctttaaaatccagcccttcctggccttaggatttttcctcaggaagctgacttcccgcgaaaatcttctgctaggcgtcggcctcgctatggcgacaaccctgcaattgccggaggatattgaacagatggccaacgggatcgcactgggattaatggctctcaaactgattacacagtttgagacttaccagctttggaccgccctgatctcattgacgtgtagtaatacaatattcaccctcactgtggcctggcgaaccgctacactgatcctagcaggtgttagcctgcttcctgtgtgccaatcgtcctctatgcggaagactgactggctcccaatggccgtcgcggctatgggcgtaccccctctgcccttgtttattttcgggctgaaggataccttaaaacgtagaagctggccactcaacgagggagtgatggccgttggcctggtgtcaatccttgcaagttccctgttgaggaatgacgtccctatggccggtcccctcgtggctgggggactgctaattgcatgttatgtaatcacgggcacatctgccgatctgaccgtggaaaaggcggctgacataacttgggaggaagaggccgaacagacaggcgtcagccacaaccttatgattaccgttgacgatgacgggactatgcgcatcaaagatgacgagacagagaacatcctcaccgtgctgttgaagacggcattactgattgtgtccggaatatttccatactcaatcccggccactctcctggtctggcatacctggcagaaacagacacaacggagcggtgtgctttgggatgttcctagtcccccagaaacccagaaggctgagctggaagagggcgtatacagaattaaacagcaggggatcttcggaaagacacaagtgggcgtcggtgtgcagaaggagggggtttttcacactatgtggcacgtgaccaggggagccgtcttgacgtataatggcaaacgactagaacccaactgggcatctgtgaagaaagacctgatttcctacggcgggggatggcgcctcagcgctcagtggcaaaagggtgaggaagtacaggtcatcgccgtggagcctggcaaaaatccaaagaacttccagacaatgcccgggactttccagaccacaaccggagaaataggcgcgatcgccctggattttaagcctggtacttcggggtcaccgattatcaatcgggagggaaaagttgtgggcctttatggcaacggggtcgtgaccaagaatggaggttacgtttctggcattgcacaaacaaacgctgagccagacgggcccacgcctgaattagaggaagagatgttcaaaaagagaaatctgactatcatggatctccatccaggaagtggcaaaaccaggaagtatttgcccgccatagtgcgtgaagctattaagcgccggctgagaacactcatcctggcacctaccagggtcgtggccgccgagatggaggaagctcttaaaggtctgccgatccgataccagactacagcgaccaagtccgagcacacggggcgggaaattgtagacttgatgtgccatgcaacttttacaatgcgcctactgagccccgtgagagttccaaactataatctcatcataatggatgaggcccacttcaccgaccctgcttctattgccgcaaggggatacatcagcacccgggtcggcatgggcgaagccgctgcgatttttatgactgccacacccccagggaccgcagatgctttccctcagtccaacgcccccatccaggacgaggagcgagacataccagaaagatcatggaatagtggaaacgagtggattacagattttgcaggtaaaactgtgtggttcgtgccgagcatcaaggccggcaatgacatcgctaactgtttacgcaaaaacgggaagaaggtcattcaactgtctaggaaaacgtttgataccgaataccagaagacaaaacttaatgactgggatttcgtagtgactaccgacatctccgagatgggagccaactttaaggcggatcgtgttattgaccctcggagatgcctgaaacccgtgatactcacagatggcccagagagggtcatcttggcaggtcccatgcctgtgaccgccgcttcagccgctcagcgccgagggagagttggccggaatccacagaaggaaaacgaccaatatattttcactggacagcccctgaataacgatgaggaccatgcacactggacggaagccaagatgctcctggacaatatcaacacccctgagggcatcattccggctcttttcgaaccagagagggagaaaagtgccgcaatagatggggaataccgcctaaagggagagagccgtaaaacatttgtggaactgatgagacggggtgacttgcccgtctggttagcgcacaaggtggcctccgagggcatcaaatatactgataggaagtggtgcttcgacgggcagcgcaataaccagattctggaagagaatatggatgtagagatctggaccaaagaaggagagaagaagaaactccgacctagatggctggacgctcggacatactctgatccccttgccctgaaggaatttaaagagttcgcagctggcaggaagtcgattgccctcgacttggtgaccgaaatcggtcgcgttccaagccatctggcacacagaactaggaacgccctagataatctggtcatgctccatacatcagagcacgggggccgggcttatcgtcacgcggtggaggaacttcctgagacgatggaaaccctgttattgctgggactcatgatactgcttactggcggggccatgctgtttctcatctccggaaaaggtattggcaagacaagtatcgggttgatttgtgtgatcgcatctagcggaatgctgtggatggctgagatacccttacaatggattgcctccgccatcgtcctagagttctttatgatggttctgctcattccagaacctgagaagcagcgcaccccgcaggacaaccaacttgcatacgtggtaatcggcatactgaccttggctgccatcattgcggctaatgaaatgggtctgctcgagacaactaaacgagatctggggatgtcaaaggaacccggcgtggtctctccaacgagctatcttgacgtggatctccatcctgccagtgcatggaccctgtacgccgttgctacaactgtgatcacccccatgttgagacacacaattgagaactccaccgcaaatgtcagcctggccgcgatcgctaaccaggccgtagtgttaatgggactagacaaaggctggccaatatctaagatggacctgggggttcctctccttgcactgggatgctactcacaggtgaaccccttgactctgacggccgctgtcctcctgcttattacacattatgccatcatcggcccgggtttacaggcaaaagctaccagggaggcccaaaagcggactgcggccgggattatgaagaatccaaccgtggatggaatcatgacaatagacctggatcctgtcatttacgactccaaattcgaaaagcagctcggccaggtgatgttgctggttctatgtgcagtgcagctgctccttatgcgcactagttgggctctgtgcgaggccttgaccctggcaacaggtcccatcacgaccctctgggaaggcagcccagggaaattttggaacactacaattgctgtatcgatggccaatatcttcagaggatcttatctggccggcgcggggttagctttttccataatgaagagcgtgggaaccggcaaaaggggtactgggtcacaaggagagacacttggcgaaaagtggaagaaaaagctgaaccagctcagtcggaaagatttcgacctatacaagaaatctggtatcaccgaggtcgatcgaacggaggcaaaggaaggcctgaaaagaggggagattacccaccatgccgtttcccgcggaagcgctaagttgcagtggtttgtggaaaggaatatggtcatccccgagggccgggtgattgacctggggtgtggacgtggcggttggtcatattactgcgccgggctcaagaaagtaacagaagtgagaggatatactaagggcggccctgggcacgaggagccggttcccatgagtacctacggatggaacatcgtgaaacttatgagcggtaaggatgtcttctacctgccacctgaaaaatgtgacacattgctgtgcgatattggcgagtcctctcccagccctactgtggaagagtccaggaccatccgcgtcctcaagatggtggagccatggttaaagaataaccagttctgtataaaagttctgaatccctatatgcctacagtaattgaacaccttgagcggctgcaacgaaagcatgggggaatgctagtgagaaacccactctcaaggaattctacccacgaaatgtactggatcagtaacggcactggtaatatcgtcgcatcggtgaacatggttagccgcctgttgctgaatcggtttacgatgacacatagacgtcccaccattgagaaagacgtggatctcggggccggaactaggcacgtcaacgctgaaccggagacccctaacatggacgtgataggcgagcggatcaagcgcattaaagaagagcacaattccacatggcattatgacgatgaaaacccatacaagacgtgggcgtatcacggctcttacgaggtaaaggccaccgggtcagcaagctccatgatcaatggagtggttaaacttctgactaagccctgggacgtcgtgcctatggtgacacagatggctatgaccgatactacaccattcggtcagcaacgagtctttaaagaaaaggttgacaccagaacacccaggagtatgccgggcactcggcgcgtgatggggattaccgccgagtggttatggagaacgctgggaaggaacaaaaagcctcgattgtgcacccgggaggaattcacaaagaaagtacgtactaatgcagccatgggcgctgtgtttaccgaggaaaaccagtgggattctgccaaggcggcagtcgaggacgaagatttctggaaactcgtggacagagagcgcgagctgcataagctaggtaaatgtgggagctgcgtttataatatgatgggaaagagggaaaaaaagcttggcgagtttggcaaggccaaagggtcacgggctatctggtacatgtggctgggagccagatacctcgaattcgaggcactgggttttttgaacgaggatcactggttctcccgcgaaaatagttatagcggcgtggagggggaaggactgcataagctcggctacatacttagggacatctctaaaattcccggtggggctatgtatgccgatgacacagctggatgggacactcgaatcaccgaggatgacctgcacaacgaagagaagattacgcagcagatggatccagagcaccggcaattagccaatgcaatctttaaactgacataccagaacaaggtcgtgaaggtacagagacctacccccactggcacagttatggacataatttccaggaaagatcagcgcggctcagggcaagtgggaacctatggtttgaatactttcaccaacatggaagcgcagctcatccgtcagatggagggcgaaggggtcctgagcaaggccgacctagagaatccacatcttcccgaaaaaaagatcacacagtggctggagacgaaaggagtggagcggctcaagagaatggctatttcgggcgatgactgcgtggtcaagcctatagatgacaggtttgccaacgcactgttggctttaaacgatatgggtaaagttcgcaaggacatcccacaatggcagccgtctaaagggtggcacgattggcagcaggtgcccttctgtagtcatcacttccacgaactgattatgaaggacggacgaaaactcgtagtgccttgccggccacaagacgagcttatcggcagagccaggatttcccagggcgcagggtggagcctgaaggaaaccgcctgtctaggaaaggcgtacgctcagatgtggtcactgatgtattttcatcgcagagatctccggttggcctccaatgcaatctgctctgccgtccccgtgcactgggttcctactagcaggacaacctggagtatacatgctcaccatcaatggatgactacagaggacatgctgaccgtgtggaaccgtgtctggatcgaagataatccatggatggaggacaaaacgcccgtgacaacctgggagaacgtaccttaccttggtaagcgagaagatcagtggtgtggctccctgattgggctcactagccgcgccacctgggcacagaatatcccgacagctattcagcaagttagatctttaatcggaaacgaggaattcctggactacatgccatcaatgaaacggtttaggaaggaggaggaaagtgagggcgccatttggtga

SEQ ID NO: 15290 - RNA, 9873 nt, synthetic construct
  misc_feature 1..9873: note = derived and/or modified CDS sequence (opt3) from DENV-3__JN183884__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgaaaatgaagaacaaagcgtggatggtccatagacagtggtttttcgatctccccctgccttggacaagcggggccaccactgaaacaccaacgtggaataggaaggagcttctggtgacctttaaaaacgcacacgctaagaagcaagaagtagttgtgttgggctcccaggagggagccatgcacactgctctcacaggcgccaccgaaattcagaattcagggggaacaagtatattcgcaggtcatctgaaatgtcggttaaagatggacaaactggagctaaagggcatgagctacgccatgtgcactaacacctttgtcctcaaaaaggaggtgtctgaaacgcagcacgggaccatcctgattaaggtcgagtacaaaggagaagatgtgccctgtaagatccctttctccacagaggacggccaaggtaaagctcataacgggcgtcttataactgcgaatccagttgtgaccaagaaagaggaacccgtaaacattgaggcagaaccgcctttcggcgagtcaaatatcgtcatcggaattggcgataacgccttgaagatcaattggtataagaaagggagcagtattggaaagatgtttgaagctacagcccgcggtgcaagaaggatggccatactgggcgacactgcttgggatttcgggtctgtgggaggcgttctcaactccctgggtaaaatggtgcaccagatctttgggagcgcctacaccgcacttttctcgggcgtctcttgggtgatgaagattggaatcggcgtactgttgacgtggatcgggctcaattccaaaaacacatcaatgagttttagctgcattgcgataggaatcattaccctgtatttaggcgctgtggttcaggccgacatgggttgtgtcatcaattggaaggggaaggagctgaaatgcggatccggcattttcgtgactaacgaggtgcatacatggaccgaacagtacaagtttcaagcagattctcccaaacggctagccactgctatcgccggtgcatgggagaatggcgtctgtgggatacgaagcaccacacgcatggaaaacctcctgtggaagcagatcgctaatgagcttaactatattttgtgggaaaataacatcaaactgacggttgtggtgggagacattatcggcgtactcgagcaggggaagagaaccctgactccacagcctatggagttaaaatactcatggaagacatggggaaaggccaaaatagtcaccgcggaaacacaaaacagttccttcattatcgatggccccaatactccagagtgccccagcgtgtctagggcctggaacgtttgggaagtggaggactatggttttggggtcttcaccacgaatatttggctgaagcttcgggaagtgtacacacagttgtgtgaccaccgcctcatgtcagctgcagttaaagatgagagagccgtgcacgctgacatgggatactggatcgagagtcagaagaacggcagctggaaactggaaaaggcctccctaatagaggtaaagacctgcacttggcctaaatctcataccctgtggtcgaatggtgtcctcgaaagcgatatgatcattccaaagtccctggcaggcccgatctcacagcacaaccataggcccgggtatcacacacaaactgcgggaccttggcaccttggcaaattggagctggactttaattactgcgaggggaccacagtggtgattacggaaaactgtggaacccgtggcccaagtttacggactacaaccgtctctggtaagctcatccatgagtggtgctgtcgaagctgcactctgccccctcttagatatatgggggaagatggatgttggtacggcatggagataaggccaatttccgaaaaagaggagaatatggttaagtcactggtgagcgccggttctggcaaggtagacaacttcacaatgggggtgttgtgcctcgctatcctgtttgaagaggtcatgcgcggaaaattcggcaagaaacacatgatcgccggggtgttctttaccttcgttctactgctctccggacagattacgtggcgggatatggcacatactctgatcatgattggcagtaatgctagcgacagaatgggtatgggggtgacctatcttgccttgatagcaacatttaagatccagcccttcctggccttaggatttttcctcaggaaactgacctctcgcgaaaaccttctgctaggcgtcggcctcgctatggcgactacactgcaattgccggaggatattgaacagatggccaatgggatcgcactgggattaatggctctcaagctgattacccagtttgagacataccagctttggactgccctgatctccttgacctgttcaaacacgatattcacactcaccgtggcctggcgaactgctaccctgatcctagcaggtgttagtctgcttcctgtgtgccaaagctcgtccatgcggaagacagactggctcccaatggccgtcgcggctatgggcgtaccccctctgcccttgtttattttcgggctgaaagatactttaaagcgtagatcttggccactcaatgagggagtgatggccgttggcctggtgagcatccttgcatcaagtctgttgaggaacgacgtccctatggccggtcccctcgtggctgggggactgctaattgcatgttatgtaatcaccggcacgtccgccgatctgacagtggaaaaagcggctgacataacctgggaggaagaggccgaacagactggcgtctctcacaaccttatgattacagttgacgatgacgggaccatgcgcatcaaggatgacgagactgagaatatcctcacagtgctgttgaaaaccgcattactgattgtgagcggaatatttccatactccatcccggccacgctcctggtctggcatacttggcagaagcagacccaacggtcaggtgtgctttgggatgttcctagccccccagaaacacagaaagctgagctggaagagggcgtatacagaattaagcagcaggggatcttcggaaagacccaagtgggcgtcggtgtgcagaaagagggggtttttcacacaatgtggcacgtgactaggggagccgtcttgacctataacggcaagcgactagaacccaattgggcaagtgtgaaaaaggacctgatttcttacggcgggggatggcgcctctccgctcagtggcaaaaaggtgaggaagtacaggtcatcgccgtggagcctggcaagaacccaaagaatttccagacgatgcccgggacattccagactaccacaggagaaataggcgcgatcgccctggattttaaacctggtaccagcgggtcgccgattatcaaccgggagggaaaggttgtgggcctttatggcaatggggtcgtgactaaaaacggaggttacgtttcaggcattgcacaaaccaatgctgagccagacgggcccacacctgaattagaggaagagatgttcaagaaaagaaacctgacgatcatggatctccatccaggatctggcaagactaggaagtatttgcccgccatagtgcgtgaagctattaaacgccggctgagaaccctcatcctggcacctacaagggtcgtggccgccgagatggaggaagctcttaagggtctgccgatccgataccagaccactgcgacaaaaagtgagcacaccgggcgggaaattgtagacttgatgtgccatgcaacgtttactatgcgcctactgtcccccgtgagagttccaaattataacctcatcataatggatgaggcccacttcacagaccctgctagcattgccgcaaggggatacatctctacccgggtcggcatgggcgaagccgctgcgatttttatgaccgccactcccccagggacagcagatgctttccctcagagcaatgcccccatccaggacgaggagcgagacataccagaaagatcctggaactcaggaaatgagtggattaccgattttgcaggtaagacagtgtggttcgtgccgagtatcaaagccggcaacgacatcgctaactgtttacgcaagaatgggaagaaagtcattcaactgagcaggaagacttttgatacggaataccagaaaaccaagcttaacgactgggatttcgtagtgacaactgacatctctgagatgggagccaattttaaagcggatcgtgttattgaccctcggagatgcctgaagcccgtgatactcaccgatggcccagagagggtcatcttggcaggtcccatgcctgtgacagccgcttccgccgctcagcgccgagggagagttggccggaacccacagaaggaaaatgaccaatatattttcaccggacagcccctgaacaatgatgaggaccatgcacactggactgaagccaaaatgctcctggacaacatcaatacgcctgagggcatcattccggctcttttcgaaccagagagggagaagtcagccgcaatagatggggaataccgcctaaaaggagagagtcgtaagacctttgtggaactgatgagacggggtgacttgcccgtctggttagcgcacaaagtggccagcgagggcatcaagtatacagataggaaatggtgcttcgacgggcagcgcaacaatcagattctggaagagaacatggatgtagagatctggactaaggaaggagagaagaaaaagctccgacctagatggctggacgctcggacctactccgatccccttgccctgaaagaatttaaggagttcgcagctggcaggaaatctattgccctcgacttggtgacagaaatcggtcgcgttccatcgcatctggcacacagaaccaggaatgccctagataacctggtcatgctccatactagcgagcacgggggccgggcttatcgtcacgcggtggaggaacttcctgagacaatggaaacgctgttattgctgggactcatgatactgcttaccggcggggccatgctgtttctcatctcaggaaagggtattggcaagacttccatcgggttgatttgtgtgatcgcaagttctggaatgctgtggatggctgagatacccttacaatggattgccagcgccatcgtcctagagttctttatgatggttctgctcattccagaacctgagaaacagcgcacaccgcaggacaatcaacttgcatacgtggtaatcggcatactgaccttggctgccatcattgcggctaacgaaatgggtctgctcgagaccacaaagcgagatctggggatgtccaaagaacccggcgtggtctcaccaacttcttatcttgacgtggatctccatcctgccagcgcatggacgctgtacgccgttgctaccacagtgatcactcccatgttgagacacaccattgagaatagtacagcaaacgtctccctggccgcgatcgctaaccaggccgtagtgttaatgggactagacaagggctggccaataagcaaaatggacctgggggttcctctccttgcactgggatgctactctcaggtgaatcccttgaccctgactgccgctgtcctcctgcttattacgcattatgccatcatcggcccgggtttacaggcaaaggctacaagggaggcccaaaagcggaccgcggccgggattatgaaaaacccaactgtggatggaatcatgaccatagacctggatcctgtcatttacgactcaaagttcgaaaaacagctcggccaggtgatgttgctggttctatgtgcagtgcagctgctccttatgcgcacatcctgggctctgtgcgaggccttgactctggcaaccggtcccatcacaacgctctgggaaggcagtccagggaagttttggaataccactattgctgtaagcatggccaacatcttcagaggatcgtatctggccggcgcggggttagctttttctataatgaaatccgtgggaacaggcaagaggggtaccgggagccaaggagagactcttggcgaaaagtggaaaaagaaactgaatcagctctcacggaaggatttcgacctatacaaaaagagtggtatcacagaggtcgatcgaaccgaggcaaaagaaggcctgaagagaggggagattacgcaccatgccgtttctcgcggatccgctaagttgcagtggtttgtggaaaggaacatggtcatccccgagggccgggtgattgacctggggtgtggacgtggcggttggagctattactgcgccgggctcaaaaaggtaaccgaagtgagaggatatacaaaaggcggccctgggcacgaggagccggttcccatgtcaacttacggatggaatatcgtgaagcttatgagtggtaaagatgtcttctacctgccacctgaaaagtgtgacaccttgctgtgcgatattggcgagagctccccctctcctacagtggaagagagcaggactatccgcgtcctcaagatggtggagccatggttaaaaaacaatcagttctgtataaaggttctgaacccctatatgcctaccgtaattgaacaccttgagcggctgcaacgaaaacatgggggaatgctagtgagaaatccactctccaggaactcaacacacgaaatgtactggatctctaatggcaccggtaacatcgtcgcaagtgtgaatatggtttcgcgcctgttgctgaaccggtttactatgacgcatagacgtcccacaattgagaaggacgtggatctcggggccggaaccaggcacgtcaacgctgaaccggagactcctaatatggacgtgataggcgagcggatcaaacgcattaaggaagagcacaacagcacctggcattatgacgatgaaaatccatacaagacatgggcgtatcacggctcctacgaggtaaaagccacggggtctgcatcaagcatgatcaacggagtggttaagcttctgaccaaaccctgggacgtcgtgcctatggtgactcagatggctatgacagataccactccattcggtcagcaacgagtctttaaggaaaaagttgacacaagaacccccaggtccatgccgggcacacggcgcgtgatggggattactgccgagtggttatggagaaccctgggaaggaataagaagcctcgattgtgcacgcgggaggaattcaccaaaaaggtacgtacaaacgcagccatgggcgctgtgtttactgaggaaaatcagtgggatagtgccaaagcggcagtcgaggacgaagatttctggaagctcgtggacagagagcgcgagctgcataaactaggtaagtgtgggtcttgcgtttataacatgatgggaaaaagggaaaagaagcttggcgagtttggcaaagccaaggggagccgggctatctggtacatgtggctgggagccagatacctcgaattcgaggcactgggttttttgaatgaggatcactggttctcacgcgaaaactcctatagtggcgtggagggggaaggactgcataaactcggctacatacttagggacatcagcaagattcccggtggggctatgtatgccgatgacaccgctggatgggacacacgaatcactgaggatgacctgcacaatgaagagaaaattacccagcagatggatccagagcaccggcaattagccaacgcaatctttaagctgacgtaccagaataaggtcgtgaaagtacagagacctacacccaccggcactgttatggacataatttctaggaaggatcagcgcggctccgggcaagtgggaacatatggtttgaacaccttcactaatatggaagcgcagctcatccgtcagatggagggcgaaggggtcctgtcaaaagccgacctagagaacccacatcttcccgaaaagaaaatcacccagtggctggagacaaagggagtggagcggctcaagagaatggctattagcggcgatgactgcgtggtcaaacctatagatgacaggtttgccaacgcactgttggctttaaatgatatgggtaaggttcgcaaagacatcccacaatggcagccgtcgaaggggtggcacgattggcagcaggtgcccttctgttctcatcacttccacgaactgattatgaaagacggacgaaagctcgtagtgccttgccggccacaagacgagcttatcggcagagccaggattagtcagggcgcagggtggtccctgaaggaaacggcctgtctaggaaaagcgtacgctcagatgtggagcctgatgtattttcatcgcagagatctccggttggcctcaaacgcaatctgctccgccgtccccgtgcactgggttcctacctctaggactacatggagcatacatgctcaccatcaatggatgaccactgaggacatgctgacagtgtggaatcgtgtctggatcgaagataacccatggatggaggacaagacccccgtgacgacatgggagaatgtaccttaccttggtaaacgagaagatcagtggtgtggcagtctgattgggctcacctcccgcgccacttgggcacagaacatcccgaccgctattcagcaagttagaagcttaatcggaaatgaggaattcctggactacatgccatctatgaagcggtttaggaaagaggaggaatcagagggcgccatttggtga

SEQ ID NO: 15291 - RNA, 9873 nt, synthetic construct
  misc_feature 1..9873: note = derived and/or modified CDS sequence (opt3) from DENV-3__HQ541785__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagcaggtgttagtctgcttcctgtgtgccaaagctcgtccatgcggaagactgactggctcccaatggccgtcgcggctatgggcgtaccccctctgcccttgtttattttctctctgaaggataccttaaaacgtagaagctggccactcaatgagggggtgatggccgttggactggtgtcaatccttgcaagttccctgttgaggaacgacgtccctatggccggccccctcgtggctggtgggctgctaattgcatgttatgtaatcacgggaacatctgccgatctgaccgtggaaaaggcggctgacataacttgggaggaagaggccgaacagacaggcgtcagccacaaccttatgattgcagttgacgatgacggcaccatgcgcatcaaagatgacgagactgagaatatcctcacagtgctgttgaagaccgccttactgattgtgtccgggatatttccatactcaatcccggctacgctcctggtctggcatacttggcagaaacagacccaacggagcggagtgctttgggatgttcctagtcccccagaaacacagaaggccgagctggaagagggtgtatacagaattaaacagcagggcatcttcgggaagacccaagtgggagtcggcgtgcagaaggagggtgtttttcacacaatgtggcacgtgactaggggggcagtcttgacctataacggaaaacgactagaacccaattgggcttctgtgaagaaagacctgatttcctacggcggcgggtggcgcctcagcgcccagtggcaaaagggagaggaagtacaggtcatcgcggtggagcctggtaaaaacccaaagaatttccagacgatgcccggcacattccagactaccacaggggaaataggagccatcgcactggattttaagcctggcacctcgggttcaccgattatcaaccgggaggggaaagttgtgggactttatggcaatggcgtcgtgactaagaacgggggatacgtttctggtattgctcaaaccaatgccgagccagacggccccacacctgaattagaggaagagatgttcaaaaagagaaacctgacgatcatggatctccatccagggagtggaaaaactaggaagtatttgcccgctatagtgcgtgaagcaattaagcgccggctgagaaccctcatcctggcccctacaagggtcgtggccgctgagatggaggaagcgcttaaaggcctgccgatccgataccagaccactgcaacaaagtccgagcacaccggtcgggaaattgtagacttgatgtgccatgccacgtttactatgcgcctactgagccccgtgagagttccaaattataacctcatcataatggatgaggctcacttcacagaccctgcctctattgcagccagggggtacatcagcacccgggtcggaatgggcgaagctgcggccatttttatgaccgcaactcccccaggcacagctgatgccttccctcagtccaatgcacccatccaggacgaggagcgagacataccagaaagatcatggaacagtgggaatgagtggattaccgattttgccggaaaaacagtgtggttcgtgccgagcatcaaggctggtaacgacatcgccaactgtttacgcaaaaatggcaagaaggtcattcaactgtctaggaaaacttttgatacggaataccagaagaccaaacttaacgactgggatttcgtagtgacaactgacatctccgagatgggggcgaattttaaggcagatcgtgttattgaccctcggagatgcctgaaacccgtgatactcaccgatggaccagagagggtcatcttggccggccccatgcctgtgacagctgcctcagctgcacagcgccgaggtagagttgggcggaacccacagaaggaaaatgaccaatatattttcaccggccagcccctgaacaatgatgaggaccatgcccactggactgaagctaagatgctcctggacaacatcaatacgcctgagggaatcattccggcccttttcgaaccagagagggagaaaagtgcagcgatagatggcgaataccgcctaaagggggagagccgtaaaacctttgtggaactgatgagacggggagacttgcccgtctggttagcccacaaggtggcttccgagggtatcaaatatacagataggaagtggtgcttcgacggccagcgcaacaatcagattctggaagagaacatggatgtagagatctggactaaagaaggggagaagaagaaactccgacctagatggctggacgcccggacctactctgatccccttgcactgaaggaatttaaagagttcgctgccggaaggaagtcgattgcactcgacttggtgacagaaatcggccgcgttccaagccatctggcccacagaaccaggaatgctctagataacctggtcatgctccatacttcagagcacggtgggcgggcgtatcgtcacgccgtggaggaacttcctgagacaatggaaacgctgttattgctgggcctcatgatactgcttaccggaggcgcaatgctgtttctcatctccgggaaaggaattggtaagactagtatcggcttgatttgtgtgatcacatctagcgggatgctgtggatggctgagatacccttacaatggattgcctccgccatcgtcctagagttctttatgatggttctgctcattccagaacctgagaagcagcgcaccccgcaggacaatcaacttgcatacgtggtaatcggaatactgaccttggctgccatcattgcggctaacgaaatgggcctgctcgagacaactaaacgagatctgggtatgtcaaaggaacccggggtggtctctccaacgagctatcttgacgtggatctccatcctgccagtgcatggaccctgtacgccgttgctacaactgtgatcacccccatgttgagacacacaattgagaattccaccgcaaacgtcagcctggccgcgatcgctaaccaggccgtagtgttaatgggcctagacaaaggatggccaatatctaagatggacctgggcgttcctctccttgcactggggtgctactcacaggtgaatcccttgactctgacggccgctgtcctcctgcttattacacattatgccatcatcggaccgggcttacaggcaaaagctaccagggaggcccaaaagcggactgcggccggtattatgaagaacccaaccgtggatgggatcatgacaatagacctggatcctgtcatttacgactccaaattcgaaaagcagctcggacaggtgatgttgctggttctatgtgcagtgcagctgctccttatgcgcactagttgggctctgtgcgaggccttgaccctggcaacaggccccatcacgaccctctgggaaggtagcccaggcaaattttggaatactacaattgctgtatcgatggccaacatcttcagagggtcttatctggccggagcgggcttagctttttccataatgaagagcgtggggaccggaaaaaggggcactggttcacaaggggagacacttggagaaaagtggaagaaaaagctgaatcagctcagtcggaaagatttcgacctatacaagaaatctggcatcaccgaggtcgatcgaacggaggcaaaggaaggtctgaaaagaggcgagattacccaccatgccgtttcccgcgggagcgctaagttgcagtggtttgtggaaaggaacatggtcatccccgagggacgggtgattgacctgggctgtgggcgtggaggctggtcatattactgcgccggtctcaagaaagtaacagaagtgagagggtatactaagggaggccctggccacgaggagccggttcccatgagtacctacgggtggaatatcgtgaaacttatgagcggaaaggatgtcttctacctgccacctgaaaaatgtgacacattgctgtgcgatattggtgagtcctctcccagccctactgtggaagagtccaggaccatccgcgtcctcaagatggtggagccatggttaaagaacaatcagttctgtataaaagttctgaacccctatatgcctacagtaattgaacaccttgagcggctgcaacgaaagcatggcgggatgctagtgagaaatccactctcaaggaactctacccacgaaatgtactggatcagtaatggaactggcaacatcgtcgcatcggtgaatatggttagccgcctgttgctgaaccggtttacgatgacacatagacgtcccaccattgagaaagacgtggatctcggtgccgggactaggcacgtcaacgctgaaccggagacccctaatatggacgtgataggagagcggatcaagcgcattaaagaagagcacaactccacatggcattatgacgatgaaaatccatacaagacgtgggcgtatcacggctcttacgaggtaaaggccaccggctcagcaagctccatgatcaacggggtggttaaacttctgactaagccctgggacgtcgtgcctatggtgacacagatggctatgaccgatactacaccattcggacagcaacgagtctttaaagaaaaggttgacaccagaacacccaggagtatgccgggtactcggcgcgtgatgggcattaccgccgagtggttatggagaacgctggggaggaataaaaagcctcgattgtgcacccgggaggaattcacaaagaaagtacgtactaacgcagccatgggagctgtgtttaccgaggaaaatcagtgggattctgccaaggcggcagtcgaggacgaagatttctggaaactcgtggacagagagcgcgagctgcataagctaggcaaatgtggtagctgcgtttataacatgatggggaagagggaaaaaaagcttggagagtttggcaaggccaaaggctcacgggctatctggtacatgtggctgggggccagatacctcgaattcgaggcactgggatttttgaatgaggatcactggttctcccgcgaaaacagttatagcggtgtggagggcgaagggctgcataagctcggatacatacttagggacatctctaaaattcccggcggtgctatgtatgccgatgacacagctgggtgggacactcgaatcaccgaggatgacctgcacaatgaagagaagattacgcagcagatggatccagagcaccggcaattagccaacgcaatctttaaactgacataccagaataaggtcgtgaaggtacagagacctacccccactggaacagttatggacataatttccaggaaagatcagcgcggctcaggccaagtggggacctatggattgaacactttcaccaatatggaagcgcagctcatccgtcagatggagggtgaaggcgtcctgagcaaggccgacctagagaacccacatcttcccgaaaaaaagatcacacagtggctggagacgaaaggggtggagcggctcaagagaatggctatttcgggagatgactgcgtggtcaagcctatagatgacaggtttgccaacgcactgttggctttaaatgatatgggcaaagttcgcaaggacatcccacaatggcagccgtctaaaggttggcacgattggcagcaggtgcccttctgtagtcatcacttccacgaactgattatgaaggacgggcgaaaactcgtagtgccttgccggccacaagacgagcttatcggaagagccaggatttcccagggcgcaggctggagcctgaaggaaaccgcctgtctagggaaggcgtacgctcagatgtggtcactgatgtattttcatcgcagagatctccggttggcctccaacgcaatctgctctgccgtccccgtgcactgggttcctactagcaggacaacctggagtatacatgctcaccatcaatggatgactacagacgatatgctgaccgtgtggaatcgtgtctggatcgaggacaacccatggatggaagataaaacgcccgtgacaacctgggagaatgtaccttaccttggaaagcgagaggaccagtggtgtggttccctgattggcctcactagccgcgccacctgggcacagaacatcccgacagctattcagcaagttagatctttaatcgggaatgaagagttcctggattacatgccatcaatgaaacggtttaggaaggaagaggagagtgaaggagccatttggtga

SEQ ID NO: 15292 - RNA, 9873 nt, synthetic construct
  misc_feature 1..9873: note = derived and/or modified CDS sequence (opt3) from DENV-3__HM181975__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcgtcttactgatgcttgtgaccccatcgatgacaatgcgctgtgtaggcgttgggaacagagactttgtggaaggattgtcaggtgccacctgggtcgatgtggtgctggagcacggcgggtgcgtcacgactatggcgaagaataaacccacactagacatcgagctccagaagaccgaagcaactcaactggccacacttaggaaactgtgtattgagggaaagatcaccaacattacgaccgatagccggtgccctacacagggcgaagctactttgccagaggaacaggaccagaattatgtttgtaaacacacctacgtggatcgcggttgggggaacggatgcggcctcttcggcaaggggagtctggtaacatgcgccaagtttcaatgtttagagcccatcgagggaaaagtggtccagcatgaaaatctgaagtatactgtgataattaccgttcacacaggtgaccagcatcaggtgggcaacgagacccaaggggtcactgcagaaatcacgcctcaggcttccacaaccgaggccattctcccagaatacggaactcttggcctggagtgctctccgcgaaccggtttggacttcaatgagatgatcctactgacaatgaaaaacaaggcgtggatggtgcacagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcatacagctctcaccggcgccacagaaatccagaattcagggggaactagtattttcgcaggtcacctgaagtgtcggttaaaaatggacaagctggagctaaaaggcatgagctatgccatgtgcaccaacacgtttgtgctcaagaaagaggtctctgaaacccagcatgggacaatactgatcaaggtggagtacaagggagaagatgttccctgtaaaattcctttctccactgaggacggccaaggtaaggctcacaacgggcgtcttatcaccgcgaatccagtggtaacaaaaaaggaggaacccgtcaacatagaggcagaaccgcctttcggcgagtcaaatattgtgatcggaatcggcgataacgccttgaaaattaattggtacaagaaggggagcagtatcggaaaaatgtttgaagctactgcccgcggtgcaagaaggatggccattctgggcgacaccgcttgggatttcgggtctgttggaggcgtgctcaactccctgggtaagatggtccatcagatatttgggagcgcctatacggcacttttctcgggcgtgtcttgggtaatgaaaatcggaattggcgtgctgttgacatggatcgggctcaattccaagaacacctcaatgagttttagctgcatcgcgattggaataatcactctgtacttaggcgctgttgtccaggccgacatgggttgtgtgattaattggaaagggaaggagctgaagtgcggatccggcatcttcgtgacaaacgaggtccacacctggactgaacagtataaatttcaagcagattctcccaagcggctagccaccgctattgccggtgcatgggagaatggcgtttgtgggatccgaagcacaacgcgcatggaaaacctcctgtggaaacagatagctaatgagcttaactacatcttgtgggaaaataacattaagctgaccgtggtggtaggagacatcattggcgtcctcgagcaggggaaaagaactctgacaccacagcctatggagttaaagtattcatggaaaacctggggaaaggccaagatcgtgacagcggaaactcaaaacagttccttcataattgatggccccaataccccagagtgccccagcgtttctagggcctggaacgtgtgggaagtcgaggactacggttttggggtgttcacgacaaatatctggctgaaacttcgggaagtttatacccagttgtgtgaccaccgcctcatgtcagctgcagtgaaggatgagagagccgtacatgctgacatgggatactggattgagagtcagaaaaacggcagctggaagctggaaaaagcctccctaatcgaggtcaagacttgcacctggcctaagtctcacacactgtggtcgaatggtgtgctcgaaagcgatatgataatcccaaaatccctggcaggcccgatttcacagcataaccacaggcccgggtaccacactcaaaccgcgggaccttggcatcttggcaagttggagctggactttaattattgcgaggggacaacggtggtcatcaccgaaaactgtggaactcgtggcccaagtttacggacaaccactgtttctggtaaactcattcacgagtggtgctgtcgaagctgcacactgccccctcttagatacatgggggaagatggatgttggtatggcatggagatcaggccaatatccgaaaaggaggagaatatggtgaaatcactggtaagcgccggttctggcaaggtggacaacttcaccatgggggtcttgtgcctcgctattctgtttgaagaggtgatgcgcggaaagttcggcaaaaagcatatgatcgccggggttttctttacgttcgtgctactgctctccggacagatcacttggcgggatatggcacacaccctgattatgatcggcagtaatgctagcgacagaatgggtatgggggtcacataccttgccttgattgcaacctttaaaatacagcccttcctggccttaggatttttcctcaggaagctgacttctcgcgaaaaccttctgctaggcgtgggcctcgctatggcgacaaccctgcaattgccggaggatatcgaacagatggccaatgggattgcactgggattaatggctctcaaactgatcacacagtttgagatttatcagctttggactgccctgatctccttgacctgttcaaacacgatattcacactcaccgttgcctggcgaactgctaccctgatcctagcaggtgtgagtctgcttcctatgtgccaaagctcgtccatgcggaagacagactggctcccaatggccgtcgcggctatgggcgtaccccctctgcccttgtttattttctctctgaaggatactttaaaacgtagaagctggccactcaatgagggggtgatggccgttggactggtgtcaatccttgcaagttccctgttgaggaacgacgtccctatggccggccccctcgtggctggtgggctgctaattgcatgttacgtaatcaccggaacgtctgccgatctgacagtggaaaaggcggctgacataacctgggaggaagaggccgaacagactggcgtcagccataaccttatgattacagttgacgatgacggcaccatgcgcatcaaagatgacgagactgagaatatcctcacagtgctgttgaagaccgcattactgattgtgtccgggatatttccatattcaatcccggccacgctcctggtctggcacacttggcagaaacagacccaacggagcggagtgctttgggatgttcctagtcccccagaaacacagaaggctgagctggaagagggtgtatacagaattaaacagcagggcatcttcgggaagacccaagtgggagtcggcgtgcagaaggagggtgtttttcacacaatgtggcatgtgactaggggggccgtcttgacctacaacggaaaacgactagaacccaattgggcatctgtgaagaaagacctgatttcctatggcggcgggtggcgcctcagcgctcagtggcaaaagggagaggaagtacaggtcatcgccgtggagcctggtaaaaacccaaagaatttccagacgatgcccggcacattccagactaccacaggggaaataggagcgatcgccctggattttaagcctggcacctcgggttcaccgattatcaaccgggaggggaaagttgtgggactttacggcaatggcgtcgtgactaagaacgggggatatgtttctggtattgcacaaaccaatgctgagccagacggccccacacctgaattagaggaagagatgttcaaaaagagaaacctgacgatcatggatctccacccagggagtggaaaaactaggaagtacttgcccgccatagtgcgtgaagctattaagcgccggctgagaaccctcatcctggcacctacaagggtcgtggccgccgagatggaggaagctcttaaaggcctgccgatccgatatcagaccactgcgacaaagtccgagcataccggtcgggaaattgtagacttgatgtgccacgcaacgtttactatgcgcctactgagccccgtgagagttccaaattacaacctcatcataatggatgaggcccatttcacagaccctgcttctattgccgcaagggggtatatcagcacccgggtcggaatgggcgaagccgctgcgatttttatgaccgccactcccccaggcacagcagatgctttccctcagtccaatgcccccatccaggacgaggagcgagacataccagaaagatcatggaacagtgggaatgagtggattaccgattttgcaggaaaaacagtgtggttcgtgccgagcatcaaggccggtaacgacatcgctaactgtttacgcaaaaatggcaagaaggtcattcaactgtctaggaaaacttttgatacggaataccagaagaccaaacttaacgactgggatttcgtagtgacaactgacatctccgagatgggggccaattttaaggcggatcgtgttattgaccctcggagatgcctgaaacccgtgatactcaccgatggaccagagagggtcatcttggcaggccccatgcctgtgacagccgcttcagccgctcagcgccgaggtagagttgggcggaacccacagaaggaaaatgaccaatacattttcaccggccagcccctgaacaatgatgaggaccacgcacactggactgaagccaagatgctcctggacaacatcaatacgcctgagggaatcattccggctcttttcgaaccagagagggagaaaagtgccgcaatagatggcgaatatcgcctaaagggggagagccgtaaaacctttgtggaactgatgagacggggagacttgcccgtctggttagcgcataaggtggcctccgagggtatcaaatacacagataggaagtggtgcttcgacggccagcgcaacaatcagattctggaagagaacatggatgtagagatctggactaaagaaggggagaagaagaaactccgacctagatggctggacgctcggacctattctgatccccttgccctgaaggaatttaaagagttcgcagctggaaggaagtcgattgccctcgacttggtgacagaaatcggccgcgttccaagccacctggcacatagaaccaggaatgccctagataacctggtcatgctccacacttcagagcacggtgggcgggcttaccgtcatgcggtggaggaacttcctgagacaatggaaacgctgttattgctgggcctcatgatactgcttaccggaggcgccatgctgtttctcatctccgggaaaggaattggtaagactagtatcggcttgatttgtgtgatcgcatctagcgggatgctgtggatggctgagatacccttacaatggattgcctccgccatcgtcctagagttctttatgatggttctgctcattccagaacctgagaagcagcgcacaccgcaggacaatcaacttgcatatgtggtaatcggaatactgaccttggctgccatcattgcggctaacgaaatgggcctgctcgagaccacaaaacgagatctgggtatgtcaaaggaacccggggtggtctctccaactagctaccttgacgtggatctccaccctgccagtgcatggacgctgtatgccgttgctaccacagtgatcactcccatgttgagacataccattgagaattccacagcaaacgtcagcctggccgcgatcgctaaccaggccgtagtgttaatgggcctagacaaaggatggccaatatctaagatggacctgggcgttcctctccttgcactggggtgctactcacaggtgaatcccttgaccctgactgccgctgtcctcctgcttattacgcactacgccatcatcggaccgggcttacaggcaaaagctacaagggaggcccaaaagcggaccgcggccggtattatgaagaacccaactgtggatgggatcatgaccatagacctggatcctgtcatttatgactccaaattcgaaaagcagctcggacaggtgatgttgctggttctatgtgtggtacagctgctccttatgcgcacaagttgggcactgtgcgaggctttgactctggccaccggccccatcacaacgctctgggaaggtagcccaggcaaattttggaataccactattgcagtgtcgatggctaacatcttcagagggtcttacctggccggagccggcttagcgttttccataatgaagagcgtcgggacaggaaaaaggggcaccggttcacaaggggagactcttggagaaaagtggaagaaaaagctgaatcagctcagtcggaaagatttcgacctatataagaaatctggcatcacagaggttgatcgaaccgaggctaaggaaggtctgaaaagaggcgagattacgcatcacgcagtgtcccgcgggagcgccaagttgcagtggtttgtcgaaaggaacatggtgatccccgagggacgggtaattgacctgggctgtgggcgtggaggctggtcatactattgcgctggtctcaagaaagtgaccgaagttagagggtacacaaagggaggccctggccacgaggagccggtgcccatgagtacttatgggtggaatatcgtcaaacttatgagcggaaaggatgtgttctacctgccacctgaaaaatgtgacaccttgctgtgcgatattggtgagtcctctcccagccctacagtcgaagagtccaggactatccgcgtgctcaagatggttgagccatggttaaagaacaatcagttctgtataaaagtactgaacccctacatgcctaccgtgattgaacatcttgagcggctgcaacgaaagcacggcgggatgctagtcagaaatccactctcaaggaactctacacatgaaatgtattggatcagtaatggaaccggcaacatcgtggcctcggttaatatggtgagccgcctgttgctgaaccggtttactatgattcacagacgtcccacgatagagaaagacgtcgatctcggtgcagggacaaggcacgtgaacgccgaaccggagacccctaatatggacgtaatcggagagcggattaagcgcatcaaagaagagcataactccacttggcactacgacgatgaaaatccatataagacctgggcttaccatggctcttatgaggtgaaggcgacaggctcagccagctccatgattaacggggttgtcaaacttctgacgaagccctgggacgtggtgcctatggtcacccagatggcaatgactgatacaaccccattcggacagcaacgagtttttaaagaaaaggtggacactagaacacccaggagtatgccgggtacccggcgcgtaatgggcatcacagctgagtggttatggagaactctggggaggaataaaaagcctcgattgtgcacccgggaggaattcacgaagaaagtgcgtaccaacgccgcaatgggagccgtctttacagaggaaaatcagtgggattctgctaaggccgcggtggaggacgaagatttctggaaactcgttgacagagagcgcgagctgcacaagctaggcaaatgtggtagctgcgtgtacaacatgatggggaagagggaaaaaaagcttggagagtttggcaaggcaaaaggctcacgggccatatggtatatgtggctgggggctagatacctcgaattcgaggccctgggatttttgaatgaggatcattggttctcccgcgaaaacagttacagcggtgtcgagggcgaagggctgcacaagctcggatatatccttagggacatttctaaaatccccggcggtgcaatgtacgctgatgacactgccgggtgggacacccgaattacagaggatgacctgcacaatgaagagaagatcactcagcagatggatccagagcatcggcaattagctaacgccatatttaaactgacctatcagaataaggtggtaaaggttcagagacctacgcccacaggaaccgtgatggacattatctccaggaaagatcagcgcggctcaggccaagtcgggacttacggattgaacacattcaccaatatggaagcacagctcatccgtcagatggagggtgaaggcgtgctgagcaaggcggacctagagaacccacaccttcccgaaaaaaagattactcagtggctggagaccaaaggggtggagcggctcaagagaatggccatatcgggagatgactgcgtcgttaagcctatcgatgacaggtttgctaacgccctgttggcattaaatgatatgggcaaagtgcgcaaggacattccacaatggcagccgtctaaaggttggcatgattggcagcaggtacccttctgtagtcaccacttccatgaactgatcatgaaggacgggcgaaaactcgtggtcccttgccggccacaagacgagcttattggaagagctaggatctcccagggcgccggctggagcctgaaggaaacagcatgtctagggaaggcctatgcgcagatgtggtcactgatgtactttcaccgcagagatctccggttggcttccaacgccatatgctctgcagtgcccgttcattgggtgcctacgagcaggaccacttggagtatccacgcccatcaccaatggatgacaaccgaggacatgctgactgtctggaatcgtgtgtggattgaagataacccatggatggaggacaaaacacccgtaaccacgtgggagaatgttccttatcttggaaagcgagaagatcagtggtgtggttccctgatcggcctcacaagccgcgctacctgggcccagaacattccgactgcaatccagcaagtgagatctttaattgggaatgaggaattcctggactacatgccatcaatgaaacggtttaggaaggaggaggaaagtgagggagctatatggtga

SEQ ID NO: 15293 - RNA, 9873 nt, synthetic construct
  misc_feature 1..9873: note = derived and/or modified CDS sequence (opt3) from DENV-3__HM631864__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagaaagccgtgcacgctgacatgggatactggatcgagagtcagaagaacggcagctggaaactggaaaaggcctccctaatagaggtaaagacttgcacctggcctaaatctcatacactgtggtcgaatggtgtcctcgaaagcgatatgatcattccaaagtccctggcaggcccgatctcacagcacaaccatagacccgggtatcacactcaaaccgcgggaccttggcaccttggcaaattggagctggactttaattactgcgaggggacaacggtggtgattaccgaaaactgtggaactaggggcccaagtttacgtacaaccactgtctctggtaagctcatccatgagtggtgctgtcggagctgcacactgccccctcttcgatatatgggggaagatggatgttggtacggcatggagataagaccaatttccgaaaaagaggagaatatggttaagtcactggtgagcgccggttctggcaaggtagacaactccaccatgggggtgttgtgcctcgctatcctgttcgaagaggtcatgaggggaaaatttggcaagaaacacatgatcgccggggtgttcttcacgtttgttctactgctcagtggacagattacttggcgcgatatggcacataccctgatcatgattggcagcaatgcttctgaccggatgggtatgggggtgacatatcttgccttgatagcaaccttcaagatccagccctttctggccttaggattctttctcagaaaactgacttccagggaaaaccttctgctaggcgtcggcctcgctatggcgacaaccctgcaattgccggaggatattgaacagatggccaatgggatcgcactgggattaatggctctcaagctgattacacagttcgagacttaccagctttggaccgccctgatctcattgacgtgtagtaacacaatatttaccctcactgtggcctggcgcaccgctacactgatcctagcaggtgttagcctgcttcctgtgtgccaatcgtcctctatgcgaaagactgactggctcccaatggccgtcgcggctatgggcgtaccccctctgcccttgttcatttttagcctgaaagataccttaaagcggcgttcatggccactcaatgagggggtgatggccgttggactggtgagtatccttgcatcctctctgttgagaaacgacgtccctatggccggccccctcgtggctggtgggctgctaattgcatgttatgtaatcacgggaacaagcgccgatctgaccgtggaaaaagcggctgacataacttgggaggaagaggccgaacagacaggcgtctcccacaaccttatgattgcagttgacgatgacggcaccatgaggatcaaggatgacgagactgagaatatcctcacagtgctgttgaaaaccgccttactgattgtgtcagggatattcccatacagcatcccggctacgctcctggtctggcatacttggcagaagcagacccaacgcagtggagtgctttgggatgttccttctcccccagaaacacagaaagccgagctggaagagggtgtataccggattaagcagcagggcatctttgggaagacccaagtgggagtcggcgtgcagaaagagggtgttttccacacaatgtggcacgtgactagaggggcagtcttgacctataacggaaagaggctagaacccaattgggcttccgtgaaaaaggacctgattagctacggcggcgggtggcgactctcggcccagtggcaaaaaggagaggaagtacaggtcatcgcggtggagcctggtaagaacccaaagaattttcagacgatgcccggcacattccagactaccacaggggaaataggagccatcgcactggatttcaaacctggcacctcaggttctccgattatcaaccgcgaggggaaggttgtgggactttatggcaatggcgtcgtgactaaaaacgggggatacgttagtggtattgctcaaaccaatgccgagccagacggccccacacctgaattagaggaagagatgtttaagaaacggaacctgacgatcatggatctccatccagggtccggaaagactagaaagtatttgcccgctatagtgagggaagcaattaaacgtcgcctgcggaccctcatcctggcccctacaagagtcgtggccgctgagatggaggaagcgcttaagggcctgccgatcaggtaccagaccactgcaacaaaaagcgagcacaccggtcgagaaattgtagacttgatgtgccatgccacgttcactatgcggctactgtctcccgtgcgcgttccaaattataacctcatcataatggatgaggctcactttacagaccctgccagcattgcagccagagggtacatctccaccagggtcggaatgggcgaagctgcggccattttcatgaccgcaactcccccaggcacagctgatgcctttcctcagtcaaatgcacccatccaggacgaggagcgggacataccagaacgaagttggaacagcgggaatgagtggattaccgatttcgccggaaagacagtgtggtttgtgccgtctatcaaagctggtaacgacatcgccaactgtttaagaaagaatggcaagaaagtcattcaactgtcccgcaagactttcgatacggaataccagaaaaccaagcttaacgactgggattttgtagtgacaactgacatctcagagatgggggcgaatttcaaagcagatagggttattgaccctcgtcggtgcctgaagcccgtgatactcaccgatggaccagagagagtcatcttggccggccccatgcctgtgacagctgccagtgctgcacagaggcgcggtcgagttgggagaaacccacagaaggaaaatgaccaatatatttttaccggccagcccctgaacaatgatgaggaccatgcccactggactgaagctaaaatgctcctggacaacatcaatacgcctgagggaatcattccggcccttttcgaaccagagcgggagaagagcgcagcgatagatggcgaatacaggctaaaaggggagtcccgcaagaccttcgtggaactgatgcgtagaggagacttgcccgtctggttagcccacaaagtggcttctgagggtatcaagtatacagatcggaaatggtgctttgacggccagaggaacaatcagattctggaagagaacatggatgtagagatctggactaaggaaggggagaagaaaaagctccgccctcgatggctggacgccagaacctactcggatccccttgcactgaaagaattcaaggagtttgctgccggacggaaaagcattgcactcgacttggtgacagaaatcggcagggttccatcacatctggcccaccgcaccagaaatgctctagataacctggtcatgctccatacttccgagcacggtgggagggcgtatcggcacgccgtggaggaacttcctgagacaatggaaacgctgttattgctgggcctcatgatactgcttaccggaggcgcaatgctgttcctcatcagtgggaagggaattggtaagacttctatcggcttgatttgtgtgatcgctagctccgggatgctgtggatggccgagatacccttacaatggattgcctcagcaatcgtcctagagtttttcatgatggttctgctcattccagaacctgagaaacagcgtacaccgcaggacaatcaacttgcttacgtggtaatcggaatactgaccttggccgcggtgatcgctgccaacgaaatgggcctgctcgagaccacaaagcgcgatctgggtatgtctaaagaacccggggtcgtgagcccaactagttatcttgacgttgatctccatcctgcatccgcctggacgctgtacgctgtggcaaccacagtcattactcccatgttgcgacacaccatcgagaatagcacagccaacgtatctctggcggctattgccaaccaggcagtggttttaatgggcctagacaagggatggccaatctcaaaaatggacctgggcgtgcctctccttgccctggggtgctactcccaggtcaatcccttgaccctgactgctgccgtgctcctgcttataacgcattatgcaattatcggaccgggcttacaggctaaggccacaagagaggcgcaaaagaggaccgccgcaggtatcatgaaaaacccaactgtcgatgggattatgaccatcgacctggatcctgtgatatacgacagtaagtttgaaaaacagctcggacaggttatgttgctggtgctatgtgctgtacagctgctccttatgcggacaagctgggccctgtgcgaggcattgactctggctaccggccccattacaacgctctgggaaggttcgccaggcaagttctggaataccactatcgccgtgtctatggccaacatttttcgcgggtcctatctggcgggagctggcttagcattcagcatcatgaaatcagtcgggacaggaaagagaggcaccggtagtcaaggggagactcttggagaaaagtggaaaaagaaactgaatcagctctctaggaaggattttgacctatacaaaaagtccggcataacagaggttgatcggaccgaggccaaagaaggtctgaagcgaggcgagatcacgcaccatgctgtgagcagagggtcagccaagttgcagtggttcgtcgaacgcaacatggtgattcccgagggaagggtaatcgacctgggctgtgggcggggaggctggagttattactgcgcaggtctcaaaaaggtgaccgaagttcgtgggtatacaaaaggaggccctggccacgaggagccggtgcccatgagcacttacgggtggaatattgtcaagcttatgtccggaaaagatgtgttttacctgccacctgaaaagtgtgacaccttgctgtgcgatatcggtgagtctagcccctcccctacagtcgaagagtcaagaactattagggtgctcaagatggttgagccatggttaaaaaacaatcagttctgtatcaaggtactgaacccctatatgcctaccgtgatagaacaccttgagcgcctgcaacggaaacatggcgggatgctagtccgaaatccactctctagaaacagtacacacgaaatgtactggatttcgaatggaaccggcaacatcgtggccagcgttaatatggtgtccaggctgttgctgaaccgcttcactatgacgcatcggagacccacaatcgagaaggacgtcgatctcggtgctgggacccgtcacgtgaacgcggaaccggagactcctaatatggacgtaattggagagaggataaaacggatcaaggaagagcacaactctacctggcattatgacgatgaaaatccatacaagacatgggcctatcacggctcatacgaggtgaaagcaacgggcagcgcttccagtatgattaacggggttgtcaagcttctgaccaaaccctgggacgtggtgcctatggtcactcagatggccatgacagataccactccatttggacagcaacgcgttttcaaggaaaaagtggacacacgaacccccagatctatgccgggtacaaggcgggtaatgggcatcactgcagagtggttatggcgcaccctggggagaaataagaagcctaggttgtgcacgcgagaggaatttaccaaaaaggtgcggacaaacgccgctatgggagccgtcttcactgaggaaaatcagtgggatagcgcgaaagcagccgtggaggacgaagatttttggaagctcgttgaccgtgagagagagctgcataaactaggcaagtgtggttcatgcgtgtataacatgatggggaaacgcgaaaagaagcttggagagttcggcaaagctaagggctccagggccatttggtacatgtggctgggggcacggtacctcgaatttgaggctctgggattcttgaatgaggatcactggtttagtagagaaaacagctattctggtgtcgagggcgaagggctgcataaactcggatacatccttcgcgacatatccaagatccccggcggtgccatgtatgctgatgacaccgccgggtgggacacaaggattactgaggatgacctgcacaatgaagagaaaatcacccagcagatggatccagagcaccgacaattagcaaacgcgattttcaagctgacgtaccagaataaggtggtaaaagttcagcggcctacacccaccggaactgtgatggacatcatatcaagaaaggatcagaggggcagcggccaagtcgggacatatggattgaacacctttactaatatggaagcccagctcattcgccagatggagggtgaaggcgtgctgtcgaaagctgacctagagaacccacatcttcccgaaaagaaaatcacccagtggctggagacaaagggggtggagcgtctcaagcggatggccatctctggagatgactgcgtcgttaaacctattgatgacagattcgcaaacgctctgttggccttaaatgatatgggcaaggtgaggaaagacataccacaatggcagccgagtaagggttggcacgattggcagcaggtacccttttgttcccatcacttccacgaactgatcatgaaagacgggcgcaagctcgtggtcccttgccgaccacaagacgagcttattggacgggcaagaatcagccagggcgccggctggtcactgaaggaaacggcgtgtctagggaaagcttacgcccagatgtggtccctgatgtatttccataggcgcgatctcagattggcatctaacgccatttgcagcgctgtgcccgttcactgggtgcctaccagtcggactacatggtccatccatgcccaccatcaatggatgaccactgacgatatgctgacagtctggaatagggtgtggatagaggacaacccatggatggaagataagacccccgtaacgacatgggagaatgttccttaccttggaaaacgtgaggaccagtggtgtggtagcctgatcggcctcacctctcgagcaacttgggctcagaacattccgaccgccatccagcaagtgcgctcattaattgggaatgaagagtttctggattacatgccaagtatgaagagattccggaaagaagaggagtccgaaggagcgatctggtga

SEQ ID NO: 15294 - RNA, 9873 nt, synthetic construct
  misc_feature 1..9873: note = derived and/or modified CDS sequence (opt3) from DENV-3__HM631859__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcagaattcagggggaactagtatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtacaagaaggggagcagtattggaaaaatgtttgaagctactgcccgcggtgcaagaaggatggccatactgggcgacaccgcttgggatttcgggtctgtgggaggcgttctcaactccctgggtaagatggtgcatcagatctttgggagcgcctatacggcacttttctcgggcgtctcttgggtgatgaaaattggaatcggcgtactgttgacatggatcgggctcaattccaagaacacctcaatgagttttagctgcattgcgataggaatcattactctgtacttaggcgctgtggttcaggccgacatgggttgtgtcatcaattggaaagggaaggagctgaagtgcggatccggcattttcgtgacaaacgaggtgcacacctggactgaacagtataaatttcaagcagattctcccaagcggctagccaccgctatcgccggtgcatgggagaatggcgtctgtgggatacgaagcacaacgcgcatggaaaacctcctgtggaaacagatcgctaatgagcttaactacattttgtgggaaaataacatcaagctgaccgttgtggtgggagacattatcggcgtactcgagcaggggaaaagaactctgacaccacagcctatggagttaaagtattcatggaaaacctggggaaaggccaagatagtcacagcggaaactcaaaacagttccttcattatcgatggccccaataccccagagtgccccagcgtgtctagggcctggaacgtttgggaagtggaggactacggttttggggtcttcacgacaaatatttggctgaaacttcgggaagtgtatacccagttgtgtgaccaccgcctcatgtcagctgcagttaaggatgagagagccgtgcatgctgacatgggatactggatcgagagtcagaaaaacggcagctggaagctggaaaaagcctccctaatagaggtaaagacttgcacctggcctaagtctcacacactgtggtcgaatggtgtcctcgaaagcgatatgatcattccaaaatccctggcaggcccgatctcacagcataaccacaggcccgggtaccacactcaaaccgcgggaccttggcatcttggcaagttggagctggactttaattattgcgaggggacaacggtggtgattaccgaaaactgtggaactcgtggcccaagtttacggacaaccactgtctctggtaaactcatccacgagtggtgctgtcgaagctgcacactgccccctcttagatacatgggggaagatggatgttggtatggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcatatgatcgccggggtgttctttacgttcgttctactgctctccggacagattacttggcgggatatggcacacaccctgatcatgattggcagtaatgctagcgacagaatgggtatgggggtgacataccttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagatctatcagctttggactgccctgatatccttgacctgttcaaacacgatcttcacactcaccgtggcctggcgaactgctaccctgattctagcaggtgttagtctgcttcctatgtgccaaagctcgtccatgcggaagacagactggctcccaatggccgtggcggctatgggcgtcccccctctgcccttgtttatcttctctctgaaggatactttaaaacgtagaagctggccactcaatgagggggtaatggccgtgggactggtttcaattcttgcaagttccctgttgaggaacgacgtgcctatggccggccccctcgtcgctggtgggctgctaatcgcatgttacgtgataaccggaacgtctgccgatctgacagtagaaaaggcggctgacattacctgggaggaagaggccgaacagactggcgtgagccataaccttatgatcacagtcgacgatgacggcaccatgcgcatcaaagatgacgagactgagaatattctcacagttctgttgaagaccgcattactgatagtgtccgggatctttccatattcaattccggccacgctcctggtgtggcacacttggcagaaacagacccaacggagcggagtcctttgggatgtgcctagtcccccagaaacacagaaggctgagctggaagagggtgtttacagaatcaaacagcagggcattttcgggaagacccaagtaggagtgggcgtccagaaggagggtgtgtttcacacaatgtggcatgttactaggggggccgtgttgacctacaacggaaaacgactagaacccaattgggcatctgtcaagaaagacctgatctcctatggcggcgggtggcgcctcagcgctcagtggcaaaagggagaggaagtgcaggtaatagccgtcgagcctggtaaaaacccaaagaatttccagacgatgcccggcacattccagactaccacaggggaaatcggagcgattgccctggattttaagcctggcacctcgggttcaccgatcattaaccgggaggggaaagtggttggactttacggcaatggcgtggtcactaagaacgggggatatgtgtctggtatcgcacaaaccaatgctgagccagacggccccacacctgaattagaggaagagatgttcaaaaagagaaacctgacgataatggatctccacccagggagtggaaaaactaggaagtacttgcccgccattgttcgtgaagctatcaagcgccggctgagaaccctcatcctggcacctacaagggtggtcgccgccgagatggaggaagctcttaaaggcctgccgattcgatatcagaccactgcgacaaagtccgagcataccggtcgggaaatcgtggacttgatgtgccacgcaacgtttactatgcgcctactgagccccgtaagagtgccaaattacaacctcataattatggatgaggcccatttcacagaccctgcttctatcgccgcaagggggtatattagcacccgggttggaatgggcgaagccgctgcgatctttatgaccgccactcccccaggcacagcagatgctttccctcagtccaatgcccccatacaggacgaggagcgagacattccagaaagatcatggaacagtgggaatgagtggatcaccgattttgcaggaaaaacagtctggttcgtgccgagcatcaaggccggtaacgacattgctaactgtttacgcaaaaatggcaagaaggtgatccaactgtctaggaaaacttttgatacggaataccagaagaccaaacttaacgactgggatttcgtcgtaacaactgacatttccgagatgggggccaattttaaggcggatcgtgtgatagaccctcggagatgcctgaaacccgttatcctcaccgatggaccagagagggtgattttggcaggccccatgcctgtcacagccgcttcagccgctcagcgccgaggtagagtggggcggaacccacagaaggaaaatgaccaatacatcttcaccggccagcccctgaacaatgatgaggaccacgcacactggactgaagccaagatgctcctggacaacatcaatacgcctgagggaattataccggctcttttcgaaccagagagggagaaaagtgccgcaatcgatggcgaatatcgcctaaagggggagagccgtaaaacctttgttgaactgatgagacggggagacttgcccgtgtggttagcgcataaggtcgcctccgagggtattaaatacacagataggaagtggtgcttcgacggccagcgcaacaatcagatcctggaagagaacatggatgtggagatttggactaaagaaggggagaagaagaaactccgacctagatggctggacgctcggacctattctgatccccttgccctgaaggaatttaaagagttcgcagctggaaggaagtcgatcgccctcgacttggtaacagaaataggccgcgtgccaagccacctggcacatagaaccaggaatgccctagataacctggttatgctccacacttcagagcacggtgggcgggcttaccgtcatgcggtcgaggaacttcctgagacaatggaaacgctgttattgctgggcctcatgatcctgcttaccggaggcgccatgctgtttctcatttccgggaaaggaatcggtaagactagtattggcttgatctgtgtgatagcatctagcgggatgctgtggatggctgagattcccttacaatggatcgcctccgccattgtgctagagttctttatgatggtcctgctcatcccagaacctgagaagcagcgcacaccgcaggacaatcaacttgcatatgttgtgataggaatcctgaccttggctgccattatcgcggctaacgaaatgggcctgctcgagaccacaaaacgagatctgggtatgtcaaaggaacccggggtagtgtctccaactagctaccttgacgtcgatctccaccctgccagtgcatggacgctgtatgccgtggctaccacagttattactcccatgttgagacataccatcgagaattccacagcaaacgtgagcctggccgcgatagctaaccaggccgtcgtattaatgggcctagacaaaggatggccaatttctaagatggacctgggcgtgcctctccttgcactggggtgctactcacaggttaatcccttgaccctgactgccgctgtgctcctgcttatcacgcactacgccatcattggaccgggcttacaggcaaaagctacaagggaggcccaaaagcggaccgcggccggtatcatgaagaacccaactgtcgatgggataatgaccattgacctggatcctgtgatctatgactccaaattcgaaaagcagctcggacaggtcatgttgctggtgctatgtgttgtgcagctgctccttatgcgcacaagttgggcactgtgcgaggctttgactctggccaccggccccattacaacgctctgggaaggtagcccaggcaaattttggaataccactatcgcagtatcgatggctaacatattcagagggtcttacctggccggagccggcttagcgttttccatcatgaagagcgtggggacaggaaaaaggggcaccggttcacaaggggagactcttggagaaaagtggaagaaaaagctgaatcagctcagtcggaaagatttcgacctatataagaaatctggcattacagaggtcgatcgaaccgaggctaaggaaggtctgaaaagaggcgagatcacgcatcacgcagtttcccgcgggagcgccaagttgcagtggtttgtggaaaggaacatggtcattcccgagggacgggtgatcgacctgggctgtgggcgtggaggctggtcatactattgcgctggtctcaagaaagtaaccgaagtgagagggtacacaaagggaggccctggccacgaggagccggttcccatgagtacttatgggtggaatattgtgaaacttatgagcggaaaggatgtcttctacctgccacctgaaaaatgtgacaccttgctgtgcgatatcggtgagtcctctcccagccctacagtggaagagtccaggactatacgcgtcctcaagatggtggagccatggttaaagaacaatcagttctgtattaaagttctgaacccctacatgcctaccgtaatcgaacatcttgagcggctgcaacgaaagcacggcgggatgctagtgagaaatccactctcaaggaactctacacatgaaatgtattggatcagtaatggaaccggcaacattgtcgcctcggtgaatatggttagccgcctgttgctgaaccggtttactatgacgcacagacgtcccacaatagagaaagacgtggatctcggtgcagggaccaggcacgtcaacgccgaaccggagactcctaatatggacgtgatcggagagcggattaagcgcatcaaagaagagcataactccacctggcactacgacgatgaaaatccatataagacatgggcttaccatggctcttatgaggtaaaggcgacgggctcagccagctccatgattaacggggtggttaaacttctgaccaagccctgggacgtcgtgcctatggtgactcagatggcaatgacagataccactccattcggacagcaacgagtctttaaagaaaaggttgacacaagaacccccaggagtatgccgggtacacggcgcgtgatgggcatcactgctgagtggttatggagaaccctggggaggaataaaaagcctcgattgtgcacgcgggaggaattcaccaagaaagtacgtacaaacgccgcaatgggagccgtgtttactgaggaaaatcagtgggattctgctaaggccgcggtcgaggacgaagatttctggagactcgtggaccgcgagagggagctgcacaaactaggcaagtgtggtagctgcgtttacaacatgatggggaaacgggaaaagaaacttggagagtttggcaaggcaaagggctcaagagccatatggtatatgtggctgggggctcgctacctcgaattcgaggccctgggatttttgaatgaggatcattggttctccagggaaaacagttacagcggtgtggagggcgaagggctgcacaaactcggatatatccttcgagacatttctaagatccccggcggtgcaatgtacgctgatgacaccgccgggtgggacacacggattactgaggatgacctgcacaatgaagagaaaatcacccagcagatggatccagagcatagacaattagctaacgccatatttaagctgacgtatcagaataaagtcgtgaaggtacagaggcctacacccaccggaactgttatggacattatctcccgcaaggatcagcgtggctcaggccaagtggggacatacggattgaacaccttcactaatatggaagcacagctcatccggcagatggagggtgaaggcgtcctgagcaaagcggacctagagaacccacaccttcccgaaaagaaaattacccagtggctggagacaaagggggtggagagactcaaaaggatggccatatcgggagatgactgcgtggtcaagcctatcgatgaccgctttgctaacgccctgttggcattaaatgatatgggcaaggttcgaaaagacattccacaatggcagccgtctaagggttggcatgattggcagcaggtgcccttctgtagtcaccacttccatgaactgatcatgaaagacgggcggaagctcgtagtgccttgcagaccacaagacgagcttattggaagggctcgcatctcccagggcgccggctggagcctgaaagaaacggcatgtctagggaaggcctatgcgcagatgtggtcactgatgtactttcacagacgggatctcaggttggcttccaacgccatatgctctgcagtccccgtgcattgggttcctaccagccgtactacatggagtatccacgcccatcaccaatggatgaccactgaggacatgctgacagtgtggaatcgagtctggattgaagataacccatggatggaggacaagacccccgtgacgacatgggagaatgtaccttatcttggaaaacgcgaagatcagtggtgtggttccctgatcggcctcaccagcagagctacttgggcccagaacattccgaccgcaatccagcaagttcggtctttaattgggaatgaggaattcctggactacatgccatcaatgaagaggtttcgcaaagaggaggaaagtgagggagctatatggtga

SEQ ID NO: 15295 - RNA, 9870 nt, synthetic construct
  misc_feature 1..9870: note = derived and/or modified CDS sequence (opt3) from DENV-3__HM631856__SS-prME
  source 1..9870: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcgtgaattggaaagggaaggagctgaagtgcggatccggcatcttcgtgacaaacgaggtccatacctggactgaacagtacaaatttcaagcagattctcccaagcggctagccaccgctattgccggtgcatgggagaatggcgtttgtgggatccgaagcacaacgcgcatggaaaacctcctgtggaaacagatagctaatgagcttaactatatcttgtgggaaaataacattaagctgaccgtggtggtaggagacatcattggcgtcctcgagcaggggaaaagaactctgacaccacagcctaaggagttaaaatactcatggaagacctggggaaaggccaaaatcgtgacagcggaaactcaaaacagttccttcataattgatggccccaataccccagagtgccccagcgtttctagggcctggaacgtgtgggaagtcgaggactatggttttggggtgttcacgacaaatatctggctgaagcttcgggaagtttacacccagttgtgtgaccaccgcctcatgtcagctgcagtgaaagatgagagagccgtacacgctgacatgggatactggattgagagtcagaagaacggcagctggaaactggaaaaggcctccctaatcgaggtcaagacttgcacctggcctaaatctcatacactgtggtcgaatggtgtgctcgaaagcgatatgataatcccaaagtccctggcaggcccgatttcacagcacaaccataggcccgggtatcacactcaaaccgcgggaccttggcaccttggcaaattggagctggactttaattactgcgaggggacaacggtggtcatcaccgaaaactgtggaactcgtggcccaagtttacggacaaccactgtttctggtaagctcattcatgagtggtgctgtcgaagctgcacactgccccctcttagatatatgggggaagatggatgttggtacggcatggagatcaggccaatatccgaaaaagaggagaatatggtgaagtcactggtaagcgccggttctggcaaggtggacaacttcaccatgggggtcttgtgcctcgctattctgtttgaagaggtgatgcgcggaaaattcggcaagaaacacatgatcgccggggttttctttacgttcgtgctactgctctccggacagatcacttggcgggatatggcacataccctgattatgatcggcagtaatgctagcgacagaatgggtatgggggtcacatatcttgccttgattgcaacctttaagatacagcccttcctggccttaggatttttcctcaggaaactgacttctcgcgaaaaccttctgctaggcgtgggcctcgctatggcgacaaccctgcaattgccggaggatatcgaacagatggccaatgggattgcactgggattaatggctctcaagctgatcacacagtttgagacttaccagctttggaccgccctgatttccttgacgtgttcaaacacaatcttcaccctcactgttgcctggcgaaccgctacactgatactagcaggtgtgagtctgcttcctgtctgccaaagctcgtccatgcggaagactgactggctcccaatggccgtagcggctatgggcgtgccccctctgcccttgtttatcttctctctgaaagataccttaaagcgtagaagctggccactcaatgagggggttatggccgtgggactggtctcaattcttgcaagttccctgttgaggaacgacgtgcctatggccggccccctcgtagctggtgggctgctaatcgcatgttatgtgattacgggaacatctgccgatctgaccgtcgaaaaagcggctgacatcacttgggaggaagaggccgaacagacaggcgttagccacaaccttatgataaccgtggacgatgacggcactatgcgcattaaggatgacgagacagagaatatcctcaccgtgctgttgaaaacggcattactgatcgtctccgggatttttccatactcaataccggccactctcctggtgtggcatacctggcagaagcagacacaacggagcggagttctttgggatgtacctagtcccccagaaacccagaaagctgagctggaagagggtgtgtacagaatcaagcagcagggcattttcgggaagacacaagtcggagtgggcgttcagaaagagggtgtgtttcacactatgtggcacgtcaccaggggggccgtgttgacgtataacggaaagcgactagaacccaattgggcatctgtaaaaaaggacctgatctcctacggcggcgggtggcgcctcagcgctcagtggcaaaaaggagaggaagtccaggtgattgccgttgagcctggtaagaacccaaagaatttccagacaatgcccggcactttccagaccacaaccggggaaatcggagcgatagccctggattttaaacctggcacttcgggttcaccgatcattaaccgggaggggaaggtggtcggactttatggcaatggcgtggttaccaaaaacgggggatacgtgtctggtatcgcacaaacaaatgctgagccagacggccccacgcctgaattagaggaagagatgttcagaaagaggaacctgactattatggatctccatccagggagtggaaaaacccgtaagtatttgcccgccatcgtccgcgaagctataaagcggagactgaggacactcattctggcacctacccgagtggtagccgccgagatggaggaagctcttaaaggcctgccgatccggtaccagactacagcgaccaagtccgagcacacgggtcgcgaaatcgtggacttgatgtgccatgcaacttttacaatgagactactgagccccgttagggtcccaaattataacctcattatcatggatgaggcccacttcaccgaccctgcttctatagccgcacgggggtacattagcacccgagtgggaatgggcgaagccgctgcgatctttatgactgccacacccccaggcaccgcagatgctttccctcagtccaatgcccccattcaggacgaggagagagacatcccagaacgctcatggaacagtgggaatgagtggataacagattttgcaggaaaaactgtgtggttcgtcccgagcattaaggccggtaacgacatcgctaactgtttaaggaaaaatggcaagaaggtaatccaactgtctcgtaaaacgtttgataccgaataccagaagacaaaacttaacgactgggatttcgtggttactaccgacatttccgagatgggggccaattttaaggcggatcgggtgatcgaccctagaaggtgcctgaaacccgtcattctcacagatggaccagagcgcgtgatattggcaggccccatgcctgttaccgccgcttcagccgctcagcgaagaggtcgggtggggaggaacccacagaaggaaaatgaccaatatatcttcactggccagcccctgaacaatgatgaggaccatgcacactggacggaagccaagatgctcctggacaacattaatacccctgagggaatcatcccggctcttttcgaaccagagcgcgagaaaagtgccgcaattgatggcgaataccgtctaaagggggagagcagaaaaacatttgtcgaactgatgcggaggggagacttgcccgtgtggttagcgcacaaggtagcctccgagggtataaaatatactgatcgcaagtggtgcttcgacggccagcgaaacaatcagatcctggaagagaacatggatgtggagatttggaccaaagaaggggagaagaagaaactcagacctcggtggctggacgctaggacatactctgatccccttgccctgaaggaatttaaagagttcgcagctggacgcaagtcgatcgccctcgacttggttaccgaaattggcagagtcccaagccatctggcacacaggactcggaatgccctagataacctggtgatgctccatacatcagagcacggtgggcgtgcttatcgccacgcggtggaggaacttcctgagacgatggaaaccctgttattgctgggcctcatgatcctgcttactggaggcgccatgctgtttctcatatccgggaaaggaatcggtaagacaagtattggcttgatctgtgtcattgcatctagcgggatgctgtggatggctgagatccccttacaatggatagcctccgccattgttctagagttctttatgatggtgctgctcatcccagaacctgagaagcagcgaaccccgcaggacaatcaacttgcatacgtagtgattggaatcctgaccttggctgccataatcgcggctaacgaaatgggcctgctcgagacaactaaaagagatctgggtatgtcaaaggaacccggggtcgtgtctccaacgagctatcttgacgttgatctccatcctgccagtgcatggaccctgtacgccgtggctacaactgtcattacccccatgttgaggcacacaatcgagaattccaccgcaaacgtaagcctggccgcgattgctaaccaggccgtggttttaatgggcctagacaaaggatggccaatctctaagatggacctgggcgtgcctctccttgcactggggtgctactcacaggtcaatcccttgactctgacggccgctgtgctcctgcttataacacattatgccattatcggaccgggcttacaggcaaaagctacccgggaggcccaaaagcgcactgcggccggtatcatgaagaacccaaccgtcgatgggattatgacaatcgacctggatcctgtgatatacgactccaaattcgaaaagcagctcggacaggttatgttgctggtgctatgtgcagtacagctgctccttatgagaactagttgggctctgtgcgaggccttgaccctggcaacaggccccattacgaccctctgggaaggtagcccaggcaaattttggaatactacaatcgctgtgtcgatggccaacattttcagggggtcttatctggccggagcgggcttagctttttccatcatgaagagcgtcgggaccggaaaacggggcactggttcacaaggggagacacttggagaaaagtggaagaaaaagctgaatcagctcagtcgaaaagatttcgacctatacaagaaatctggcataaccgaggttgatagaacggaggcaaaggaaggtctgaaacgcggcgagatcacccaccatgccgtgtccagggggagcgctaagttgcagtggtttgtcgaacggaacatggtgattcccgagggacgtgtaatcgacctgggctgtgggagaggaggctggtcatattactgcgccggtctcaagaaagtgacagaagttagggggtatactaagggaggccctggccacgaggagccggtgcccatgagtacctacgggtggaatattgtcaaacttatgagcggaaaggatgtgttctacctgccacctgaaaaatgtgacacattgctgtgcgatatcggtgagtcctctcccagccctactgtcgaagagtcccgcaccattcgggtgctcaagatggttgagccatggttaaagaacaatcagttctgtatcaaagtactgaacccctatatgcctacagtgatagaacaccttgagcgactgcaaagaaagcatggcgggatgctagtcaggaatccactctcacgcaactctacccacgaaatgtactggattagtaatggaactggcaacatcgtggcatcggttaatatggtgagccggctgttgctgaacagatttacgatgacacatcgtaggcccaccatcgagaaagacgtcgatctcggtgccgggactcggcacgtgaacgctgaaccggagacccctaatatggacgtaattggagagcgcataaagcgaatcaaagaagagcacaactccacatggcattatgacgatgaaaatccatacaagacgtgggcgtatcacggctcttacgaggtgaaggccaccggctcagcaagctccatgattaacggggttgtcaaacttctgactaagccctgggacgtggtgcctatggtcacacagatggctatgaccgatactacaccattcggacagcaaagagtttttaaagaaaaggtggacaccaggacaccccggagtatgccgggtactcgcagagtaatgggcatcaccgccgagtggttatggaggacgctggggcgaaataaacctcggttgtgcacccgtgaggaattcacaaagaaggtgagaactaacgcagccatgggagctgtctttaccgaggaaaatcagtgggattctgccaaagcggcagtggaggacgaagatttctggaagctcgttgaccgcgagagggagctgcataaactaggcaagtgtggtagctgcgtgtataacatgatggggaaacgggaaaagaaacttggagagtttggcaaggccaagggctcaagagctatttggtacatgtggctgggggcccgctacctcgaattcgaggcactgggatttttgaatgaggatcactggttctccagggaaaacagttatagcggtgtcgagggcgaagggctgcataaactcggatacatccttcgagacatatctaagatccccggcggtgctatgtatgccgatgacacagctgggtgggacactcggattaccgaggatgacctgcacaatgaagagaaaatcacgcagcagatggatccagagcacagacaattagccaacgcaatttttaagctgacataccagaataaagtggtaaaggttcagaggcctacccccactggaacagtgatggacatcatatcccgcaaggatcagcgtggctcaggccaagtcgggacctatggattgaacactttcaccaatatggaagcgcagctcattcggcagatggagggtgaaggcgtgctgagcaaagccgacctagagaacccacatcttcccgaaaagaaaatcacacagtggctggagacgaagggggtggagagactcaaaaggatggctatctcgggagatgactgcgtcgttaagcctattgatgaccgctttgccaacgcactgttggctttaaatgatatgggcaaggtgcgaaaagacataccacaatggcagccgtctaagggttggcacgattggcagcaggtacccttctgtagtcatcacttccacgaactgatcatgaaagacgggcggaagctcgtggtcccttgcagaccacaagacgagcttattggaagggcccgcatctcccagggcgcaggctggagcctgaaagaaaccgcctgtctagggaaggcgtacgctcagatgtggtcactgatgtattttcatagacgggatctcaggttggcctccaacgcaatttgctctgccgtgcccgttcactgggtgcctactagccgtacaacctggagtatccatgctcaccatcaatggatgactacagaggacatgctgaccgtctggaatcgagtgtggatagaagataacccatggatggaggacaagacgcccgtaacaacctgggagaatgttccttaccttggaaaacgcgaagatcagtggtgtggttccctgatcggcctcactagcagagccacctgggcacagaacattccgacagctatccagcaagtgcggtctttaattgggaatgaggaattcctggactacatgccatcaatgaagaggtttcgcaaagaggaggaaagtgagggagccatctggtga

SEQ ID NO: 15296 - RNA, 9873 nt, synthetic construct
  misc_feature 1..9873: note = derived and/or modified CDS sequence (opt3) from DENV-3__HM756276__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcgtgaattggaaagggaaggagctgaagtgcggatccggcatcttcgtgacaaacgaggtccatacctggactgaacagtacaaatttcaagcagattctcccaagcggctagccaccgctattgccggtgcatgggagaatggcgtttgtgggatccgaagcacaacgcgcatggaaaacctcctgtggaaacagatagctaatgagcttaactatatcttgtgggaaaataacattaagctgaccgtggtggtaggagacatcattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgtttctagggcctggaacgtgtgggaagtcgaggactatggttttggggtgttcacgacaaatatctggctgaaacttcgggaagtttacacccagttgtgtgaccaccgcctcatgtcagctgcagtgaaggatgagagagccgtacacgctgacatgggatactggattgagagtcagaaaaacggcagctggaagctggaaaaagcctccctaatcgaggtcaagacttgcacctggcctaagtctcatacactgtggtcgaatggtgtgctcgaaagcgatatgataatcccaaaatccctggcaggcccgatttcacagcacaaccataggcccgggtatcacactcaaaccgcgggaccttggcaccttggcaagttggagctggactttaattactgcgaggggacaacggtggtcatcaccgaaaactgtggaactcgtggcccaagtttacggacaaccactgtttctggtaaactcattcatgagtggtgctgtcgaagctgcacactgccccctcttagatatatgggggaagatggatgttggtacggcatggagatcaggccaatatccgaaaaggaggagaatatggtgaaatcactggtaagcgccggttctggcaaggtggacaacttcaccatgggggtcttgtgcctcgctattctgtttgaagaggtgatgcgcggaaagttcggcaaaaagcacatgatcgccggggttttctttacgttcgtgctactgctctccggacagatcacttggcgggatatggcacataccctgattatgatcggcagtaatgctagcgacagaatgggtatgggggtcacatatcttgccttgattgcaacctttaaaatacagcccttcctggccttaggatttttcctcaggaagctgacttctcgcgaaaaccttctgctaggcgtgggcctcgctatggcgacaaccctgcaattgccggaggatatcgaacagatggccaatgggattgcactgggattaatggctctcaaactgatcacacagtttgagacttaccagctttggaccgccctgatttccttgacgtgttcaaacacaatcttcaccctcactgttgcctggcgaaccgctacactgatactagcaggtgtgagtctgcttcctgtctgccaaagctcgtccatgcggaagactgactggctcccaatggccgtagcggctatgggcgtgccccctctgcccttgtttatcttctctctgaaggataccttaaaacgtagaagctggccactcaatgagggggttatggccgtgggactggtctcaattcttgcaagttccctgttgaggaacgacgtgcctatggccggccccctcgtagctggtgggctgctaatcgcatgttatgtgattacgggaacatctgccgatctgaccgtcgaaaaggcggctgacatcacttgggaggaagaggccgaacagacaggcgttagccacaaccttatgataaccgtggacgatgacggcactatgcgcattaaagatgacgagacagagaatatcctcaccgtgctgttgaagacggcattactgatcgtctccgggatttttccatactcaataccggccactctcctggtgtggcatacctggcagaaacagacacaacggagcggagttctttgggatgtacctagtcccccagaaacccagaaggctgagctggaagagggtgtgtacagaatcaaacagcagggcattttcgggaagacacaagtcggagtgggcgttcagaaggagggtgtgtttcacactatgtggcacgtcaccaggggggccgtgttgacgtataacggaaaacgactagaacccaattgggcatctgtaaagaaagacctgatctcctacggcggcgggtggcgcctcagcgctcagtggcaaaagggagaggaagtccaggtgattgccgttgagcctggtaaaaacccaaagaatttccagacaatgcccggcactttccagaccacaaccggggaaatcggagcgatagccctggattttaagcctggcacttcgggttcaccgatcattaaccgggaggggaaagtggtcggactttatggcaatggcgtggttaccaagaacgggggatacgtgtctggtatcgcacaaacaaatgctgagccagacggccccacgcctgaattagaggaagagatgttcaaaaagagaaacctgactattatggatctccatccagggagtggaaaaaccaggaagtatttgcccgccatcgtccgtgaagctataaagcgccggctgagaacactcattctggcacctaccagggtggtagccgccgagatggaggaagctcttaaaggcctgccgatccgataccagactacagcgaccaagtccgagcacacgggtcgggaaatcgtggacttgatgtgccatgcaacttttacaatgcgcctactgagccccgttagagtcccaaattataacctcattatcatggatgaggcccacttcaccgaccctgcttctatagccgcaagggggtacattagcacccgggtgggaatgggcgaagccgctgcgatctttatgactgccacacccccaggcaccgcagatgctttccctcagtccaatgcccccattcaggacgaggagcgagacatcccagaaagatcatggaacagtgggaatgagtggataacagattttgcaggaaaaactgtgtggttcgtcccgagcattaaggccggtaacgacatcgctaactgtttacgcaaaaatggcaagaaggtaatccaactgtctaggaaaacgtttgataccgaataccagaagacaaaacttaacgactgggatttcgtggttactaccgacatttccgagatgggggccaattttaaggcggatcgtgtgatcgaccctcggagatgcctgaaacccgtcattctcacagatggaccagagagggtgatattggcaggccccatgcctgttaccgccgcttcagccgctcagcgccgaggtagagtggggcggaacccacagaaggaaaatgaccaatatatcttcactggccagcccctgaacaatgatgaggaccatgcacactggacggaagccaagatgctcctggacaacattaatacccctgagggaatcatcccggctcttttcgaaccagagagggagaaaagtgccgcaattgatggcgaataccgcctaaagggggagagccgtaaaacatttgtcgaactgatgagacggggagacttgcccgtgtggttagcgcacaaggtagcctccgagggtataaaatatactgataggaagtggtgcttcgacggccagcgcaacaatcagatcctggaagagaacatggatgtggagatttggaccaaagaaggggagaagaagaaactccgacctagatggctggacgctcggacatactctgatccccttgccctgaaggaatttaaagagttcgcagctggaaggaagtcgatcgccctcgacttggttaccgaaattggccgcgtcccaagccatctggcacacagaactaggaatgccctagataacctggtgatgctccatacatcagagcacggtgggcgggcttatcgtcacgcggtggaggaacttcctgagacgatggaaaccctgttattgctgggcctcatgatcctgcttactggaggcgccatgctgtttctcatatccgggaaaggaatcggtaagacaagtattggcttgatctgtgtcattgcatctagcgggatgctgtggatggctgagatccccttacaatggatagcctccgccattgttctagagttctttatgatggtgctgctcatcccagaacctgagaagcagcgcaccccgcaggacaatcaacttgcatacgtagtgattggaatcctgaccttggctgccataatcgcggctaacgaaatgggcctgctcgagacaactaaacgagatctgggtatgtcaaaggaacccggggtcgtgtctccaacgagctatcttgacgttgatctccatcctgccagtgcatggaccctgtacgccgtggctacaactgtcattacccccatgttgagacacacaatcgagaattccaccgcaaacgtaagcctggccgcgattgctaaccaggccgtggttttaatgggcctagacaaaggatggccaatctctaagatggacctgggcgtgcctctccttgcactggggtgctactcacaggtcaatcccttgactctgacggccgctgtgctcctgcttataacacattatgccattatcggaccgggcttacaggcaaaagctaccagggaggcccaaaagcggactgcggccggtatcatgaagaacccaaccgtcgatgggattatgacaatcgacctggatcctgtgatatacgactccaaattcgaaaagcagctcggacaggttatgttgctggtgctatgtgcagtacagctgctccttatgcgcactagttgggctctgtgcgaggccttgaccctggcaacaggccccattacgaccctctgggaaggtagcccaggcaaattttggaatactacaatcgctgtgtcgatggccaacattttcagagggtcttatctggccggagcgggcttagctttttccatcatgaagagcgtcgggaccggaaaaaggggcactggttcacaaggggagacacttggagaaaagtggaagaaaaagctgaatcagctcagtcggaaagatttcgacctatacaagaaatctggcataaccgaggttgatcgaacggaggcaaaggaaggtctgaaaagaggcgagatcacccaccatgccgtgtcccgcgggagcgctaagttgcagtggtttgtcgaaaggaacatggtgattcccgagggacgggtaatcgacctgggctgtgggcgtggaggctggtcatattactgcgccggtctcaagaaagtgacagaagttagagggtatactaagggaggccctggccacgaggagccggtgcccatgagtacctacgggtggaatattgtcaaacttatgagcggaaaggatgtgttctacctgccacctgaaaaatgtgacacattgctgtgcgatatcggtgagtcctctcccagccctactgtcgaagagtccaggaccattcgcgtgctcaagatggttgagccatggttaaagaacaatcagttctgtatcaaagtactgaacccctatatgcctacagtgatagaacaccttgagcggctgcaacgaaagcatggcgggatgctagtcagaaatccactctcaaggaactctacccacgaaatgtactggattagtaatggaactggcaacatcgtggcatcggttaatatggtgagccgcctgttgctgaaccggtttacgatgacacatagacgtcccaccatcgagaaagacgtcgatctcggtgccgggactaggcacgtgaacgctgaaccggagacccctaatatggacgtaattggagagcggataaagcgcatcaaagaagagcacaactccacatggcattatgacgatgaaaatccatacaagacgtgggcgtatcacggctcttacgaggtgaaggccaccggctcagcaagctccatgattaacggggttgtcaaacttctgactaagccctgggacgtggtgcctatggtcacacagatggctatgaccgatactacaccattcggacagcaacgagtttttaaagaaaaggtggacaccagaacacccaggagtatgccgggtactcggcgcgtaatgggcatcaccgccgagtggttatggagaacgctggggaggaataaaaagcctcgattgtgcacccgggaggaattcacaaagaaagtgcgtactaacgcagccatgggagctgtctttaccgaggaaaatcagtgggattctgccaaggcggcagtggaggacgaagatttctggaaactcgttgacagagagcgcgagctgcataagctaggcaaatgtggtagctgcgtgtataacatgatggggaagagggaaaaaaagcttggagagtttggcaaggccaaaggctcacgggctatttggtacatgtggctgggggccagatacctcgaattcgaggcactgggatttttgaatgaggatcactggttctcccgcgaaaacagttatagcggtgtcgagggcgaagggctgcataagctcggatacatccttagggacatatctaaaatccccggcggtgctatgtatgccgatgacacagctgggtgggacactcgaattaccgaggatgacctgcacaatgaagagaagatcacgcagcagatggatccagagcaccggcaattagccaacgcaatttttaaactgacataccagaataaggtggtaaaggttcagagacctacccccactggaacagtgatggacatcatatccaggaaagatcagcgcggctcaggccaagtcgggacctatggattgaacactttcaccaatatggaagcgcagctcattcgtcagatggagggtgaaggcgtgctgagcaaggccgacctagagaacccacatcttcccgaaaaaaagatcacacagtggctggagacgaaaggggtggagcggctcaagagaatggctatctcgggagatgactgcgtcgttaagcctattgatgacaggtttgccaacgcactgttggctttaaatgatatgggcaaagtgcgcaaggacataccacaatggcagccgtctaaaggttggcacgattggcagcaggtacccttctgtagtcatcacttccacgaactgatcatgaaggacgggcgaaaactcgtggtcccttgccggccacaagacgagcttattggaagagccaggatctcccagggcgcaggctggagcctgaaggaaaccgcctgtctagggaaggcgtacgctcagatgtggtcactgatgtattttcatcgcagagatctccggttggcctccaacgcaatttgctctgccgtgcccgttcactgggtgcctactagcaggacaacctggagtatccatgctcaccatcaatggatgactacagaggacatgctgaccgtctggaatcgtgtgtggatagaagataacccatggatggaggacaaaacgcccgtaacaacctgggagaatgttccttaccttggaaagcgagaagatcagtggtgtggttccctgatcggcctcactagccgcgccacctgggcacagaacattccgacagctatccagcaagtgagatctttaattgggaatgaggaattcctggactacatgccatcaatgaaacggtttaggaaggaggaggaaagtgagggagccatctggtga

SEQ ID NO: 15297 - RNA, 9873 nt, synthetic construct
  misc_feature 1..9873: note = derived and/or modified CDS sequence (opt3) from DENV-3__HM756279__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatactgtcatcggaatcggcgataacgccttgaaaattaattggtataagaaggggagcagtatcggaaaaatgtttgaagctaccgcccgcggtgcaagaaggatggccattctgggcgacacggcttgggatttcgggtctgtgggaggcgttctcaactccctgggtaagatggtgcaccagatatttgggagcgcctacacagcacttttctcgggcgtctcttgggtgatgaaaatcggaattggcgtactgttgacctggatcgggctcaattccaagaacacttcaatgagttttagctgcatcgcgattggaataatcacactgtatttaggcgctgtggttcaggccgacatgggttgtgtcattaattggaaagggaaggagctgaagtgcggatccggcatcttcgtgaccaacgaggtgcatacttggaccgaacagtacaaatttcaagcagattctcccaagcggctagccacagctattgccggtgcatgggagaatggcgtctgtgggatccgaagcacgacccgcatggaaaacctcctgtggaaacagatagctaatgagcttaactatatcttgtgggaaaataacattaagctgactgttgtggtgggagacatcattggcgtactcgagcaggggaaaagaacactgaccccacagcctatggagttaaagtactcatggaaaacatggggaaaggccaagatcgtcactgcggaaacccaaaacagttccttcataattgatggccccaatacgccagagtgccccagcgtgtctagggcctggaacgtttgggaagtggaggactatggttttggggtcttcacaaccaatatctggctgaaacttcgggaagtgtacactcagttgtgtgaccaccgcctcatgtcagctgcagttaaggatgagagagccgtgcacgctgacatgggatactggattgagagtcagaaaaacggcagctggaagctggaaaaagcctccctaatcgaggtaaagacctgcacatggcctaagtctcatactctgtggtcgaatggtgtcctcgaaagcgatatgataatcccaaaatccctggcaggcccgatttcacagcacaaccataggcccgggtatcacacccaaacagcgggaccttggcaccttggcaagttggagctggactttaattactgcgaggggacgaccgtggtgatcactgaaaactgtggaacacgtggcccaagtttacggaccactacagtctctggtaaactcattcatgagtggtgctgtcgaagctgcaccctgccccctcttagatatatgggggaagatggatgttggtacggcatggagatcaggccaatatccgaaaaggaggagaatatggttaaatcactggtgagcgccggttctggcaaggtagacaacttcacgatgggggtgttgtgcctcgctattctgtttgaagaggtcatgcgcggaaagttcggcaaaaagcacatgatcgccggggtgttctttactttcgttctactgctctccggacagatcacctggcgggatatggcacatacactgattatgatcggcagtaatgctagcgacagaatgggtatgggggtgacctatcttgccttgattgcaacttttaaaatacagcccttcctggccttaggatttttcctcaggaagctgacatctcgcgaaaaccttctgctaggcgtcggcctcgctatggcgaccacactgcaattgccggaggatatcgaacagatggccaatgggattgcactgggattaatggctctcaaactgatcactcagtttgagacctaccagctttggacggccctgatttccttgacatgttcaaacaccatcttcactctcaccgtggcctggcgaacagctactctgatactagcaggtgttagtctgcttcctgtgtgccaaagctcgtccatgcggaagaccgactggctcccaatggccgtcgcggctatgggcgtaccccctctgcccttgtttatcttcgggctgaaggatacgttaaaacgtagatcttggccactcaatgagggagtgatggccgttggcctggtgagcattcttgcatcaagtctgttgaggaacgacgtccctatggccggtcccctcgtggctgggggactgctaatcgcatgttatgtaattacaggcacctccgccgatctgactgtggaaaaggcggctgacatcacatgggaggaagaggccgaacagaccggcgtctctcacaaccttatgataactgttgacgatgacgggacaatgcgcattaaagatgacgagaccgagaatatcctcacggtgctgttgaagactgcattactgatcgtgagcggaatttttccatactccataccggccaccctcctggtctggcatacatggcagaaacagacccaacggtcaggtgtgctttgggatgttcctagccccccagaaacacagaaggctgagctggaagagggcgtatacagaatcaaacagcaggggaacttctgggagactcaagtgggagtcggcgtgcagaaggaaggtgtttttcacaccatgtggcacgtgacgaggggggccgtcttgacatataatggaaagcgactagagcccaactgggcaagtgtgaaaaaggacctgatttcttacggcggcgggtggcgcctctccgctcagtggcaaaaaggagaagaggtacaggtcatcgccgtggaacctggtaagaatccaaaaaacttccagactatgcccggcaccttccagacaaccactggggagattggagcgatcgccctggattttaagcctggcaccagcggttcgccgataatcaatcgggaggggaaggttgtgggactttatggcaacggcgtcgtgacaaaaaatgggggatacgtttcaggtattgcacaaacgaacgctgaaccagacggccccactcctgagttagaagaggaaatgttcaagaaaagaaatctgaccatcatggatctccatccagggtctggaaagacaaggaaatatttgcccgccattgtgcgtgaggctatcaagcgccggctgagaaccctcatactggcacctactagggtcgtggccgccgagatggaagaggctcttaagggcctgccgattcgataccagacaaccgcgacgaaaagtgaacacactggtcgggagatcgtagacttgatgtgccatgcaacatttaccatgcgcctactgtcccccgtgagagttccaaactataatctcatcattatggatgaagcccacttcaccgaccctgctagcatcgccgcaagggggtacatatctactcgggtcggaatgggcgaggccgctgcgatttttatgacagccacccccccaggcacagcagatgctttccctcagagcaacgcccccatccaggacgaggaacgagacattccagagagatcctggaattcagggaacgaatggatcactgattttgcaggaaagacggtgtggttcgtgccgagtataaaagccggtaacgacattgctaattgtttacgcaagaacggcaaaaaggtcatccaactgagcaggaagacctttgatacagagtaccagaaaactaagcttaatgactgggatttcgtagtgaccacagacatctctgagatgggggccaactttaaagcggatcgtgttattgaccctcggagatgcctgaagcccgtgatcctcaccgatggaccagaaagggtcattttggcaggccccatgcctgtgactgccgcttccgccgctcagcgccgaggtagagttgggcggaatccacagaaagagaacgaccaatatatattcacgggccagcccctgaataacgatgaagaccatgcacactggaccgaggccaagatgctcctggacaatatcaacacacctgaaggaattatcccggctcttttcgagccagagagggaaaagtcagccgcaatcgatggcgagtaccgcctaaaaggggaaagtcgtaagacttttgtggagctgatgagacggggagacttgaccgtctggttagcgcacaaagtggccagcgaaggtattaagtatacagataggaaatggtgcttcgacggccagcgcaataaccagatactggaggagaatatggatgtagaaatctggaccaaggagggggaaaaaaagaagctccgacccagatggctggacgctcggacttactccgatcctcttgccctgaaagagtttaaggaattcgcagctggaaggaaatctattgccctcgacttggtgacagagatcggccgcgttccctcgcatctggcacacagaacgaggaacgccctagataatctggtcatgctccataccagcgagcacggtgggcgggcttatcgtcacgcggtggaagagcttccagaaactatggagacactgttattgctgggcctcatgattctgcttaccggaggcgccatgctgtttctcatctcagggaagggaataggtaaaacctccatcggcttgatttgtgtgatcgcaagttctgggatgctgtggatggctgagattcctttacaatggatcgccagcgccatagtcctagaattctttatgatggttctgctcattcccgagccagaaaagcagcgcacacctcaggacaaccaacttgcatacgtggtaatcggaattctgactttggctgccatcatagcggctaatgagatgggcctgctcgaaacgaccaagcgagatctgggtatgtccaaagagccgggggtggtctcacccacatcttatcttgacgtggatctccatccagccagcgcatggactctgtacgccgttgctaccacagtgatcacccctatgttgagacacactattgagaacagtacggcaaacgtctccctggccgcgatcgctaatcaggccgtagtgttaatgggcctagacaagggatggcccattagcaaaatggacctgggcgttccactccttgcactggggtgctactctcaggtgaaccctttgacactgaccgccgctgtcctcctgcttatcactcattatgccataattggacccggcttacaggcaaaggctaccagggaagcccaaaaacggacagcggccggtatcatgaagaatccgactgtggatgggatcatgaccattgacctggatccagtcatctacgactcaaagttcgagaaacagctcggacaggtgatgttgctggttctatgtgcagtgcagctgctccttatgcgcacatcctgggctctgtgcgaagccttgacgctggcaaccggccctataactacactctgggagggtagtcccggcaagttttggaacaccactattgctgtaagcatggccaatatcttcagagggtcgtatctggccggagcgggcttagctttttctattatgaaatccgtggggacaggaaagaggggcaccggtagccaaggggaaacgcttggagagaaatggaagaagaaactgaaccagctctcacggaaggatttcgacctatacaaaaagagtggcatcaccgaggtcgatcgaacagaagcaaaagagggtctgaagagaggcgaaataactcaccatgccgtttctcgcgggtccgctaaattgcagtggtttgtggagaggaatatggtcatcccagaaggacgggtgattgacctgggctgtgggcgtggaggctggagctattactgcgccggtctcaagaaggtaaccgaggtgagagggtatacaaaaggaggccccggccacgaggaacctgttccgatgtcaacttacgggtggaacatcgtgaagcttatgagtggaaaagatgtcttctacctgcccccagagaagtgtgacaccttgctgtgcgatattggtgaaagctccccttctcccacagtggaggagagcaggaccatccgcgtcctcaaaatggtggaaccttggttaaagaataaccagttctgtattaaggttctgaatccatatatgcccactgtaatcgagcaccttgaacggctgcaacgaaaacatggcgggatgctagtgagaaaccctctctccaggaattcaacgcacgagatgtactggatatctaacggaacaggcaatattgtcgcaagtgtgaacatggtttcgcgcctgttgctgaaccggtttaccatgactcatagacgtccaaccatcgaaaaggacgtggatctcggtgccgggacaaggcacgtcaatgctgagcccgagacgccgaacatggacgtgatcggagaacggattaaacgcataaaggaggaacacaatagcacctggcattatgacgatgagaacccttacaaaacttgggcgtatcacggctcctacgaagtaaaggccacaggctctgcatcaagcatgatcaatggggtggttaagcttctgaccaaaccatgggacgtcgtgcccatggtgactcagatggctatgacagataccacacctttcggacagcaacgagtctttaaggagaaagttgacactagaaccccaaggtccatgcccggtacgcggcgcgtgatgggcattaccgccgagtggttatggagaacactggggaggaacaagaaaccgcgattgtgcactcgggaagagttcaccaagaaggtacgtacaaatgcagccatgggagctgtgtttactgaagagaaccagtgggatagtgccaaagcggcagtcgaagacgaggatttctggaagctcgtggacagagagcgcgaactgcataaactaggcaagtgtggttcttgcgtttataatatgatggggaaaagggagaagaaacttggagaatttggcaaggccaagggcagccgggctatctggtacatgtggctgggggccagatacctcgagttcgaggcactgggatttttgaacgaagatcactggttctcacgcgagaattcctatagtggtgtggaaggcgaggggctgcataaactcggatacattcttagggacatcagcaagatacctggcggtgctatgtatgccgatgacaccgctgggtgggacacgcgaatcacagaagatgacctgcacaacgaggagaaaattacccagcagatggatcccgaacaccggcaattagccaatgcaatctttaagctgacttaccagaacaaagtcgtgaaggtacagagaccaacacctaccggaactgttatggacattatctctaggaaggatcagcgcggctccggccaagtggggacctatggattgaatacattcacgaacatggaggcgcagctcatacgtcagatggaaggtgagggcgtcctgtcaaaagccgacctagaaaacccccatcttccagagaagaaaattacccagtggctggagactaagggggtggaacggctcaaaagaatggctatcagcggagatgactgcgtggtcaagcccatcgatgacaggtttgccaatgcactgttggctttaaacgatatgggcaaggttcgcaaagacattcctcaatggcagccatcgaagggttggcacgattggcagcaggtgccgttctgttctcatcacttccacgagctgataatgaaagacgggcgaaagctcgtagtgccctgccggcctcaagacgaacttatcggaagagccaggattagtcagggcgcaggctggtccctgaaagagacagcctgtctagggaaggcgtacgctcagatgtggagcctgatgtattttcatcgcagagatctccggttggcctcaaatgcaatctgctccgccgtcccagtgcactgggttcccacctctaggactacatggagcattcatgctcaccatcaatggatgaccacggaagacatgctgacagtgtggaaccgtgtctggatcgaggataatccttggatggaggacaagaccccagtgactacctgggaaaacgtaccctaccttggaaaacgagaggatcagtggtgtggtagtctgataggcctcacatcccgcgccacttgggcacagaatatccctaccgctattcagcaagttagaagcttaatcgggaacgaagagttcctggactacatgccgtctatgaagcggtttaggaaagaggaagagtcagaaggagccatttggtga

SEQ ID NO: 15298 - RNA, 9873 nt, synthetic construct
  misc_feature 1..9873: note = derived and/or modified CDS sequence (opt3) from DENV-3__HQ891025__SS-prME
  source 1..9873: mol_type = other RNA
accagcctgtgcctcatgatgatccttcccgcagctctggcattccacttgacatccagagacggcgaacctagaatgattgtggggaagaacgaacggggtaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagcatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgactaagaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagccggtgttagtctgcttcctgtgtgccaaagctcgtccatgcggaagactgactggctcccaatggccgtcgcggctatgggcgtaccccctctgcccttgtttattttcgggctgaaggataccttaaaacgtagatcttggccactcaatgagggagtgatggccgttggcctggtgagcatccttgcatcaagtctgttgaggaacgacgtccctatggccggtcccctcgtggctgggggactgctaattgcatgttatgtaatcacgggcacatccgccgatctgaccgtggaaaaggcggctgacataacttgggaggaagaggccgaacagacaggcgtctctcacaaccttatgattaccgttgacgatgacgggactatgcgcatcaaagatgacgagacagagaatatcctcaccgtgctgttgaagacggcattactgattgtgagcggaatatttccatactccatcccggccactctcctggtctggcatacctggcagaaacagacacaacggtcaggtgtgctttgggatgttcctagtcccccagaaacccagaaggctgagctggaagagggcgtatacagaattaaacagcaggggatcttcggaaagacacaagtgggcgtcggtgtgcagaaggagggggtttttcacactatgtggcacgtgaccaggggagccgtcttgacgtataacggcaaacgactagaacccaattgggcaagtgtgaagaaagacctgatttcttacggcgggggatggcgcctctccgctcagtggcaaaagggtgaggaagtacaggtcatcgccgtggagcctggcaaaaacccaaagaatttccagacaatgcccgggactttccagaccacaaccggagaaataggcgcgatcgccctggattttaagcctggtactagcgggtcgccgattatcaaccgggagggaaaagttgtgggcctttatggcaatggggtcgtgaccaagaacggaggttacgtttcaggcattgcacaaacaaatgctgagccagacgggcccacgcctgaattagaggaagagatgttcaaaaagagaaacctgactatcatggatctccatccaggatctggcaaaaccaggaagtatttgcccgccatagtgcgtgaagctattaagcgccggctgagaacactcatcctggcacctaccagggtcgtggccgccgagatggaggaagctcttaaaggtctgccgatccgataccagactacagcgaccaagagtgagcacacggggcgggaaattgtagacttgatgtgccatgcaacttttacaatgcgcctactgtcccccgtgagagttccaaattataacctcatcataatggatgaggcccacttcaccgaccctgctagcattgccgcaaggggatacatctctacccgggtcggcatgggcgaagccgctgcgatttttatgactgccacacccccagggaccgcagatgctttccctcagagcaatgcccccatccaggacgaggagcgagacataccagaaagatcctggaactcaggaaatgagtggattacagattttgcaggtaaaactgtgtggttcgtgccgagtatcaaggccggcaacgacatcgctaactgtttacgcaaaaatgggaagaaggtcattcaactgagcaggaaaacgtttgataccgaataccagaagacaaaacttaacgactgggatttcgtagtgactaccgacatctctgagatgggagccaattttaaggcggatcgtgttattgaccctcggagatgcctgaaacccgtgatactcacagatggcccagagagggtcatcttggcaggtcccatgcctgtgaccgccgcttccgccgctcagcgccgagggagagttggccggaacccacagaaggaaaatgaccaatatattttcactggacagcccctgaacaatgatgaggaccatgcacactggacggaagccaagatgctcctggacaacatcaatacccctgagggcatcattccggctcttttcgaaccagagagggagaaatcagccgcaatagatggggaataccgcctaaagggagagagtcgtaaaacatttgtggaactgatgagacggggtgacttgcccgtctggttagcgcacaaggtggccagcgagggcatcaaatatactgataggaagtggtgcttcgacgggcagcgcaacaatcagattctggaagagaacatggatgtagagatctggaccaaagaaggagagaagaagaaactccgacctagatggctggacgctcggacatactccgatccccttgccctgaaggaatttaaagagttcgcagctggcaggaagtctattgccctcgacttggtgaccgaaatcggtcgcgttccatcgcatctggcacacagaactaggaatgccctagataacctggtcatgctccatacaagcgagcacgggggccgggcttatcgtcacgcggtggaggaacttcctgagacgatggaaaccctgttattgctgggactcatgatactgcttactggcggggccatgctgtttctcatctcaggaaaaggtattggcaagacatccatcgggttgatttgtgtgatcgcaagttctggaatgctgtggatggctgagatacccttacaatggattgccagcgccatcgtcctagagttctttatgatggttctgctcattccagaacctgagaagcagcgcaccccgcaggacaatcaacttgcatacgtggtaatcggcatactgaccttggctgccatcattgcggctaacgaaatgggtctgctcgagacaactaaacgagatctggggatgtccaaggaacccggcgtggtctcaccaacgtcttatcttgacgtggatctccatcctgccagcgcatggaccctgtacgccgttgctacaactgtgatcacccccatgttgagacacacaattgagaatagtaccgcaaacgtctccctggccgcgatcgctaaccaggccgtagtgttaatgggactagacaaaggctggccaataagcaagatggacctgggggttcctctccttgcactgggatgctactctcaggtgaatcccttgactctgacggccgctgtcctcctgcttattacacattatgccatcatcggcccgggtttacaggcaaaagctaccagggaggcccaaaagcggactgcggccgggattatgaagaacccaaccgtggatggaatcatgacaatagacctggatcctgtcatttacgactcaaaattcgaaaagcagctcggccaggtgatgttgctggttctatgtgcagtgcagctgctccttatgcgcacttcctgggctctgtgcgaggccttgaccctggcaacaggtcccatcacgaccctctgggaaggcagtccagggaaattttggaatactacaattgctgtaagcatggccaacatcttcagaggatcgtatctggccggcgcggggttagctttttctataatgaagtccgtgggaaccggcaaaaggggtactgggagccaaggagagacacttggcgaaaagtggaagaaaaagctgaatcagctctcacggaaagatttcgacctatacaagaaaagtggtatcaccgaggtcgatcgaacggaggcaaaggaaggcctgaaaagaggggagattacccaccatgccgtttctcgcggatccgctaagttgcagtggtttgtggaaaggaacatggtcatccccgagggccgggtgattgacctggggtgtggacgtggcggttggagctattactgcgccgggctcaagaaagtaacagaagtgagaggatatactaagggcggccctgggcacgaggagccggttcccatgtcaacctacggatggaatatcgtgaaacttatgagtggtaaggatgtcttctacctgccacctgaaaaatgtgacacattgctgtgcgatattggcgagagctccccctctcctactgtggaagagagcaggaccatccgcgtcctcaagatggtggagccatggttaaagaacaatcagttctgtataaaagttctgaacccctatatgcctacagtaattgaacaccttgagcggctgcaacgaaagcatgggggaatgctagtgagaaatccactctccaggaactcaacccacgaaatgtactggatctctaatggcactggtaacatcgtcgcaagtgtgaatatggtttcgcgcctgttgctgaaccggtttacgatgacacatagacgtcccaccattgagaaagacgtggatctcggggccggaactaggcacgtcaacgctgaaccggagacccctaatatggacgtgataggcgagcggatcaagcgcattaaagaagaacacaacagcacatggcattatgacgatgaaaatccatacaagacgtgggcgtatcacggctcctacgaggtaaaggccaccgggtctgcatcaagcatgatcaacggagtggttaaacttctgactaagccctgggacgtcgtgcctatggtgacacagatggctatgaccgatactacaccattcggtcagcaacgagtctttaaagaaaaggttgacaccagaacacccaggtccatgccgggcactcggcgcgtgatggggattaccgccgagtggttatggagaacgctgggaaggaataaaaagcctcgattgtgcacccgggaggagttcacaaagaaagtacgtactaacgcagccatgggcgctgtgtttaccgaggaaaatcagtgggatagtgccaaggcggcagtcgaggacgaagatttctggaaactcgtggacagagagcgcgagctgcataagctaggtaaatgtgggtcttgcgtttataacatgatgggaaagagggagaagaaacttggcgagtttggcaaagccaaagggagccgggctatctggtacatgtggctgggagccagatacctcgagttcgaggcactgggatttttgaatgaggatcactggttctcacgcgaaaactcctatagtggcgtggagggggaaggactgcataagctcggctacatacttagggacatcagcaaaattcccggtggggctatgtatgccgatgacacagctggatgggacactcgaatcaccgaggatgacctgcacaatgaagagaagattacgcagcagatggatccagagcaccggcaattagccaacgcaatctttaaactgacataccagaataaggtcgtgaaggtacagagacctacccccactggcacagttatggacataatttctaggaaagatcagcgcggctccgggcaagtgggaacctatggtttgaacactttcaccaatatggaagcgcagctcatccgtcagatggagggcgaaggggtcctgtcaaaggccgacctagagaacccacatcttcccgagaaaaagatcacacagtggctggagacgaaaggagtggagcggctcaagagaatggctattagcggcgatgactgcgtggtcaagcctatagatgacaggtttgccaacgcactgttggctttaaatgatatgggtaaagttcgcaaggacatcccacaatggcagccgtcgaaagggtggcacgattggcaacaggtgcccttctgttctcatcacttccacgaactgattatgaaggacggacgaaaactcgtagtgccttgccggccacaagacgagcttatcggcagagccaggattagtcagggcgcagggtggtccctgaaggaaaccgcctgtctaggaaaggcgtacgctcagatgtggagcctgatgaactttcatcgcagagatctccggttggcctcaaatgcaatctgctccgccgtccccgtgcactgggttcctacttctaggacaacctggagcatacatgctcaccatcaatggatgactacagaggacatgctgaccgtgtggaaccgtgtctggatcgaagataatccatggatggaggacaaaacgcccgtgacaacctgggagaacgtaccttatcttggtaagcgagaagatcagtggtgtggcagtctgattgggctcacttcccgcgccacctgggcacagaatatcccgacagctattcagcaagttaggagcttaatcggaaacgaggagttcctggactacatgccatctatgaaacggtttaggaaggaggaggaatcagagggcgccatttggtga

SEQ ID NO: 15299 - RNA, 9873 nt, synthetic construct
  misc_feature 1..9873: note = derived and/or modified CDS sequence (opt3) from DENV-3__HQ705617__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaggatccagcccttcctggccttaggatttttcctccgcaaactgacttctcgagaaaaccttctgctaggcgtcggcctcgctatggcgacaaccctgcaattgccggaggatattgaacagatggccaatgggatcgcactgggattaatggctctcaagctgattacacagtttgagacttaccagctttggaccgccctgatctccttgacgtgttcaaacacaatattcaccctcactgtggcctggcggaccgctacactgatcctagcaggtgttagtctgcttcctgtgtgccaaagctcgtccatgcgtaaaactgactggctcccaatggccgtcgcggctatgggcgtaccccctctgcccttgtttattttcgggctgaaggataccttaaagagaaggtcttggccactcaatgagggagtgatggccgttggcctggtgagcatccttgcatcaagtctgttgcgcaacgacgtccctatggccggtcccctcgtggctgggggactgctaattgcatgttatgtaatcacgggcacatccgccgatctgaccgtggaaaaagcggctgacataacttgggaggaagaggccgaacagacaggcgtctctcacaaccttatgattaccgttgacgatgacgggactatgcggatcaaggatgacgagacagagaatatcctcaccgtgctgttgaaaacggcattactgattgtgagcggaatatttccatactccatcccggccactctcctggtctggcatacctggcagaagcagacacaaagatcaggtgtgctttgggatgttcctagccccccagaaacccagaaagctgagctggaagagggcgtatacaggattaagcagcaggggatcttcggaaaaacacaagtgggcgtcggtgtgcagaaggagggggtttttcacactatgtggcacgtgacccgaggagccgtcttgacgtataacggcaagcgcctagaacccaattgggcaagtgtgaaaaaggacctgatttcttacggcgggggatggcggctctccgctcagtggcaaaaaggtgaggaagtacaggtcatcgccgtggagcctggcaagaacccaaaaaatttccagacaatgcccgggactttccagaccacaaccggagaaataggcgcgatcgccctggattttaagcctggtactagcgggtcgccgattatcaacagagagggaaaggttgtgggcctttatggcaatggggtcgtgaccaaaaacggaggttacgtttcaggcattgcacaaacaaatgctgagccagacgggcccacgcctgaattagaggaagagatgttcaagaaaaggaacctgactatcatggatctccatccaggatctggcaagacccgtaaatatttgcccgccatagtgcgcgaagctattaagcggagactgaggacactcatcctggcacctacccgagtcgtggccgccgagatggaggaagctcttaagggtctgccgatccggtaccagactacagcgaccaaaagtgagcacacggggcgcgaaattgtagacttgatgtgccatgcaacttttacaatgagactactgtcccccgtgagggttccaaattataacctcatcataatggatgaggcccacttcaccgaccctgctagcattgccgcacggggatacatctctacccgagtcggcatgggcgaagccgctgcgatttttatgactgccacacccccagggaccgcagatgctttccctcagagcaatgcccccatccaggacgaggagagagacataccagaacgctcctggaactcaggaaatgagtggattacagattttgcaggtaagactgtgtggttcgtgccgagtatcaaagccggcaacgacatcgctaactgtttaaggaagaatgggaaaaaggtcattcaactgagccgtaagacgtttgataccgaataccagaaaacaaagcttaacgactgggatttcgtagtgactaccgacatctctgagatgggagccaattttaaagcggatcgggttattgaccctagaaggtgcctgaagcccgtgatactcacagatggcccagagcgcgtcatcttggcaggtcccatgcctgtgaccgccgcttccgccgctcagcgaagagggcgggttggcaggaacccacagaaagaaaatgaccaatatattttcactggacagcccctgaacaatgatgaggaccatgcacactggacggaagccaagatgctcctggacaacatcaatacccctgagggcatcattccggctcttttcgaaccagagcgcgagaagtcagccgcaatagatggggaataccgtctaaaaggagagagtagaaagacatttgtggaactgatgcggaggggtgacttgcccgtctggttagcgcacaaagtggccagcgagggcatcaagtatactgatcgcaaatggtgcttcgacgggcagcgaaacaatcagattctggaagagaacatggatgtagagatctggaccaaggaaggagagaaaaagaagctcagacctcggtggctggacgctaggacatactccgatccccttgccctgaaagaatttaaggagttcgcagctggccgcaaatctattgccctcgacttggtgaccgaaatcggtagagttccatcgcatctggcacacaggactcggaatgccctagataacctggtcatgctccatacaagcgagcacgggggccgtgcttatcgccacgcggtggaggaacttcctgagacgatggaaaccctgttattgctgggactcatgatactgcttactggcggggccatgctgtttctcatctcaggaaagggtattggcaaaacatccatcgggttgatttgtgtgatcgcaagttctggaatgctgtggatggctgagatacccttacaatggattgccagcgccatcgtcctagagttctttatgatggttctgctcattccagaacctgagaagcagcgaaccccgcaggacaatcaacttgcatacgtggtaatcggcatactgaccttggctgccatcattgcggctaacgaaatgggtctgctcgagacaactaagagagatctggggatgtccaaagaacccggcgtggtctcaccaacgtcttatcttgacgtggatctccatcctgccagcgcatggaccctgtacgccgttgctacaactgtgatcacccccatgttgaggcacacaattgagaatagtaccgcaaacgtctccctggccgcgatcgctaaccaggccgtagtgttaatgggactagacaagggctggccaataagcaaaatggacctgggggttcctctccttgcactgggatgctactctcaggtgaatcccttgactctgacggccgctgtcctcctgcttattacacattatgccatcatcggcccgggtttacaggcaaaggctacccgggaggcccaaaaacgcactgcggccgggattatgaagaacccaaccgtggatggaatcatgacaatagacctggatcctgtcatttacgactcaaagttcgaaaaacagctcggccaggtgatgttgctggttctatgtgcagtgcagctgctccttatgagaacttcctgggctctgtgcgaggccttgaccctggcaacaggtcccatcacgaccctctgggaaggcagtccagggaagttttggaatactacaattgctgtaagcatggccaacatcttcaggggatcgtatctggccggcgcggggttagctttttctataatgaaatccgtgggaaccggcaagcggggtactgggagccaaggagagacacttggcgaaaaatggaagaagaaactgaatcagctctcacgaaaggatttcgacctatacaaaaagagtggtatcaccgaggtcgatagaacggaggcaaaagaaggcctgaagcgcggggagattacccaccatgccgtttctaggggatccgctaaattgcagtggtttgtggaacggaacatggtcatccccgagggccgtgtgattgacctggggtgtggaagaggcggttggagctattactgcgccgggctcaagaaggtaacagaagtgaggggatatactaaaggcggccctgggcacgaggagccggttcccatgtcaacctacggatggaatatcgtgaagcttatgagtggtaaagatgtcttctacctgccacctgaaaagtgtgacacattgctgtgcgatattggcgagagctccccctctcctactgtggaagagagccgcaccatccgggtcctcaaaatggtggagccatggttaaagaacaatcagttctgtataaaggttctgaacccctatatgcctacagtaattgaacaccttgagcgactgcaaagaaaacatgggggaatgctagtgaggaatccactctcccgcaactcaacccacgaaatgtactggatctctaatggcactggtaacatcgtcgcaagtgtgaatatggtttcgcggctgttgctgaacagatttacgatgacacatcgtaggcccaccattgagaaggacgtggatctcggggccggaactcggcacgtcaacgctgaaccggagacccctaatatggacgtgataggcgagcgcatcaaacgaattaaggaagagcacaacagcacatggcattatgacgatgaaaatccatacaaaacgtgggcgtatcacggctcctacgaggtaaaggccaccgggtctgcatcaagcatgatcaacggagtggttaagcttctgactaaaccctgggacgtcgtgcctatggtgacacagatggctatgaccgatactacaccattcggtcagcaaagagtctttaaggaaaaagttgacaccaggacaccccggtccatgccgggcactcgcagagtgatggggattaccgccgagtggttatggaggacgctgggacgaaataagaaacctcggttgtgcacccgtgaggaattcacaaagaaggtaagaactaacgcagccatgggcgctgtgtttaccgaggaaaatcagtgggatagtgccaaagcggcagtcgaggacgaagatttctggaagctcgtggaccgcgagagggagctgcataaactaggtaagtgtgggtcttgcgtttataacatgatgggaaaacgggaaaagaaacttggcgagtttggcaaggccaaggggagcagagctatctggtacatgtggctgggagcccgctacctcgaattcgaggcactgggttttttgaatgaggatcactggttctcaagggaaaactcctatagtggcgtggagggggaaggactgcataaactcggctacatacttcgagacatcagcaagattcccggtggggctatgtatgccgatgacacagctggatgggacactcggatcaccgaggatgacctgcacaatgaagagaaaattacgcagcagatggatccagagcacagacaattagccaacgcaatctttaagctgacataccagaataaagtcgtgaaggtacagaggcctacccccactggcacagttatggacataatttctcgcaaggatcagcgtggctccgggcaagtgggaacctatggtttgaacactttcaccaatatggaagcgcagctcatccggcagatggagggcgaaggggtcctgtcaaaagccgacctagagaacccacatcttcccgaaaagaaaatcacacagtggctggagacgaagggagtggagagactcaaaaggatggctattagcggcgatgactgcgtggtcaagcctatagatgaccgctttgccaacgcactgttggctttaaatgatatgggtaaggttcgaaaagacatcccacaatggcagccgtcgaaggggtggcacgattggcagcaggtgcccttctgttctcatcacttccacgaactgattatgaaagacggacggaagctcgtagtgccttgcagaccacaagacgagcttatcggcagggcccgcattagtcagggcgcagggtggtccctgaaagaaaccgcctgtctaggaaaggcgtacgctcagatgtggagcctgatgtattttcatagacgggatctcaggttggcctcaaacgcaatctgctccgccgtccccgtgcactgggttcctacttctcgtacaacctggagcatacatgctcaccatcaatggatgactacagaggacatgctgaccgtgtggaatcgagtctggatcgaagataacccatggatggaggacaagacgcccgtgacaacctgggagaatgtaccttaccttggtaaacgcgaagatcagtggtgtggcagtctgattgggctcacttccagagccacctgggcacagaacatcccgacagctattcagcaagttcggagcttaatcggaaatgaggaattcctggactacatgccatctatgaagaggtttcgcaaagaggaggaatcagagggcgccatttggtga

SEQ ID NO: 15300 - RNA, 9873 nt, synthetic construct
  misc_feature 1..9873: note = derived and/or modified CDS sequence (opt3) from DENV-3__HQ705619__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgcttacctggaataggaaagagctgttggtgacttttaagaacgcacacgctaaaaagcaagaagtagttgtgctcggctcccaggagggagccatgcacacagctctgaccggcgccacagaaattcagaattcagggggaactagtatattcgcaggtcatttaaagtgtcggctgaaaatggacaagctagagctcaaaggcatgagctacgccatgtgcaccaacacgtttgtcctgaagaaagaggtgtctgaaacccagcacgggacaatccttattaaggtcgagtacaagggagaagatgtgccatgtaaaatccccttctccactgaggacggccaaggtaaggctcataacgggcgtttgataaccgcgaatcctgttgtgacaaaaaaggaggaaccagtaaacattgaggcagaacccccgttcggcgagtcaaatatcgtcatcggaattggcgataacgccctgaaaatcaattggtataagaaggggagcagtattggaaaaatgtttgaagctactgcccgcggtgcaagaaggatggccatactcggcgacaccgcttgggatttcgggtctgtgggaggcgttctgaactcccttggtaagatggtgcaccagatctttgggagcgcctacacggcactgttctcgggcgtctcttgggtgatgaaaattggaatcggcgtattgctcacatggatcgggctgaattccaagaacacctcaatgagttttagctgcattgcgataggaatcattactttatatctgggcgctgtggttcaggccgacatgggttgtgtcatcaattggaaagggaaggagctaaagtgcggatccggcattttcgtgacaaacgaggtgcatacctggactgaacagtacaaatttcaagcagattctcctaagcggctcgccaccgctatcgccggtgcatgggagaatggcgtctgtgggatacgaagcacaacgcgcatggaaaacctgctttggaaacagatcgctaatgagttgaactatattctgtgggaaaataacatcaagctcaccgttgtggtgggagacattatcggcgtactggagcaggggaaaagaactttaacaccccagccaatggagctgaagtactcatggaaaacctggggaaaggccaagatagtcacagcggaaactcaaaacagttccttcattatcgatggccctaatacccccgagtgcccaagcgtgtctagggcctggaacgtttgggaagtggaggactatggttttggggtcttcacgacaaatatttggcttaaattgcgggaagtgtacacccagctctgtgaccaccgcctgatgtcagctgcagttaaggatgagagagccgtgcacgctgacatgggatactggatcgagagtcagaaaaacggcagctggaagctagaaaaagcctccctgatagaggtaaagacttgcacctggcccaagtctcatacactctggtcgaatggtgtcctggaaagcgatatgatcattcctaaatcccttgcaggcccaatctcacagcacaaccataggccggggtatcacactcaaaccgcgggaccctggcacttgggcaagctggagttagactttaattactgcgaggggacaacggtggtgattaccgaaaactgtggaactcgtggccctagtctccggacaaccactgtctctggtaaactgatccatgagtggtgctgtcgaagctgcacacttccacccctgagatatatgggggaagatggatgttggtacggcatggagataaggcctatttccgaaaaggaggagaatatggttaaatcattggtgagcgccggttctggcaaggtagacaacttcaccatgggggtgctctgcctggctatcctatttgaagaggtcatgcgcggaaagttcggcaaaaagcacatgatcgccggggtgttctttacgttcgttctgctcctgtccggacagattacttggcgggatatggcacatacccttatcatgattggcagtaatgctagcgacagaatgggtatgggggtgacatatttggccctgatagcaacctttaaaatccagccattcttagccctcggatttttcctgaggaagcttacttctcgcgaaaacctgctactcggcgtcggcctggctatggcgacaaccttgcaactgcccgaggatattgaacagatggccaatgggatcgcattaggactcatggctctgaaacttattacacagtttgagacttaccagctgtggaccgccttgatctccctcacgtgttcaaacacaatattcaccctgactgtggcctggcgaaccgctacactaatcctggcaggtgttagtcttctcccggtgtgccaaagctcgtccatgcggaagactgactggctgcctatggccgtcgcggctatgggcgtaccacccttgcctctgtttattttcgggttaaaggataccctcaaacgtagatcttggcccctgaatgagggagtgatggccgttggccttgtgagcatcctggcatcaagtttgctcaggaacgacgtcccaatggccggtcctctggtggctgggggactactgattgcatgttatgtaatcacgggcacatccgccgatcttaccgtggaaaaggcggctgacataacttgggaggaagaggccgaacagacaggcgtctctcacaacctcatgattaccgttgacgatgacgggactatgcgcatcaaagatgacgagacagagaatatcctgaccgtgttgttaaagacggcactgctcattgtgagcggaatatttccctactccatcccagccactctgcttgtctggcatacctggcagaaacagacacaacggtcaggtgtgctgtgggatgttccgagccctcccgaaacccagaaggctgagttggaagagggcgtatacagaattaaacagcaggggatcttcggaaagacacaagtgggcgtcggtgtgcagaaggagggggtttttcacactatgtggcacgtgaccaggggagccgtcctaacgtataacggcaaacgactggaaccaaattgggcaagtgtgaagaaagacctcatttcttacggcgggggatggcgcctgtccgctcagtggcaaaagggtgaggaagtacaggtcatcgccgtggagcccggcaaaaaccctaagaatttccagacaatgccagggactttccagaccacaaccggagaaataggcgcgatcgcccttgattttaagcccggtactagcgggtcgcctattatcaaccgggagggaaaagttgtgggcttatatggcaatggggtcgtgaccaagaacggaggttacgtttcaggcattgcacaaacaaatgctgagccggacgggccaacgcccgaactggaggaagagatgttcaaaaagagaaacctcactatcatggatttgcatcctggatctggcaaaaccaggaagtatctgccagccatagtgcgtgaagctattaagcgccggctcagaacactgatccttgcacccaccagggtcgtggccgccgagatggaggaagctctgaaaggtttgcctatccgataccagactacagcgaccaagagtgagcacacggggcgggaaattgtagacctaatgtgccatgcaacttttacaatgcgcctgctctccccggtgagagttcccaattataacttaatcataatggatgaggcccacttcaccgacccagctagcattgccgcaaggggatacatctctacccgggtcggcatgggcgaagccgctgcgatttttatgactgccacacctcccgggaccgcagatgctttcccacagagcaatgcccctatccaggacgaggagcgagacatacccgaaagatcctggaactcaggaaatgagtggattacagattttgcaggtaaaactgtgtggttcgtgccaagtatcaaggccggcaacgacatcgctaactgtctgcgcaaaaatgggaagaaggtcattcaacttagcaggaaaacgtttgataccgaataccagaagacaaaactgaacgactgggatttcgtagtgactaccgacatctctgagatgggagccaattttaaggcggatcgtgttattgacccgcggagatgcctcaaacctgtgatattgacagatggccccgagagggtcatcctggcaggtccaatgcccgtgaccgccgcttccgccgctcagcgccgagggagagttggccggaaccctcagaaggaaaatgaccaatatattttcactggacagccactcaacaatgatgaggaccatgcacactggacggaagccaagatgctgcttgacaacatcaatacccccgagggcatcattcctgctctattcgaaccggagagggagaaatcagccgcaatagatggggaataccgcctgaagggagagagtcgtaaaacatttgtggaattgatgagacggggtgacttaccagtctggctggcgcacaaggtggccagcgagggcatcaaatatactgataggaagtggtgcttcgacgggcagcgcaacaatcagattctcgaagagaacatggatgtagagatctggaccaaagaaggagagaagaagaaactgcgacccagatggcttgacgctcggacatactccgatcctctggccctcaaggaatttaaagagttcgcagctggcaggaagtctattgccttggacctggtgaccgaaatcggtcgcgttccctcgcatctagcacacagaactaggaatgccctggataacctcgtcatgcttcatacaagcgagcacgggggccgggcttatcgtcacgcggtggaggaactgccagagacgatggaaaccttattgctgctcggactgatgatacttctgactggcggggccatgctctttttgatctcaggaaaaggtattggcaagacatccatcgggctgatttgtgtgatcgcaagttctggaatgttatggatggctgagatacctctacaatggattgccagcgccatcgtcctggagttctttatgatggttctccttattcccgaaccagagaagcagcgcacccctcaggacaatcaactggcatacgtggtaatcggcatattgaccctggctgccatcattgcggctaacgaaatgggtctcctggagacaactaaacgagatcttgggatgtccaaggaaccgggcgtggtctcacccacgtcttatctcgacgtggatctgcatccagccagcgcatggaccttgtacgccgttgctacaactgtgatcacccctatgctgagacacacaattgagaatagtaccgcaaacgtctccttagccgcgatcgctaaccaggccgtagtgctaatgggactggacaaaggctggcccataagcaagatggacctcggggttccacttctggcattgggatgctactctcaggtgaatcctctgactctcacggccgctgtcctgcttttaattacacattatgccatcatcggccccggtctgcaggcaaaagctaccagggaggcccaaaagcggactgcggccgggattatgaagaacccgaccgtggatggaatcatgacaatagacctcgatccagtcatttacgactcaaaattcgaaaagcagttgggccaggtgatgctgctagttctgtgtgcagtgcagctccttctgatgcgcacttcctgggctttgtgcgaggccctgaccctcgcaacaggtcctatcacgaccctgtgggaaggcagtcccgggaaattttggaatactacaattgctgtaagcatggccaacatcttcagaggatcgtatttagccggcgcggggcttgctttttctataatgaagtccgtgggaaccggcaaaaggggtactgggagccaaggagagacactgggcgaaaagtggaagaaaaagctcaatcagctatcacggaaagatttcgacctgtacaagaaaagtggtatcaccgaggtcgatcgaacggaggcaaaggaaggcttgaaaagaggggagattacccaccatgccgtttctcgcggatccgctaagctgcagtggtttgtggaaaggaacatggtcatcccagagggccgggtgattgacctcgggtgtggacgtggcggttggagctattactgcgccgggcttaagaaagtaacagaagtgagaggatatactaagggcggccccgggcacgaggagcctgttccgatgtcaacctacggatggaatatcgtgaaactgatgagtggtaaggatgtcttctacttgcccccagaaaaatgtgacacactgctctgcgatattggcgagagctccccttctcccactgtggaagagagcaggaccatccgcgtcttaaagatggtggagccttggctgaagaacaatcagttctgtataaaagttcttaacccatatatgcccacagtaattgaacacctggagcggctacaacgaaagcatgggggaatgctcgtgagaaatcctctgtccaggaactcaacccacgaaatgtactggatctctaatggcactggtaacatcgtcgcaagtgtgaatatggtttcgcgcttgctgctcaaccggtttacgatgacacatagacgtccaaccattgagaaagacgtggatcttggggccggaactaggcacgtcaacgctgaacccgagaccccgaatatggacgtgataggcgagcggatcaagcgcattaaagaagagcacaacagcacatggcattatgacgatgaaaatccttacaagacgtgggcgtatcacggctcctacgaggtaaaggccaccgggtctgcatcaagcatgatcaacggagtggttaaactgttaactaagccatgggacgtcgtgcccatggtgacacagatggctatgaccgatactacacctttcggtcagcaacgagtctttaaagaaaaggttgacaccagaacaccaaggtccatgcccggcactcggcgcgtgatggggattaccgccgagtggctgtggagaacgttgggaaggaataaaaagccgcgactctgcacccgggaggaattcacaaagaaagtacgtactaacgcagccatgggcgctgtgtttaccgaggaaaatcagtgggatagtgccaaggcggcagtcgaggacgaagatttctggaaactggtggacagagagcgcgagctacataagcttggtaaatgtgggtcttgcgtttataacatgatgggaaagagggaaaaaaagctgggcgagtttggcaaggccaaagggagccgggctatctggtacatgtggctcggagccagatacctggaattcgaggcattgggttttctgaatgaggatcactggttctcacgcgaaaactcctatagtggcgtggagggggaaggactccataagcttggctacatactgagggacatcagcaaaattcctggtggggctatgtatgccgatgacacagctggatgggacactcgaatcaccgaggatgacttacacaatgaagagaagattacgcagcagatggatcccgagcaccggcaactggccaacgcaatctttaaattgacataccagaataaggtcgtgaaggtacagagaccaacccctactggcacagttatggacataatttctaggaaagatcagcgcggctccgggcaagtgggaacctatggtctcaacactttcaccaatatggaagcgcagctgatccgtcagatggagggcgaaggggtcctatcaaaggccgaccttgagaacccccatctgccagaaaaaaagatcacacagtggctcgagacgaaaggagtggagcggctgaagagaatggctattagcggcgatgactgcgtggtcaagcccatagatgacaggtttgccaacgcattgttagctctgaatgatatgggtaaagttcgcaaggacatccctcaatggcagccatcgaaagggtggcacgattggcagcaggtgccgttctgttctcatcacttccacgaactcattatgaaggacggacgaaaacttgtagtgccctgccggcctcaagacgagctgatcggcagagccaggattagtcagggcgcagggtggtccctaaaggaaaccgcctgtctgggaaaggcgtacgctcagatgtggagcctcatgtattttcatcgcagagatttgcggctggcctcaaacgcaatctgctccgccgtcccagtgcactgggttcccacttctaggacaacctggagcatacatgctcaccatcaatggatgactacagaggacatgcttaccgtgtggaatcgtgtctggatcgaagataacccttggatggaggacaaaacgccagtgacaacctgggagaatgtaccctacctgggtaagcgagaagatcagtggtgtggcagtctcattgggttaacttcccgcgccacctgggcacagaacatccctacagctattcagcaagttagaagcctgatcggaaatgaggaattcttggactacatgccgtctatgaaacggtttaggaaggaggaggaatcagagggcgccatttggtga

SEQ ID NO: 15301 - RNA, 9873 nt, synthetic construct
  misc_feature 1..9873: note = derived and/or modified CDS sequence (opt3) from DENV-3__HQ705620__SS-prME
  source 1..9873: mol_type = other RNA
accagcctgtgcctcatgatgatccttccagcagctctggcattccacttgacatccagagacggcgaacctaggatgattgtggggaagaacgaacggggaaaatctttactgtttaagactgcctcaggtataaatatgtgtacgttaatcgcgatggatctcggcgaaatgtgcgacgataccgtaacatacaaatgtccacatattactgaagttgaaccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcaaaattcagggggaacaagtatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgactaagaaggaggaacccgtaaacattgaggcagaaccgcctttcggcgagtcaaatatcgtcatcggaattggcgataacgccttgaaaatcaattggtacaagaaggggagcagtattggaaaaatgtttgaagctactgcccgcggtgcaagaaggatggccatactgggcgacaccgcttgggatttcgggtctgtgggaggcgttctcaactccctgggtaagatggtgcatcagatctttgggagcgcctatacggcacttttctcgggcgtctcttgggtgatgaaaattggaatcggcgtactgttgacatgggtggggctcaattccaagaacacctcaatgagttttagctgcatcgcgattggaataatcactctgtacttaggcgctgttgtccaggccgacatgggttgtgtgattaattggaaagggaaggagctgaagtgcggatccggcatcttcgtgacaaacgaggtccacacctggactgaacagtataaatttcaagcagattctcccaagcggctagccaccgctattgccggtgcatgggagaatggcgtttgtgggatccgaagcacaacgcgcatggaaaacctcctgtggaaacagatagctaatgagcttaactacatcttgtgggaaaataacattaagctgaccgtggtggtaggagacatcattggcgtcctcgagcaggggaaaagaactctgacaccacagcctatggagttaaagtattcatggaaaacctggggaaaggccaagatcgtgacagcggaaactcaaaacagttccttcataattgatggccccaataccccagagtgccccagcgtttctagggcctggaacgtgtgggaagtcgaggactacggttttggggtgttcacgacaaatatctggctgaaacttcgggaagtttatacccagttgtgtgaccaccgcctcatgtcagctgcagtgaaggatgagagagccgtacatgctgacatgggatactggattgagagtcagaaaaacggcagctggaagctggaaaaagcctccctaatcgaggtcaagacttgcacctggcctaagtctcacacactgtggtcgaatggtgtgctcgaaagcgatatgataatcccaaaatccctggcaggcccgatttcacagcataaccacaggcccgggtaccacactcaaaccgcgggaccttggcatcttggcaagttggagctggactttaattattgcgaggggacaacggtggtcatcaccgaaaactgtggaactcgtggcccaagtttacggacaaccactgtttctggtaaactcattcacgagtggtgctgtcgaagctgcacactgccccctcttagatacatgggggaagatggatgttggtatggcatggagatcaggccaatatccgaaaaggaggagaatatggtgaaatcactggtaagcgccggttctggcaaggtggacaacttcaccatgggggtcttgtgcctcgctattctgtttgaagaggtgatgcgcggaaagttcggcaaaaagcatatgatcgccggggttttctttacgttcgtgctactgctctccggacagatcacttggcgggatatggcacacaccctgattatgatcggcagtaatgctagcgacagaatgggtatgggggtcacataccttgccttgattgcaacctttaaaatacagcccttcctggccttaggatttttcctcaggcgcctgacttctcgagaaaaccttctgctaggcgtgggcctcgctatggcgacaaccctgcaattgccggaggatatcgaacagatggccaatgggattgcactgggattaatggctctcaagctgatcacacagtttgagacttatcagctttggaccgccctgatttccttgacgtgttcaaacacaatcttcaccctcactgttgcctggcggaccgctacactgatactagccggtgtgagtctgcttcctgtctgccaaagctcgtccatgcgtaaaactgactggctcccaatggccgtagcggctatgggcgtgccccctctgcccttgtttatcttctctctgaaggataccttaaagagaaggagctggccactcaatgagggggttatggccgtgggactggtctcaattcttgcaagttccctgttgcgcaacgacgtgcctatggccggccccctcgtagctggtgggctgctaatcgcatgttacgtgattacgggaacatctgccgatctgaccgtcgaaaaagcggctgacatcacttgggaggaagaggccgaacagacaggcgttagccataaccttatgataaccgtggacgatgacggcactatgcggattaaggatgacgagacagagaatatcctcaccgtgctgttgaaaacggcattactgatcgtctccgggatttttccatattcaataccggccactctcctggtgtggcacacctggcagaagcagacacaaagaagcggagttctttgggatgtacctagtcccccagaaacccagaaagctgagctggaagagggtgtgtacaggatcaagcagcagggcattttcgggaaaacacaagtcggagtgggcgttcagaaggagggtgtgtttcacactatgtggcatgtcacccgaggggccgtgttgacgtacaacggaaagcgcctagaacccaattgggcatctgtcaagaaggacctgatctcctatggcggcgggtggcggctcagcgctcagtggcaaaaaggagaggaagtccaggtgattgccgttgagcctggtaagaaccccaagaatttccagacaatgcccggcactttccagaccacaaccggggaaatcggagcgatagccctggattttaagcctggcacttcgggttcaccgatcattaacagagaggggaaggtggtcggactttacggcaatggcgtggttaccaaaaacgggggatatgtgtctggtatcgcacaaacaaatgctgagccagacggccccacgcctgaattagaggaagagatgttcaagaaaaggaacctgactattatggatctccacccagggagtggaaagacccgtaaatacttgcccgccatcgtccgcgaagctataaagcggagactgaggacactcattctggcacctacccgagtggtagccgccgagatggaggaagctcttaagggcctgccgatccggtatcagactacagcgaccaaatccgagcatacgggtcgcgaaatcgtggacttgatgtgccacgcaacttttacaatgagactactgagccccgttagggtcccaaattacaacctcattatcatggatgaggcccatttcaccgaccctgcttctatagccgcacgggggtatattagcacccgagtgggaatgggcgaagccgctgcgatctttatgactgccacacccccaggcaccgcagatgctttccctcagtccaatgcccccattcaggacgaggagagagacatcccagaacgctcatggaacagtgggaatgagtggataacagattttgcaggaaagactgtgtggttcgtcccgagcattaaagccggtaacgacatcgctaactgtttaaggaagaatggcaaaaaggtaatccaactgtctcgtaagacgtttgataccgaataccagaaaacaaaacttaacgactgggatttcgtggttactaccgacatttccgagatgggggccaattttaaagcggatcgggtgatcgaccctagaaggtgcctgaagcccgtcattctcacagatggaccagagcgcgtgatattggcaggccccatgcctgttaccgccgcttcagccgctcagcgaagaggtcgggtggggaggaacccacagaaagaaaatgaccaatacatcttcactggccagcccctgaacaatgatgaggaccacgcacactggacggaagccaagatgctcctggacaacattaatacccctgagggaatcatcccggctcttttcgaaccagagcgcgagaagagtgccgcaattgatggcgaatatcgtctaaaaggggagagcagaaagacatttgtcgaactgatgcggaggggagacttgcccgtgtggttagcgcataaagtagcctccgagggtataaagtacactgatcgcaaatggtgcttcgacggccagcgaaacaatcagatcctggaagagaacatggatgtggagatttggaccaaggaaggggagaaaaagaagctcagacctcggtggctggacgctaggacatattctgatccccttgccctgaaagaatttaaggagttcgcagctggacgcaaatcgatcgccctcgacttggttaccgaaattggcagagtcccaagccacctggcacataggactcggaatgccctagataacctggtgatgctccacacatcagagcacggtgggcgtgcttaccgccatgcggtggaggaacttcctgagacgatggaaaccctgttattgctgggcctcatgatcctgcttactggaggcgccatgctgtttctcatatccgggaagggaatcggtaaaacaagtattggcttgatctgtgtcattgcatctagcgggatgctgtggatggctgagatccccttacaatggatagcctccgccattgttctagagttctttatgatggtgctgctcatcccagaacctgagaagcagcgaaccccgcaggacaatcaacttgcatatgtagtgattggaatcctgaccttggctgccataatcgcggctaacgaaatgggcctgctcgagacaactaagagagatctgggtatgtcaaaagaacccggggtcgtgtctccaacgagctaccttgacgttgatctccaccctgccagtgcatggaccctgtatgccgtggctacaactgtcattacccccatgttgaggcatacaatcgaaaattccaccgcaaacgtaagcctggccgcgattgctaaccaggccgtggttttaatgggcctagacaagggatggccaatctctaaaatggacctgggcgtgcctctccttgcactggggtgctactcacaggtcaatcccttgactctgacggccgctgtgctcctgcttataacacactacgccattatcggaccgggcttacaggcaaaggctacccgggaggcccaaaaacgcactgcggccggtatcatgaagaacccaaccgtcgatgggattatgacaatcgacctggatcctgtgatatatgactccaagttcgaaaaacagctcggacaggttatgttgctggtgctatgtgcagtacagctgctccttatgagaacaagttgggctctgtgcgaggccttgaccctggcaacaggccccattacgaccctctgggaaggtagcccaggcaagttttggaatactacaatcgctgtgtcgatggccaacattttcagggggtcttacctggccggagcgggcttagctttttccatcatgaaaagcgtcgggaccggaaagcggggcactggttcacaaggggagacacttggagaaaaatggaagcgaaagctgaatcagctcagtagaaaagatttcgacctatataagaaatctggcataaccgaggttgatcgcacggaggcaaaggaaggtctgaaaaggggcgagatcacccatcacgccgtgtcccgggggagcgctaagttgcagtggtttgtcgaacgtaacatggtgattcccgagggaagagtaatcgacctgggctgtgggaggggaggctggtcatactattgcgccggtctcaaaaaggtgacagaagttcgcgggtacactaagggaggccctggccacgaggagccggtgcccatgagtacctatgggtggaatattgtcaaacttatgagcggaaaggatgtgttctacctgccacctgaaaaatgtgacacattgctgtgcgatatcggtgagtcctctcccagccctactgtcgaagagtcccggaccattcgagtgctcaagatggttgagccatggctgaaaaacaatcagttctgtatcaaggtactaaacccctacatgcctacagtgatagaacatcttgagagactgcaaaggaagcacggcgggatgctagtccgcaatccactctcacggaactctacccatgaaatgtattggattagtaatggaactggcaacatcgtggcatcggttaatatggtgagcagactgttgctgaaccgttttacgatgacacacaggcggcccaccatcgagaaagacgtcgatctcggtgccgggactcgccacgtgaacgctgaaccggagacccctaatatggacgtaattggagagcgaataaagagaatcaaagaagaacataactccacatggcactacgacgatgaaaatccatataagacgtgggcgtaccatggctcttatgaggtgaaagccaccggctcagcaagctccatgattaacggggttgtcaaacttctgactaagccctgggacgtggtgcctatggtcacacagatggctatgaccgatactacaccattcggacagcaaagggtttttaaagaaaaggtggacacccggacaccccgcagtatgccgggtactagaagggtaatgggcatcaccgccgagtggttatggcgaacgctggggcggaataaaaagcctcgtttgtgcaccagagaggagttcactaaaaaggtgcgcactaacgcagccatgggagctgtctttaccgaggaaaatcagtgggattctgccaaggcggcagtggaggacgaagatttctggaaactcgttgacagggagcgggagctgcacaagctaggcaaatgtggtagctgcgtgtacaacatgatggggaagagagagaagaaacttggagagtttggcaaagccaaaggctcacgcgctatttggtatatgtggctgggggccaggtacctcgagttcgaggcactgggatttttgaatgaggatcattggttctcccgagaaaacagttacagcggtgtcgagggcgaagggctgcacaagctcggatatatccttcgggacatatctaaaatccccggcggtgctatgtacgccgatgacacagctgggtgggacactagaattaccgaggatgacctgcacaatgaagagaagatcacgcagcagatggatccagagcataggcaattagccaacgcaatttttaaactgacatatcagaataaggtggtaaaagttcagcgccctacccccactggaacagtgatggacatcatatcccgtaaggatcagcggggctcaggccaagtcgggacctacggattgaacactttcaccaatatggaagcgcagctcattagacagatggagggtgaaggcgtgctgagcaaggccgacctagagaacccacaccttcccgagaaaaagatcacacagtggctggagacgaaaggggtggagaggctcaagcgcatggctatctcgggagatgactgcgtcgttaaacctattgatgaccgatttgccaacgcactgttggctttaaatgatatgggcaaggtgcggaaggacataccacaatggcagccgtctaaaggttggcatgattggcagcaggtacccttctgtagtcaccacttccatgaactgatcatgaaggacgggagaaaactcgtggtcccttgcaggccacaagacgagcttattggacgcgccagaatctcccagggcgcaggctggagcctgaaggaaaccgcctgtctagggaaagcgtatgctcagatgtggtcactgatgtactttcaccggagggatctccgtttggcctccaacgcaatttgctctgccgtgcccgttcattgggtgcctactagccgaacaacctggagtatccacgctcatcaccaatggatgactacagaggacatgctgaccgtctggaatcgcgtgtggatagaagataacccatggatggaggacaagacgcccgtaacaacctgggagaatgttccttatcttggaaagagagaagatcagtggtgtggttccctgatcggcctcactagccgggccacctgggcacagaacattccgacagctatccagcaagtgaggtctttaattgggaatgaggagttcctggactacatgccatcaatgaaacgctttagaaaggaggaggaaagtgagggagccatctggtga

SEQ ID NO: 15302 - RNA, 9873 nt, synthetic construct
  misc_feature 1..9873: note = derived and/or modified CDS sequence (opt3) from DENV-3__HQ705621__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcagaattcagggggaactagtatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtacaagaaggggagcagtattggaaaaatgtttgaagctactgcccgcggtgcaagaaggatggccatactgggcgacaccgcttgggatttcgggtctgtgggaggcgttctcaactccctgggtaagatggtgcatcagatctttgggagcgcctatacggcacttttctcgggcgtctcttgggtgatgaaaattggaatcggcgtactgttgacatggatcgggctcaattccaagaacacctcaatgagttttagctgcattgcgataggaatcattactctgtacttaggcgctgtggttcaggccgacatgggttgtgtcatcaattggaaagggaaggagctgaagtgcggatccggcattttcgtgacaaacgaggtgcacacctggactgaacagtataaatttcaagcagattctcccaagcggctagccaccgctatcgccggtgcatgggagaatggcgtctgtgggatacgaagcacaacgcgcatggaaaacctcctgtggaaacagatcgctaatgagcttaactacattttgtgggaaaataacatcaagctgaccgttgtggtgggagacattatcggcgtactcgagcaggggaaaagaactctgacaccacagcctatggagttaaagtattcatggaaaacctggggaaaggccaagatagtcacagcggaaactcaaaacagttccttcattatcgatggccccaataccccagagtgccccagcgtgtctagggcctggaacgtttgggaagtggaggactacggttttggggtcttcacgacaaatatttggctgaaacttcgggaagtgtatacccagttgtgtgaccaccgcctcatgtcagctgcagttaaggatgagagagccgtgcatgctgacatgggatactggatcgagagtcagaaaaacggcagctggaagctggaaaaagcctccctaatagaggtaaagacttgcacctggcctaagtctcacacactgtggtcgaatggtgtcctcgaaagcgatatgatcattccaaaatccctggcaggcccgatctcacagcataaccacaggcccgggtaccacactcaaaccgcgggaccttggcatcttggcaagttggagctggactttaattattgcgaggggacaacggtggtgattaccgaaaactgtggaactcgtggcccaagtttacggacaaccactgtctctggtaaactcatccacgagtggtgctgtcgaagctgcacactgccccctcttagatacatgggggaagatggatgttggtatggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcatatgatcgccggggtgttctttacgttcgttctactgctctccggacagattacttggcgggatatggcacacaccctgatcatgattggcagtaatgctagcgacagaatgggtatgggggtgacataccttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagatctatcagctttggactgccctgatatccttgacctgttcaaacacgatcttcacactcaccgtggcctggcgaactgctaccctgattctagcaggtgttagtctgcttcctatgtgccaaagctcgtccatgcggaagacagactggctcccaatggccgtggcggctatgggcgtcccccctctgcccttgtttatcttctctctgaaggatactttaaaacgtagaagctggccactcaatgagggggtaatggccgtgggactggtttcaattcttgcaagttccctgttgaggaacgacgtgcctatggccggccccctcgtcgctggtgggctgctaatcgcatgttacgtgataaccggaacgtctgccgatctgacagtagaaaaggcggctgacattacctgggaggaagaggccgaacagactggcgtgagccataaccttatgatcacagtcgacgatgacggcaccatgcgcatcaaagatgacgagactgagaatattctcacagttctgttgaagaccgcattactgatagtgtccgggatctttccatattcaattccggccacgctcctggtgtggcacacttggcagaaacagacccaacggagcggagtcctttgggatgtgcctagtcccccagaaacacagaaggctgagctggaagagggtgtttacagaatcaaacagcagggcattttcgggaagacccaagtaggagtgggcgtccagaaggagggtgtgtttcacacaatgtggcatgttactaggggggccgtgttgacctacaacggaaaacgactagaacccaattgggcatctgtcaagaaagacctgatctcctatggcggcgggtggcgcctcagcgctcagtggcaaaagggagaggaagtgcaggtaatagccgtcgagcctggtaaaaacccaaagaatttccagacgatgcccggcacattccagactaccacaggggaaatcggagcgattgccctggattttaagcctggcacctcgggttcaccgatcattaaccgggaggggaaagtggttggactttacggcaatggcgtggtcactaagaacgggggatatgtgtctggtatcgcacaaaccaatgctgagccagacggccccacacctgaattagaggaagagatgttcaaaaagagaaacctgacgataatggatctccacccagggagtggaaaaactaggaagtacttgcccgccattgttcgtgaagctatcaagcgccggctgagaaccctcatcctggcacctacaagggtggtcgccgccgagatggaggaagctcttaaaggcctgccgattcgatatcagaccactgcgacaaagtccgagcataccggtcgggaaatcgtggacttgatgtgccacgcaacgtttactatgcgcctactgagccccgtaagagtgccaaattacaacctcataattatggatgaggcccatttcacagaccctgcttctatcgccgcaagggggtatattagcacccgggttggaatgggcgaagccgctgcgatctttatgaccgccactcccccaggcacagcagatgctttccctcagtccaatgcccccatacaggacgaggagcgagacattccagaaagatcatggaacagtgggaatgagtggatcaccgattttgcaggaaaaacagtctggttcgtgccgagcatcaaggccggtaacgacattgctaactgtttacgcaaaaatggcaagaaggtgatccaactgtctaggaaaacttttgatacggaataccagaagaccaaacttaacgactgggatttcgtcgtaacaactgacatttccgagatgggggccaattttaaggcggatcgtgtgatagaccctcggagatgcctgaaacccgttatcctcaccgatggaccagagagggtgattttggcaggccccatgcctgtcacagccgcttcagccgctcagcgccgaggtagagtggggcggaacccacagaaggaaaatgaccaatacatcttcaccggccagcccctgaacaatgatgaggaccacgcacactggactgaagccaagatgctcctggacaacatcaatacgcctgagggaattataccggctcttttcgaaccagagagggagaaaagtgccgcaatcgatggcgaatatcgcctaaagggggagagccgtaaaacctttgttgaactgatgagacggggagacttgcccgtgtggttagcgcataaggtcgcctccgagggtattaaatacacagataggaagtggtgcttcgacggccagcgcaacaatcagatcctggaagagaacatggatgtggagatttggactaaagaaggggagaagaagaaactccgacctagatggctggacgctcggacctattctgatccccttgccctgaaggaatttaaagagttcgcagctggaaggaagtcgatcgccctcgacttggtaacagaaataggccgcgtgccaagccacctggcacatagaaccaggaatgccctagataacctggttatgctccacacttcagagcacggtgggcgggcttaccgtcatgcggtcgaggaacttcctgagacaatggaaacgctgttattgctgggcctcatgatcctgcttaccggaggcgccatgctgtttctcatttccgggaaaggaatcggtaagactagtattggcttgatctgtgtgatagcatctagcgggatgctgtggatggctgagattcccttacaatggatcgcctccgccattgtgctagagttctttatgatggtcctgctcatcccagaacctgagaagcagcgcacaccgcaggacaatcaacttgcatatgttgtgataggaatcctgaccttggctgccattatcgcggctaacgaaatgggcctgctcgagaccacaaaacgagatctgggtatgtcaaaggaacccggggtagtgtctccaactagctaccttgacgtcgatctccaccctgccagtgcatggacgctgtatgccgtggctaccacagttattactcccatgttgagacataccatcgagaattccacagcaaacgtgagcctggccgcgatagctaaccaggccgtcgtattaatgggcctagacaaaggatggccaatttctaagatggacctgggcgtgcctctccttgcactggggtgctactcacaggttaatcccttgaccctgactgccgctgtgctcctgcttatcacgcactacgccatcattggaccgggcttacaggcaaaagctacaagggaggcccaaaagcggaccgcggccggtatcatgaagaacccaactgtcgatgggataatgaccattgacctggatcctgtgatctatgactccaaattcgaaaagcagctcggacaggtcatgttgctggtgctatgtgttgtgcagctgctccttatgcgcacaagttgggcactgtgcgaggctttgactctggccaccggccccattacaacgctctgggaaggtagcccaggcaaattttggaataccactatcgcagtatcgatggctaacatattcagagggtcttacctggccggagccggcttagcgttttccatcatgaagagcgtggggacaggaaaaaggggcaccggttcacaaggggagactcttggagaaaagtggaagaaaaagctgaatcagctcagtcggaaagatttcgacctatataagaaatctggcattacagaggtcgatcgaaccgaggctaaggaaggtctgaaaagaggcgagatcacgcatcacgcagtttcccgcgggagcgccaagttgcagtggtttgtggaaaggaacatggtcattcccgagggacgggtgatcgacctgggctgtgggcgtggaggctggtcatactattgcgctggtctcaagaaagtaaccgaagtgagagggtacacaaagggaggccctggccacgaggagccggttcccatgagtacttatgggtggaatattgtgaaacttatgagcggaaaggatgtcttctacctgccacctgaaaaatgtgacaccttgctgtgcgatatcggtgagtcctctcccagccctacagtggaagagtccaggactatacgcgtcctcaagatggtggagccatggttaaagaacaatcagttctgtattaaagttctgaacccctacatgcctaccgtaatcgaacatcttgagcggctgcaacgaaagcacggcgggatgctagtgagaaatccactctcaaggaactctacacatgaaatgtattggatcagtaatggaaccggcaacattgtcgcctcggtgaatatggttagccgcctgttgctgaaccggtttactatgacgcacagacgtcccacaatagagaaagacgtggatctcggtgcagggaccaggcacgtcaacgccgaaccggagactcctaatatggacgtgatcggagagcggattaagcgcatcaaagaagagcataactccacctggcaccatgacgatgaaaatccatacaagacatgggcttatcacggctcttacgaggtaaaggcgacgggctcagccagctccatgattaacggggtggttaaacttctgaccaagccctgggacgtcgtgcctatggtgactcagatggcaatgacagataccactccattcggacagcaacgagtctttaaagaaaaggttgacacaagaacccccaggagtatgccgggtacacggcgcgtgatgggcatcactgctgagtggttatggagaaccctggggaggaataaaaagcctcgattgtgcacgcgggaggaattcaccaagaaagtacgtacaaacgccgcaatgggagccgtgtttactgaggaaaatcagtgggattctgctaaggccgcggtcgaggacgaagatttctggaaactcgtggacagagagcgcgagctgcataagctaggcaaatgtggtagctgcgtttataacatgatggggaagagggaaaaaaagcttggagagtttggcaaggcaaaaggctcacgggccatatggtacatgtggctgggggctagatatctcgaattcgaggccctgggatttttgaatgaggatcactggttctcccgcgaaaacagttacagcggtgtggagggcgaagggctgcacaagctcggatacatccttagggacatttctaaaatccccggcggtgcaatgtatgctgatgacaccgccgggtgggacacacgaattactgaggatgacctgcataatgaagagaagatcacccagcagatggatccagagcaccggcaattagctaacgccatatttaaactgacgtaccagaataaggtcgtgaaggtacagagacctacacccaccggaactgttatggacattatctccaggaaagatcagcgcggctcaggccaagtggggacatatggattgaacaccttcactaatatggaagcacagctcatccgtcagatggagggtgaaggcgtcctgagcaaggcggacctagagaacccacatcttcccgaaaaaaagattacccagtggctggagacaaaaggggtggagcggctcaagagaatggccatatcgggagatgactgcgtggtcaagcctatcgatgacaggtttgctaacgccctgttggcattaaatgatatgggcaaagttcgcaaggacattccacaatggcagccgtctaaaggttggcacgattggcagcaggtgcccttctgtagtcaccatttccacgaactgatcatgaaggacgggcgaaaactcgtagtgccttgccggccacaagacgagcttattggaagagctaggatctcccagggcgccggctggagcctgaaggaaacggcatgtctagggaaggcctacgcgcagatgtggtcactgatgtattttcatcgcagagatctccggttggcttccaacgccatatgctctgcagtccccgtgcactgggttcctaccagcaggactacatggagtatccatgcccaccaccaatggatgaccactgaggacatgctgacagtgtggaatcgtgtctggattgaagataacccatggatggaggacaaaacccccgtgacgacatgggagaatgtaccttaccttggaaagcgagaagatcagtggtgtggttccctgatcggcctcaccagccgcgctacttgggcccagaacattccgaccgcaatccagcaagttagatctttaattgggaatgaggaattcctggactatatgccatcaatgaaacggtttaggaaggaggaggaaagtgagggagctatatggtga

SEQ ID NO: 15303 - RNA, 9873 nt, synthetic construct
  misc_feature 1..9873: note = derived and/or modified CDS sequence (opt3) from DENV-3__HQ671176__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcagaattcagggggaactagtatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtacaagaaggggagcagtattggaaaaatgtttgaagctactgcccgcggtgcaagaaggatggccatactgggcgacaccgcttgggatttcgggtctgtgggaggcgttctcaactccctgggtaagatggtgcatcagatctttgggagcgcctatacggcacttttctcgggcgtctcttgggtgatgaaaattggaatcggcgtactgttgacatggatcgggctcaattccaagaacacctcaatgagttttagctgcattgcgataggaatcattactctgtacttaggcgctgtggttcaggccgacatgggttgtgtcatcaattggaaagggaaggagctgaagtgcggatccggcattttcgtgacaaacgaggtgcacacctggactgaacagtataaatttcaagcagattctcccaagcggctagccaccgctatcgccggtgcatgggagaatggcgtctgtgggatacgaagcacaacgcgcatggaaaacctcctgtggaaacagatcgctaatgagcttaactacattttgtgggaaaataacatcaagctgaccgttgtggtgggagacattatcggcgtactcgagcaggggaaaagaactctgacaccacagcctatggagttaaagtattcatggaaaacctggggaaaggccaagatagtcacagcggaaactcaaaacagttccttcattatcgatggccccaataccccagagtgccccagcgtgtctagggcctggaacgtttgggaagtggaggactacggttttggggtcttcacgacaaatatttggctgaaacttcgggaagtgtatacccagttgtgtgaccaccgcctcatgtcagctgcagttaaggatgagagagccgtgcatgctgacatgggatactggatcgagagtcagaaaaacggcagctggaagctggaaaaagcctccctaatagaggtaaagacttgcacctggcctaagtctcacacactgtggtcgaatggtgtcctcgaaagcgatatgatcattccaaaatccctggcaggcccgatctcacagcataaccacaggcccgggtaccacactcaaaccgcgggaccttggcatcttggcaagttggagctggactttaattattgcgaggggacaacggtggtgattaccgaaaactgtggaactcgtggcccaagtttacggacaaccactgtctctggtaaactcatccacgagtggtgctgtcgaagctgcacactgccccctcttagatacatgggggaagatggatgttggtatggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcatatgatcgccggggtgttctttacgttcgttctactgctctccggacagattacttggcgggatatggcacacaccctgatcatgattggcagtaatgctagcgacagaatgggtatgggggtgacataccttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagatctatcagctttggactgccctgatatccttgacctgttcaaacacgatcttcacactcaccgtggcctggcgaactgctaccctgattctagcaggtgttagtctgcttcctatgtgccaaagctcgtccatgcggaagacagactggctcccaatggccgtggcggctatgggcgtcccccctctgcccttgtttatcttctctctgaaggatactttaaaacgtagaagctggccactcaatgagggggtaatggccgtgggactggtttcaattcttgcaagttccctgttgaggaacgacgtgcctatggccggccccctcgtcgctggtgggctgctaatcgcatgttacgtgataaccggaacgtctgccgatctgacagtagaaaaggcggctgacattacctgggaggaagaggccgaacagactggcgtgagccataaccttatgatcacagtcgacgatgacggcaccatgcgcatcaaagatgacgagactgagaatattctcacagttctgttgaagaccgcattactgatagtgtccgggatctttccatattcaattccggccacgctcctggtgtggcacacttggcagaaacagacccaacggagcggagtcctttgggatgtgcctagtcccccagaaacacagaaggctgagctggaagagggtgtttacagaatcaaacagcagggcattttcgggaagacccaagtaggagtgggcgtccagaaggagggtgtgtttcacacaatgtggcatgttactaggggggccgtgttgacctacaacggaaaacgactagaacccaattgggcatctgtcaagaaagacctgatctcctatggcggcgggtggcgcctcagcgctcagtggcaaaagggagaggaagtgcaggtaatagccgtcgagcctggtaaaaacccaaagaatttccagacgatgcccggcacattccagactaccacaggggaaatcggagcgattgccctggattttaagcctggcacctcgggttcaccgatcattaaccgggaggggaaagtggttggactttacggcaatggcgtggtcactaagaacgggggatatgtgtctggtatcgcacaaaccaatgctgagccagacggccccacacctgaattagaggaagagatgttcaaaaagagaaacctgacgataatggatctccacccagggagtggaaaaactaggaagtacttgcccgccattgttcgtgaagctatcaagcgccggctgagaaccctcatcctggcacctacaagggtggtcgccgccgagatggaggaagctcttaaaggcctgccgattcgatatcagaccactgcgacaaagtccgagcataccggtcgggaaatcgtggacttgatgtgccacgcaacgtttactatgcgcctactgagccccgtaagagtgccaaattacaacctcatagttatggatgaggcccatttcacagaccctgcttctattgccgcaagggggtatatcagcacccgggtcggaatgggcgaagccgctgcgatttttatgaccgccactcccccaggcacagcagatgctttccctcagtccaatgcccccatccaggacgaggagcgagacataccagaaagatcatggaacagtgggaatgagtggattaccgattttgcaggaaaaacagtgtggttcgtgccgagcatcaaggccggtaacgacatcgctaactgtttacgcaaaaatggcaagaaggtcattcaactgtctaggaaaacttttgatacggaataccagaagaccaaacttaacgactgggatttcgtagtgacaactgacatctccgagatgggggccaattttaaggcggatcgtgttattgaccctcggagatgcctgaaacccgtgatactcaccgatggaccagagagggtcatcttggcaggccccatgcctgtgacagccgcttcagccgctcagcgccgaggtagagttgggcggaacccacagaaggaaaatgaccaatacattttcaccggccagcccctgaacaatgatgaggaccacgcacactggactgaagccaagatgctcctggacaacatcaatacgcctgagggaatcattccggctcttttcgaaccagagagggagaaaagtgccgcaatagatggcgaatatcgcctaaagggggagagccgtaaaacctttgtggaactgatgagacggggagacttgcccgtctggttagcgcataaggtggcctccgagggtatcaaatacacagataggaagtggtgcttcgacggccagcgcaacaatcagattctggaagagaacatggatgtagagatctggactaaagaaggggagaagaagaaactccgacctagatggctggacgctcggacctattctgatccccttgccctgaaggaatttaaagagttcgcagctggaaggaagtcgattgccctcgacttggtgacagaaatcggccgcgttccaagccacctggcacatagaaccaggaatgccctagataacctggtcatgctccacacttcagagcacggtgggcgggcttaccgtcatgcggtggaggaacttcctgagacaatggaaacgctgttattgctgggcctcatgatactgcttaccggaggcgccatgctgtttctcatctccgggaaaggaattggtaagactagtatcggcttgatttgtgtgatcgcatctagcgggatgctgtggatggctgagatacccttacaatggattgcctccgccatcgtcctagagttctttatgatggttctgctcattccagaacctgagaagcagcgcacaccgcaggacaatcaacttgcatatgtggtaatcggaatactgaccttggctgccatcattgcggctaacgaaatgggcctgctcgagaccacaaaacgagatctgggtatgtcaaaggaacccggggtggtctctccaactagctaccttgacgtggatctccaccctgccagtgcatggacgctgtatgccgttgctaccacagtgatcactcccatgttgagacataccattgagaattccacagcaaacgtcagcctggccgcgatcgctaaccaggccgtagtgttaatgggcctagacaaaggatggccaatatctaagatggacctgggcgttcctctccttgcactggggtgctactcacaggtgaatcccttgaccctgactgccgctgtcctcctgcttattacgcactacgccatcatcggaccgggcttacaggcaaaagctacaagggaggcccaaaagcggaccgcggccggtattatgaagaacccaactgtggatgggatcatgaccatagacctggatcctgtcatttatgactccaaattcgaaaagcagctcggacaggtgatgttgctggttctatgtgcagtgcagctgctccttatgcgcacaagttgggctctgtgcgaggccttgactctggcaaccggccccatcacaacgctctgggaaggtagcccaggcaaattttggaataccactattgctgtatcgatggccaacatcttcagagggtcttacctggccggagcgggcttagctttttccataatgaagagcgtggggacaggaaaaaggggcaccggttcacaaggggagactcttggagaaaagtggaagaaaaagctgaatcagctcagtcggaaagatttcgacctatataagaaatctggcatcacagaggtcgatcgaaccgaggcaaaggaaggtctgaaaagaggcgagattacgcatcacgccgtttcccgcgggagcgctaagttgcagtggtttgtggaaaggaacatggtcatccccgagggacgggtgattgacctgggctgtgggcgtggaggctggtcatactattgcgccggtctcaagaaagtaaccgaagtgagagggtacacaaagggaggccctggccacgaggagccggttcccatgagtacttatgggtggaatatcgtgaaacttatgagcggaaaggatgtcttctacctgccacctgaaaaatgtgacaccttgctgtgcgatattggtgagtcctctcccagccctacagtggaagagtccaggactatccgcgtcctcaagatggtggagccatggttaaagaacaatcagttctgtataaaagttctgaacccctacatgcctaccgtaattgaacatcttgagcggctgcaacgaaagcacggcgggatgctagtgagaaatccactctcaaggaactctacacatgaaatgtattggatcagtaatggaaccggcaacatcgtcgcatcggtgaatatggttagccgcctgttgctgaaccggtttactatgacgcacagacgtcccacaattgagaaagacgtggatctcggtgccgggaccaggcacgtcaacgctgaaccggagactcctaatatggacgtgataggagagcggatcaagcgcattaaagaagagcataactccacctggcactacgacgatgaaaatccatataagacatgggcgtaccatggctcttatgaggtaaaggccacgggctcagcaagctccatgatcaacggggtggttaaacttctgaccaagccctgggacgtcgtgcctatggtgactcagatggctatgacagataccactccattcggacagcaacgagtctttaaagaaaaggttgacacaagaacccccaggagtatgccgggtacacggcgcgtgatgggcattactgccgagtggttatggagaaccctggggaggaataaaaagcctcgattgtgcacgcgggaggaattcaccaagaaagtacgtacaaacgcagccatgggagctgtgtttactgaggaaaatcagtgggattctgccaaggcggcagtcgaggacgaagatttctggaaactcgtggacagagagcgcgagctgcacaagctaggcaaatgtggtagctgcgtttacaacatgatggggaagagggaaaaaaagcttggagagtttggcaaggccaaaggctcacgggctatctggtatatgtggctgggggccagatacctcgaattcgaggcactgggatttttgaatgaggatcattggttctcccgcgaaaacagttacagcggtgtggagggcgaagggctgcacaagctcggatatatacttagggacatctctaaaattcccggcggtgctatgtacgccgatgacaccgctgggtgggacacacgaatcactgaggatgacctgcacaatgaagagaagattacccagcagatggatccagagcatcggcaattagccaacgcaatctttaaactgacgtatcagaataaggtcgtgaaggtacagagacctacacccaccggaactgttatggacataatttccaggaaagatcagcgcggctcaggccaagtggggacatacggattgaacaccttcactaatatggaagcgcagctcatccgtcagatggagggtgaaggcgtcctgagcaaggccgacctagagaacccacaccttcccgaaaaaaagatcacccagtggctggagacaaaaggggtggagcggctcaagagaatggctatttcgggagatgactgcgtggtcaagcctatagatgacaggtttgccaacgcactgttggctttaaatgatatgggcaaagttcgcaaggacatcccacaatggcagccgtctaaaggttggcatgattggcagcaggtgcccttctgtagtcaccacttccatgaactgattatgaaggacgggcgaaaactcgtagtgccttgccggccacaagacgagcttatcggaagagccaggatttcccagggcgcaggctggagcctgaaggaaacggcctgtctagggaaggcgtatgctcagatgtggtcactgatgtactttcaccgcagagatctccggttggcctccaacgcaatctgctctgccgtccccgtgcattgggttcctaccagcaggactacatggagtatacacgctcatcaccaatggatgaccactgaggacatgctgacagtgtggaatcgtgtctggatcgaagataacccatggatggaggacaaaacccccgtgacgacatgggagaatgtaccttatcttggaaagcgagaagatcagtggtgtggttccctgattggcctcaccagccgcgccacttgggcacagaacatcccgaccgctattcagcaagttagatctttaatcgggaatgaggaattcctggactacatgccatcaatgaaacggtttaggaaggaggaggaaagtgagggagccatttggtga

SEQ ID NO: 15304 - RNA, 9873 nt, synthetic construct
  misc_feature 1..9873: note = derived and/or modified CDS sequence (opt3) from DENV-3__HQ705609__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcgtgaattggaaagggaaggagctgaagtgcggatccggcatcttcgtgacaaacgaggtccatacctggactgaacagtacaaatttcaagcagattctcccaagcggctagccaccgctattgccggtgcatgggagaatggcgtttgtgggatccgaagcacaacgcgcatggaaaacctcctgtggaaacagatagctaatgagcttaactatatcttgtgggaaaataacattaagctgaccgtggtggtaggagacatcattggcgtcctcgagcaggggaaaagaactctgacaccacagcctaaggagttaaaatactcatggaagacctggggaaaggccaaaatcgtgacagcggaaactcaaaacagttccttcataattgatggccccaataccccagagtgccccagcgtttctagggcctggaacgtgtgggaagtcgaggactatggttttggggtgttcacgacaaatatctggctgaagcttcgggaagtttacacccagttgtgtgaccaccgcctcatgtcagctgcagtgaaagatgagagagccgtacacgctgacatgggatactggattgagagtcagaagaacggcagctggaaactggaaaaggcctccctaatcgaggtcaagacttgcacctggcctaaatctcatacactgtggtcgaatggtgtgctcgaaagcgatatgataatcccaaagtccctggcaggcccgatttcacagcacaaccataggcccgggtatcacactcaaaccgcgggaccttggcaccttggcaaattggagctggactttaattactgcgaggggacaacggtggtcatcaccgaaaactgtggaactcgtggcccaagtttacggacaaccactgtttctggtaagctcattcatgagtggtgctgtcgaagctgcacactgccccctcttagatatatgggggaagatggatgttggtacggcatggagatcaggccaatatccgaaaaagaggagaatatggtgaagtcactggtaagcgccggttctggcaaggtggacaacttcaccatgggggtcttgtgcctcgctattctgtttgaagaggtgatgcgcggaaaattcggcaagaaacacatgatcgccggggttttctttacgttcgtgctactgctctccggacagatcacttggcgggatatggcacataccctgattatgatcggcagtaatgctagcgacagaatgggtatgggggtcacatatcttgccttgattgcaacctttaagatacagcccttcctggccttaggatttttcctcaggaaactgacttctcgcgaaaaccttctgctaggcgtgggcctcgctatggcgacaaccctgcaattgccggaggatatcgaacagatggccaatgggattgcactgggattaatggctctcaagctgatcacacagtttgagacttaccagctttggaccgccctgatttccttgacgtgttcaaacacaatcttcaccctcactgttgcctggcgaaccgctacactgatactagcaggtgtgagtctgcttcctgtctgccaaagctcgtccatgcggaagactgactggctcccaatggccgtagcggctatgggcgtgccccctctgcccttgtttatcttctctctgaaagataccttaaagcgtagaagctggccactcaatgagggggttatggccgtgggactggtctcaattcttgcaagttccctgttgaggaacgacgtgcctatggccggccccctcgtagctggtgggctgctaatcgcatgttatgtgattacgggaacatctgccgatctgaccgtcgaaaaagcggctgacatcacttgggaggaagaggccgaacagacaggcgttagccacaaccttatgataaccgtggacgatgacggcactatgcgcattaaggatgacgagacagagaatatcctcaccgtgctgttgaaaacggcattactgatcgtctccgggatttttccatactcaataccggccactctcctggtgtggcatacctggcagaagcagacacaacggagcggagttctttgggatgtacctagtcccccagaaacccagaaagctgagctggaagagggtgtgtacagaatcaagcagcagggcattttcgggaagacacaagtcggagtgggcgttcagaaagagggtgtgtttcacactatgtggcacgtcaccaggggggccgtgttgacgtataacggaaagcgactagaacccaattgggcatctgtaaaaaaggacctgatctcctacggcggcgggtggcgcctcagcgctcagtggcaaaaaggagaggaagtccaggtgattgccgttgagcctggtaagaacccaaagaatttccagacaatgcccggcactttccagaccacaaccggggaaatcggagcgatagccctggattttaaacctggcacttcgggttcaccgatcattaaccgggaggggaaggtggtcggactttatggcaatggcgtggttaccaaaaacgggggatacgtgtctggtatcgcacaaacaaatgctgagccagacggccccacgcctgaattagaggaagagatgttcaagaaaagaaacctgactattatggatctccatccagggagtggaaagaccaggaagtatttgcccgccatcgtccgtgaagctataaaacgccggctgagaacactcattctggcacctaccagggtggtagccgccgagatggaggaagctcttaagggcctgccgatccgataccagactacagcgaccaaatccgagcacacgggtcgggaaatcgtggacttgatgtgccatgcaacttttacaatgcgcctactgagccccgttagagtcccaaattataacctcattatcatggatgaggcccacttcaccgaccctgcttctatagccgcaagggggtacattagcacccgggtgggaatgggcgaagccgctgcgatctttatgactgccacacccccaggcaccgcagatgctttccctcagtccaatgcccccattcaggacgaggagcgagacatcccagaaagatcatggaacagtgggaatgagtggataacagattttgcaggaaagactgtgtggttcgtcccgagcattaaagccggtaacgacatcgctaactgtttacgcaagaatggcaagaaagtaatccaactgtctaggaagacgtttgataccgaataccagaaaacaaagcttaacgactgggatttcgtggttactaccgacatttccgagatgggggccaattttaaagcggatcgtgtgatcgaccctcggagatgcctgaagcccgtcattctcacagatggaccagagagggtgatattggcaggccccatgcctgttaccgccgcttcagccgctcagcgccgaggtagagtggggcggaacccacagaaggaaaatgaccaatatatcttcactggccagcccctgaacaatgatgaggaccatgcacactggacggaagccaaaatgctcctggacaacattaatacccctgagggaatcatcccggctcttttcgaaccagagagggagaagagtgccgcaattgatggcgaataccgcctaaaaggggagagccgtaagacatttgtcgaactgatgagacggggagacttgcccgtgtggttagcgcacaaagtagcctccgagggtataaagtatactgataggaaatggtgcttcgacggccagcgcaacaatcagatcctggaagagaacatggatgtggagatttggaccaaggaaggggagaagaaaaagctccgacctagatggctggacgctcggacatactctgatccccttgccctgaaagaatttaaggagttcgcagctggaaggaaatcgatcgccctcgacttggttaccgaaattggccgcgtcccaagccatctggcacacagaactaggaatgccctagataacctggtgatgctccatacatcagagcacggtgggcgggcttatcgtcacgcggtggaggaacttcctgagacgatggaaaccctgttattgctgggcctcatgatcctgcttactggaggcgccatgctgtttctcatatccgggaagggaatcggtaagacaagtattggcttgatctgtgtcattgcatctagcgggatgctgtggatggctgagatccccttacaatggatagcctccgccattgttctagagttctttatgatggtgctgctcatcccagaacctgagaaacagcgcaccccgcaggacaatcaacttgcatacgtagtgattggaatcctgaccttggctgccataatcgcggctaacgaaatgggcctgctcgagacaactaagcgagatctgggtatgtcaaaagaacccggggtcgtgtctccaacgagctatcttgacgttgatctccatcctgccagtgcatggaccctgtacgccgtggctacaactgtcattacccccatgttgagacacacaatcgagaattccaccgcaaacgtaagcctggccgcgattgctaaccaggccgtggttttaatgggcctagacaagggatggccaatctctaaaatggacctgggcgtgcctctccttgcactggggtgctactcacaggtcaatcccttgactctgacggccgctgtgctcctgcttataacacattatgccattatcggaccgggcttacaggcaaaggctaccagggaggcccaaaagcggactgcggccggtatcatgaaaaacccaaccgtcgatgggattatgacaatcgacctggatcctgtgatatacgactccaagttcgaaaaacagctcggacaggttatgttgctggtgctatgtgcagtacagctgctccttatgcgcactagttgggctctgtgcgaggccttgaccctggcaacaggccccattacgaccctctgggaaggtagcccaggcaagttttggaatactacaatcgctgtgtcgatggccaacattttcagagggtcttatctggccggagcgggcttagctttttccatcatgaaaagcgtcgggaccggaaagaggggcactggttcacaaggggagacacttggagaaaagtggaaaaagaaactgaatcagctcagtcggaaggatttcgacctatacaaaaagtctggcataaccgaggttgatcgaacggaggcaaaagaaggtctgaagagaggcgagatcacccaccatgccgtgtcccgcgggagcgctaagttgcagtggtttgtcgaaaggaacatggtgattcccgagggacgggtaatcgacctgggctgtgggcgtggaggctggtcatattactgcgccggtctcaaaaaggtgacagaagttagagggtatactaaaggaggccctggccacgaggagccggtgcccatgagtacctacgggtggaatattgtcaagcttatgagcggaaaagatgtgttctacctgccacctgaaaagtgtgacacattgctgtgcgatatcggtgagtcctctcccagccctattgtcgaagagtccaggactatccgcgtgctcaagatggttgagccatggttaaaaaacaatcagttctgtataaaggtactgaacccctatatgcctaccgtgattgaacaccttgagcggctgcaacgaaaacatggcgggatgctagtcagaaatccactctcaaggaactctacacacgaaatgtactggatcagtaatggaaccggcaacatcgtggcatcggttaatatggtgagccgcctgttgctgaaccggtttactatgacgcatagacgtcccacaattgagaaggacgtcgatctcggtgccgggaccaggcacgtgaacgctgaaccggagactcctaatatggacgtaataggagagcggatcaaacgcattaaggaagagcacaactccacctggcattatgacgatgaaaatccatacaagacatgggcgtatcacggctcttacgaggtgaaagccacgggctcagcaagctccatgatcaacggggttgtcaagcttctgaccaaaccctgggacgtggtgcctatggtcactcagatggctatgacagataccactccattcggacagcaacgagtttttagagaaaaggtggacacaaggaccccccggagtatgccgggtacacgcagagtaatgggcattactgccgagtggttatggaggaccctggggcgaaataaaaagcctcggttgtgcacgcgtgaggaattcaccaagaaagtgagaacaaacgcagccatgggagctgtctttactgaggaaaatcagtgggattctgccaaggcggcagtggaggacgaagatttctggaaactcgttgaccgcgagagggagctgcataagctaggcaaatgtggtagctgcgtgtataacatgatggggaagcgggaaaaaaagcttggagagtttggcaaggccaaaggctcaagagctatctggtacatgtggctgggggcccgctacctcgaattcgaggcactgggatttttgaatgaggatcactggttctccagggaaaacagttatagcggtgtcgagggcgaagggctgcataagctcggatacatacttcgagacatctctaaaattcccggcggtgctatgtatgccgatgacaccgctgggtgggacacacggatcactgaggatgacctgcacaatgaagagaagattacccagcagatggatccagagcacagacaattagccaacgcaatctttaaactgacgtaccagaataaggtggtaaaggttcagaggcctacacccaccggaactgtgatggacataatttcccgcaaagatcagcgtggctcaggccaagtcgggacatatggattgaacaccttcactaatatggaagcgcagctcatccggcagatggagggtgaaggcgtgctgagcaaggccgacctagagaacccacatcttcccgaaaaaaagatcacccagtggctggagacaaaaggggtggagagactcaagaggatggctatttcgggagatgactgcgtcgttaagcctatagatgaccgctttgccaacgcactgttggctttaaatgatatgggcaaagtgcgaaaggacatcccacaatggcagccgtctaaaggttggcacgattggcagcaggtacccttctgtagtcatcacttccacgaactgattatgaaggacgggcggaaactcgtggtcccttgcagaccacaagacgagcttatcggaagggcccgcatttcccagggcgcaggctggagcctgaaggaaacggcctgtctagggaaggcgtacgctcagatgtggtcactgatgtattttcatagacgggatctcaggttggcctccaacgcaatctgctctgccgtgcccgttcactgggtgcctaccagccgtactacatggagtatacatgctcaccatcaatggatgaccactgaggacatgctgacagtctggaatcgagtgtggatcgaagataacccatggatggaggacaaaacccccgtaacgacatgggagaatgttccttaccttggaaagcgcgaagatcagtggtgtggttccctgattggcctcaccagcagagccacttgggcacagaacatcccgaccgctattcagcaagtgcggtctttaatcgggaatgaggaattcctggactacatgccatcaatgaaaaggtttcgcaaggaggaggaaagtgagggagccatttggtga

SEQ ID NO: 15305 - RNA, 9873 nt, synthetic construct
  misc_feature 1..9873: note = derived and/or modified CDS sequence (opt3) from DENV-3__HQ705610__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacaatctggtcgaatggtgtcctggaaagcgatatgattatcccaaaatccctcgcaggcccgatttcacagcacaaccataggcccgggtatcacactcaaaccgcgggaccttggcacctgggcaagcttgagttggactttaattactgcgaggggacaacggtggtgatcaccgaaaactgtggaactcgtggcccaagtctgcggacaaccactgtctctggtaaattaatacatgagtggtgctgtcgaagctgcacactcccccctctgagatatatgggggaagatggatgttggtacggcatggagattaggccaatctccgaaaaggaggagaatatggttaaatcacttgtgagcgccggttctggcaaggtagacaacttcaccatgggggtgctgtgcttggctatcctctttgaagaggtcatgcgcggaaagttcggcaaaaagcacatgattgccggggtgttcctgacgtttgttctactgctctccggacagatcacttggaaagatatggcacataccctgattatgataggcagtaatgctagcgaccggatgggtatgggggtgacatatcttgccttgatcgcaaccttcaagattcagccctttctggccttaggattctttctcagaaaactgacttctagggaaaaccttctgctaggcgtcggcctcgctatggcgacaaccctgcaattgccggaggatatcgaacagatggccaatgggattgcactgggattaatggctctcaagctgatcacacagttcgagacttaccagctttggaccgccctgatatccttgacgtgttcaaacacaatcagtaccctcactgtggcctggcgcaccgctacactgattctagcaggtgttagcctgcttcctgtgtgccaatcgtcctctatgcgaaagactgactggctcccaatggccgtcgcggctatgggcgtaccccctctgcccttgtttatcttcagcctgaaagataccttaaagcggcgttcatggccactcaatgagggggtgatggccgttggactggtgagtattcttgcatcctctctgttgagaaacgacgtccctatggccggccccctcgtggctggtgggctgctaatcgcatgttatgtaataacgggaacaagcgccgatctgaccgtggaaaaagcggctgacattacttgggaggaagaggccgaacagacaggcgtctcccacaaccttatgatcaccgttgacgatgacggcactatgaggatcaaggatgacgagacagagaatattctcaccgtgctgttgaaaacggcattactgatagtgtcagggatctttccatacagcattccggccactctcctggtctggcatacctggcagaagcagacacaacgcagtggagtgctttgggatgttccttctcccccagaaacccagaaagctgagctggaagagggtgtataccggatcaagcagcagggcattttcgggaagacacaagtgggagtcggcgtgcagaaagagggtgtttttcacactatgtggcacgtgaccagaggggccgtcttgacgtataacggaaagaggctagaacccaattgggcatccgtgaaaaaggacctgatcagctacggcggcgggtggcgactctcggctcagtggcaaaaaggagaggaagtacaggtcatagccgtggagcctggtaagaacccaaagaatttccagacaatgcccggcacttttcagaccacaaccggggaaatcggagcgattgccctggatttcaaacctggcacttcaggttctccgatcattaaccgcgaggggaaggttgtgggactttatggcaatggcgtcgtgaccaaaaacgggggatacgttagtggtatcgcacaaacaaatgctgagccagacggccccacgcctgaattagaggaagagatgttcaagaaacggaacctgactataatggatctccatccagggtccggaaagaccagaaagtatttgcccgccattgtgagggaagctatcaaacgtcgcctgcggacactcatcctggcacctaccagagtcgtggccgccgagatggaggaagctcttaagggcctgccgattaggtaccagactacagcgaccaaaagcgagcacacgggtcgagaaatcgtagacttgatgtgccatgcaacttttacaatgcggctactgtctcccgtgcgcgttccaaattataacctcataattatggatgaggcccacttcaccgaccctgctagcatcgccgcaagagggtacatttccaccagggtcggaatgggcgaagccgctgcgatctttatgactgccacacccccaggcaccgcagatgctttccctcagtcaaatgcccccatacaggacgaggagcgggacattccagaacgaagttggaacagcgggaatgagtggatcacagattttgcaggaaagactgtgtggttcgtgccgtctatcaaagccggtaacgacattgctaactgtttaagaaagaatggcaagaaagtcatccaactgtcccgcaagacgtttgataccgaataccagaaaacaaagcttaacgactgggatttcgtagtgactaccgacatttcagagatgggggccaattttaaagcggatagggttatagaccctcgtcggtgcctgaagcccgtgatcctcacagatggaccagagagagtcattttggcaggccccatgcctgtgaccgccgctagtgccgctcagaggcgcggtcgagttgggagaaacccacagaaggaaaatgaccaatatatcttcactggccagcccctgaacaatgatgaggaccatgcacactggacggaagccaaaatgctcctggacaacatcaatacccctgagggaattataccggctctttttgaaccagagcgggagaagagcgccgcaatcgatggcgaatacaggctaaaaggggagtcccgcaagacattcgtggaactgatgcgtagaggagacttgcccgtctggttagcgcacaaagtggcctctgagggtattaagtatactgatcggaaatggtgcttcgacggccagaggaacaatcagatcctggaagagaacatggatgtagagatttggaccaaggaaggggagaagaaaaagctccgccctcgatggctggacgctagaacatactcggatccccttgccctgaaagaatttaaggagttcgcagctggacggaaaagcatcgccctcgacttggtgaccgaaataggcagggttccatcacatctggcacaccgcactagaaatgccctagataacctggtcatgctccatacatccgagcacggtgggagggcttatcggcacgcggtggaggaacttcctgagacgatggaaaccctgttattgctgggcctcatgatcctgcttactggaggcgccatgctgtttctcattagtgggaagggaatcggtaagacatctattggcttgatctgtgtgatagcaagctccgggatgctgtggatggctgagattcccttacaatggatcgcctcagccattgtcctagagttctttatgatggttctgctcatcccagaacctgagaaacagcgtaccccgcaggacaatcaacttgcatacgtggtaataggaatcctgaccttggctgccattatcgcggctaacgaaatgggcctgctcgagacaactaagcgcgatctgggtatgtctaaagaacccggggtggtcagcccaacgagttatcttgacgtggatctccatcctgcctccgcatggaccctgtacgccgttgctacaactgtgattacccccatgttgcgacacacaatcgagaatagcaccgcaaacgtctctctggccgcgatagctaaccaggccgtagtgttaatgggcctagacaagggatggccaatttcaaaaatggacctgggcgttcctctccttgcactggggtgctactcccaggtgaatcccttgactctgacggccgctgtcctcctgcttatcacacattatgccatcattggaccgggcttacaggcaaaggctaccagagaggcccaaaagaggactgcggccggtatcatgaaaaacccaaccgtggatgggataatgacaattgacctggatcctgtcatctacgacagtaagttcgaaaaacagctcggacaggtgatgttgctggttctatgtgtggtacagctgctccttatgcggactagctgggcactgtgcgaggctttgaccctggccacaggccccattacgaccctctgggaaggttcgccaggcaagttttggaatactacaatcgcagtgtctatggctaacatattccgcgggtcctatctggccggagccggcttagcgtttagcatcatgaaatcagtcgggaccggaaagagaggcactggtagtcaaggggagacacttggagaaaagtggaaaaagaaactgaatcagctctctaggaaggatttcgacctatacaaaaagtccggcattaccgaggttgatcggacggaggctaaagaaggtctgaagcgaggcgagatcacccaccatgcagtgagcagagggtcagccaagttgcagtggtttgtcgaacgcaacatggtgattcccgagggaagggtaatcgacctgggctgtgggcggggaggctggagttattactgcgctggtctcaaaaaggtgacagaagttcgtgggtatactaaaggaggccctggccacgaggagccggtgcccatgagcacctacgggtggaatattgtcaagcttatgtccggaaaagatgtgttctacctgccacctgaaaagtgtgacacattgctgtgcgatatcggtgagtctagcccctcccctactgtcgaagagtcaagaaccataagggtgctcaagatggttgagccatggttaaaaaacaatcagttttgtattaaggtactgaacccctatatgcctacagtgatcgaacaccttgagcgcctgcaacggaaacatggcgggatgctagtccgaaatccactctctagaaacagtacccacgaaatgtactggatctcgaatggaactggcaacattgtggccagcgttaatatggtgtccaggctgttgctgaaccgcttcacgatgacacatcggagacccaccatagagaaggacgtcgatctcggtgcagggactcgtcacgtgaacgccgaaccggagacccctaatatggacgtaatcggagagaggattaaacggatcaaggaagagcacaactctacatggcattatgacgatgaaaatccatacaagacgtgggcttatcacggctcatacgaggtgaaagcgaccggcagcgcctccagtatgattaacggggttgtcaagcttctgactaaaccctgggacgtggtgcctatggtcacacagatggcaatgaccgatactacaccattcggacagcaacgcgtttttaaggaaaaagtggacacccgaacacccagatctatgccgggtactaggcgggtaatgggcatcaccgctgagtggttatggcgcacgctggggagaaataagaagcctaggttgtgcacccgagaggaattcacaaaaaaggtgcggactaacgccgcaatgggagccgtctttaccgaggaaaatcagtgggatagcgctaaagccgcggtggaggacgaagatttctggaagctcgttgaccgtgagagagagctgcataaactaggcaagtgtggttcatgcgtgtataacatgatggggaaacgcgaaaagaagcttggagagtttggcaaagcaaagggctccagggccatatggtacatgtggctgggggctcggtacctcgaattcgaggccctgggatttttgaatgaggatcactggttcagtagagaaaacagctattctggtgtcgagggcgaagggctgcataaactcggatacatccttcgcgacatttccaagatccccggcggtgcaatgtatgctgatgacacagccgggtgggacactaggattaccgaggatgacctgcacaatgaagagaaaatcacgcagcagatggatccagagcaccgacaattagctaacgccatatttaagctgacataccagaataaggtggtaaaagttcagcggcctacccccactggaacagtgatggacattatctcaagaaaggatcagaggggcagcggccaagtcgggacctatggattgaacactttcaccaatatggaagcacagctcatccgccagatggagggtgaaggcgtgctgtcgaaagcggacctagagaacccacatcttcccgaaaagaaaattacacagtggctggagacgaagggggtggagcgtctcaagcggatggccatatctggagatgactgcgtcgttaaacctatcgatgacagatttgctaacgccctgttggcattaaatgatatgggcaaggtgaggaaagacattccacaatggcagccgagtaagggttggcacgattggcagcaggtacccttctgttcccatcactttcacgaactgatcatgaaagacgggcgcaagctcgtggtcccttgccgaccacaagacgagcttattggacgggctagaatcagccagggcgccggctggtcactgaaggaaaccgcatgtctagggaaagcctacgcgcagatgtggtccctgatgtatttccataggcgcgatctcagattggcttctaacgccatatgcagcgcagtgcccgttcactgggtgcctactagtcggacaacctggtccatccatgcccaccatcaatggatgactacagaggacatgctgaccgtctggaatagggtgtggattgaagataacccatggatggaggacaagacgcccgtaacaacctgggagaatgttccttaccttggaaaacgtgaagatcagtggtgtggtagcctgatcggcctcacttctcgagctacctgggcccagaacattccgacagcaatccagcaagtgcgctcattaattgggaatgaggaattcctggactacatgccaagtatgaagagatttcggaaagaggaggaatccgagggagctatatggtga

SEQ ID NO: 15306 - RNA, 9873 nt, synthetic construct
  misc_feature 1..9873: note = derived and/or modified CDS sequence (opt3) from DENV-3__HQ705611__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagcaggtgttagtctgcttcctgtgtgccaaagctcgtccatgcggaagactgactggctcccaatggccgtcgcggctatgggcgtaccccctctgcccttgtttattttcgggctgaaggataccttaaaacgtagatcttggccactcaatgagggagtgatggccgttggcctggtgagcatccttgcatcaagtctgttgaggaacgacgtccctatggccggtcccctcgtggctgggggactgctaattgcatgttatgtaatcacgggcacatccgccgatctgaccgtggaaaaggcggctgacataacttgggaggaagaggccgaacagacaggcgtctctcacaaccttatgattaccgttgacgatgacgggactatgcgcatcaaagatgacgagacagagaatatcctcaccgtgctgttgaagacggcattactgattgtgagcggaatatttccatactccatcccggccactctcctggtctggcatacctggcagaaacagacacaacggtcaggtgtgctttgggatgttcctagccccccagaaacccagaaggctgagctggaagagggcgtatacagaattaaacagcaggggatcttcggaaagacacaagtgggcgtcggtgtgcagaaggagggggtttttcacactatgtggcacgtgaccaggggagccgtcttgacgtataacggcaaacgactagaacccaattgggcaagtgtgaagaaagacctgatttcttacggcgggggatggcgcctctccgctcagtggcaaaagggtgaggaagtacaggtcatcgccgtggagcctggcaaaaacccaaagaatttccagacaatgcccgggactttccagaccacaaccggagaaataggcgcgatcgccctggattttaagcctggtactagcgggtcgccgattatcaaccgggagggaaaagttgtgggcctttatggcaatggggtcgtgaccaagaacggaggttacgtttcaggcattgcacaaacaaatgctgagccagacgggcccacgcctgaattagaggaagagatgttcaaaaagagaaacctgactatcatggatctccatccaggatctggcaaaaccaggaagtatttgcccgccatagtgcgtgaagctattaagcgccggctgagaacactcatcctggcacctaccagggtcgtggccgccgagatggaggaagctcttaaaggtctgccgatccgataccagactacagcgaccaagagtgagcacacggggcgggaaattgtagacttgatgtgccatgcaacttttacaatgcgcctactgtcccccgtgagagttccaaattataacctcatcataatggatgaggcccacttcaccgaccctgctagcattgccgcaaggggatacatctctacccgggtcggcatgggcgaagccgctgcgatttttatgactgccacacccccagggaccgcagatgctttccctcagagcaatgcccccatccaggacgaggagcgagacataccagaaagatcctggaactcaggaaatgagtggattacagattttgcaggtaaaactgtgtggttcgtgccgagtatcaaggccggcaacgacatcgctaactgtttacgcaaaaatgggaagaaggtcattcaactgagcaggaaaacgtttgataccgaataccagaagacaaaacttaacgactgggatttcgtagtgactaccgacatctctgagatgggagccaattttaaggcggatcgtgttattgaccctcggagatgcctgaaacccgtgatactcacagatggcccagagagggtcatcttggcaggtcccatgcctgtgaccgccgcttccgccgctcagcgccgagggagagttggccggaacccacagaaggaaaatgaccaatatattttcactggacagcccctgaacaatgatgaggaccatgcacactggacggaagccaagatgctcctggacaacatcaatacccctgagggcatcattccggctcttttcgaaccagagagggagaaatcagccgcaatagatggggaataccgcctaaagggagagagtcgtaaaacatttgtggaactgatgagacggggtgacttgcccgtctggttagcgcacaaggtggccagcgagggcatcaaatatactgataggaagtggtgcttcgacgggcagcgcaacaatcagattctggaagagaacatggatgtagagatctggaccaaagaaggagagaagaagaaactccgacctagatggctggacgctcggacatactccgatccccttgccctgaaggaatttaaagagttcgcagctggcaggaagtctattgccctcgacttggtgaccgaaatcggtcgcgttccatcgcatctggcacacagaactaggaatgccctagataacctggtcatgctccatacaagcgagcacgggggccgggcttatcgtcacgcggtggaggaacttcctgagacgatggaaaccctgttattgctgggactcatgatactgcttactggcggggccatgctgtttctcatctcaggaaaaggtattggcaagacatccatcgggttgatttgtgtgatcgcaagttctggaatgctgtggatggctgagatacccttacaatggattgccagcgccatcgtcctagagttctttatgatggttctgctcattccagaacctgagaagcagcgcaccccgcaggacaatcaacttgcatacgtggtaatcggcatactgaccttggctgccatcattgcggctaacgaaatgggtctgctcgagacaactaaacgagatctggggatgtccaaggaacccggcgtggtctcaccaacgtcttatcttgacgtggatctccatcctgccagcgcatggaccctgtacgccgttgctacaactgtgatcacccccatgttgagacacacaattgagaatagtaccgcaaacgtctccctggccgcgatcgctaaccaggccgtagtgttaatgggactagacaaaggctggccaataagcaagatggacctgggggttcctctccttgcactgggatgctactctcaggtgaatcccttgactctgacggccgctgtcctcctgcttattacacattatgccatcatcggcccgggtttacaggcaaaagctaccagggaggcccaaaagcggactgcggccgggattatgaagaacccaaccgtggatggaatcatgacaatagacctggatcctgtcatttacgactcaaaattcgaaaagcagctcggccaggtgatgttgctggttctatgtgcagtgcagctgctccttatgcgcacttcctgggctctgtgcgaggccttgaccctggcaacaggtcccatcacgaccctctgggaaggcagtccagggaaattttggaatactacaattgctgtaagcatggccaacatcttcagaggatcgtatctggccggcgcggggttagctttttctataatgaagtccgtgggaaccggcaaaaggggtactgggagccaaggagagacacttggcgaaaagtggaagaaaaagctgaatcagctctcacggaaagatttcgacctatacaagaaaagtggtatcaccgaggtcgatcgaacggaggcaaaggaaggcctgaaaagaggggagattacccaccatgccgtttctcgcggatccgctaagttgcagtggtttgtggaaaggaacatggtcatccccgagggccgggtgattgacctggggtgtggacgtggcggttggagctattactgcgccgggctcaagaaagtaacagaagtgagaggatatactaagggcggccctgggcacgaggagccggttcccatgtcaacctacggatggaatatcgtgaaacttatgagtggtaaggatgtcttctacctgccacctgaaaaatgtgacacattgctgtgcgatattggcgagagctccccctctcctactgtggaagagagcaggaccatccgcgtcctcaagatggtggagccatggttaaagaacaatcagttctgtataaaagttctgaacccctatatgcctacagtaattgaacaccttgagcggctgcaacgaaagcatgggggaatgctagtgagaaatccactctccaggaactcaacccacgaaatgtactggatctctaatggcactggtaacatcgtcgcaagtgtgaatatggtttcgcgcctgttgctgaaccggtttacgatgacacatagacgtcccaccattgagaaagacgtggatctcggggccggaactaggcacgtcaacgctgaaccggagacccctaatatggacgtgataggcgagcggatcaagaaaattaaggaagagcacaacagcacatggcattatgacgatgaaaatccatacaagacgtgggcgtatcacggctcctacgaggtaaaagccaccgggtctgcatcaagcatgatcaacggagtggttaagcttctgactaaaccctgggacgtcgtgcctatggtgacacagatggctatgaccgatactacaccattcggtcagcaacgcgtctttaaggaaaaagttgacacccgaacacccagatccatgccgggcactaggcgggtgatggggattaccgccgagtggttatggcgcacgctgggaagaaataagaagcctaggttgtgcacccgagaggaattcacaaaaaaggtacggactaacgcagccatgggcgctgtgtttaccgaggaaaatcagtgggatagtgccaaagcggcagtcgaggacgaagatttctggaagctcgtggaccgtgagagagagctgcataaactaggtaagtgtgggtcttgcgtttataacatgatgggaaaacgcgaaaagaagcttggcgagtttggcaaagccaaggggagcagggctatctggtacatgtggctgggagcccggtacctcgaattcgaggcactgggttttttgaatgaggatcactggttctcaagagaaaactcctatagtggcgtggagggggaaggactgcataaactcggctacatacttcgcgacatcagcaagattcccggtggggctatgtatgccgatgacacagctggatgggacactaggatcaccgaggatgacctgcacaatgaagagaaaattacgcagcagatggatccagagcaccgacaattagccaacgcaatctttaagctgacataccagaataaggtcgtgaaagtacagcggcctacccccactggcacagttatggacataatttctagaaaggatcagaggggctccgggcaagtgggaacctatggtttgaacactttcaccaatatggaagcgcagctcatccgccagatggagggcgaaggggtcctgtcaaaagccgacctagagaacccacatcttcccgaaaagaaaatcacacagtggctggagacgaagggagtggagcgtctcaagcggatggctattagcggcgatgactgcgtggtcaaacctatagatgacagatttgccaacgcactgttggctttaaatgatatgggtaaggttaggaaagacatcccacaatggcagccgtcgaaggggtggcacgattggcagcaggtgcccttctgttctcatcacttccacgaactgattatgaaagacggacgcaagctcgtagtgccttgccgaccacaagacgagcttatcggccgggccagaattagtcagggcgcagggtggtccctgaaggaaaccgcctgtctaggaaaagcgtacgctcagatgtggagcctgatgtattttcataggcgcgatctcagattggcctcaaacgcaatctgctccgccgtccccgtgcactgggttcctacttctcggacaacctggagcatacatgctcaccatcaatggatgactacagaggacatgctgaccgtgtggaatagggtctggatcgaagataacccatggatggaggacaagacgcccgtgacaacctgggagaatgtaccttaccttggtaaacgtgaagatcagtggtgtggcagtctgattgggctcacttcccgagccacctgggcacagaacatcccgacagctattcagcaagttcgcagcttaatcggaaatgaggaattcctggactacatgccatctatgaagagatttcggaaagaggaggaatcagagggcgccatttggtga

SEQ ID NO: 15307 - RNA, 9873 nt, synthetic construct
  misc_feature 1..9873: note = derived and/or modified CDS sequence (opt3) from DENV-3__HQ705612__SS-prME
  source 1..9873: mol_type = other RNA
accagcctgtgcctcatgatgatccttcccgcagctctggcattccacttgacatccagagacggcgaacctagaatgattgtggggaagaacgaacggggtaaatctttactgtttaagactgcctcaggtataaatatgtgtacgctaatcgcgatggatctcggcgaaatgtgcgacgataccgtcacctacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagcatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgactaagaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagccggtgttagtctgcttcctgtgtgccaaagctcgtccatgcggaagactgactggctcccaatggccgtcgcggctatgggcgtaccccctctgcccttgtttattttcgggctgaaggataccttaaaacgtagatcttggccactcaatgagggagtgatggccgttggcctggtgagcatccttgcatcaagtctgttgaggaacgacgtccctatggccggtcccctcgtggctgggggactgctaattgcatgttatgtaatcacgggcacatccgccgatctgaccgtggaaaaggcggctgacactacatgggaggaagaggccgaacagaccggcgtctctcacaaccttatgataactgttgacgatgacgggacaatgcgcattaaagatgacgagaccgagaatatcctcacggtgctgttgaagactgcattactgatcgtgagcggaatttttccatactccataccggccaccctcctggtctggcatacatggcagaaacagacccaacggtcaggtgtgctttgggatgttcctagtcccccagaaacacagaaggctgagctggaagagggcgtatacagaatcaaacagcaggggattttcggaaagactcaagtgggcgtcggtgtgcagaaggagggggtttttcacaccatgtggcacgtgacgaggggagccgtcttgacacataacggcaaacgactagaacccaattgggcaagtgtgaagaaagacctgatctcttatggcgggggatggcgcctctccgctcagtggcaaaagggtgaggaagtacaggtcattgccgtggagcctggcaaaaacccaaagaatttccagactatgcccgggaccttccagacaaccactggagaaatcggcgcgatagccctggattttaagcctggtaccagcgggtcgccgatcattaaccgggagggaaaagttgtgggcctttacggcaatggggtcgtgacaaagaacggaggttatgtttcaggcatcgcacaaacgaatgctgagccagacgggcccactcctgaattagaggaagagatgttcaaaaagagaaacctgaccattatggatctccacccaggatctggcaaaacaaggaagtacttgcccgccatcgtgcgtgaagctataaagcgccggctgagaaccctcattctggcacctactagggtcgtggccgccgagatggaggaagctcttaaaggtctgccgatccgatatcagacaaccgcgacgaagagtgagcatactgggcgggaaatcgtagacttgatgtgccacgcaacatttaccatgcgcctactgtcccccgtgagagttccaaattacaacctcattatcatggatgaggcccatttcaccgaccctgctagcatagccgcaaggggatatatttctactcgggtcggcatgggcgaagccgctgcgatctttatgacagccacacccccagggacagcagatgctttccctcagagcaatgcccccattcaggacgaggagcgagacatcccagaaagatcctggaactcaggaaatgagtggataactgattttgcaggtaaaacggtgtggttcgtgccgagtattaaggccggcaacgacatcgctaactgtttacgcaaaaatgggaagaaggtcatccaactgagcaggaaaacctttgatacagaataccagaagactaaacttaacgactgggatttcgtagtgaccacagacatttctgagatgggagccaattttaaggcggatcgtgttatcgaccctcggagatgcctgaaacccgtgattctcaccgatggcccagagagggtcatattggcaggtcccatgcctgtgactgccgcttccgccgctcagcgccgagggagagttggccggaacccacagaaggaaaatgaccaatacatcttcacgggacagcccctgaacaatgatgaggaccacgcacactggaccgaagccaagatgctcctggacaacattaatacacctgagggcatcatcccggctcttttcgaaccagagagggagaaatcagccgcaattgatggggaatatcgcctaaagggagagagtcgtaaaacttttgtggaactgatgagacggggtgacttgcccgtctggttagcgcataaggtggccagcgagggcataaaatacaccgataggaagtggtgcttcgacgggcagcgcaacaatcagatcctggaagagaacatggatgtagagatttggacaaaagaaggagagaagaagaaactccgacctagatggctggacgctcggacctattccgatccccttgccctgaaggaatttaaagagttcgcagctggcaggaagtctatcgccctcgacttggtgactgaaattggtcgcgttccatcgcacctggcacatagaacaaggaatgccctagataacctggtcatgctccacacgagcgagcacgggggccgggcttaccgtcatgcggtggaggaacttcctgagaccatggaaactctgttattgctgggactcatgatcctgcttacaggcggggccatgctgtttctcatatcaggaaaaggtatcggcaagacctccattgggttgatctgtgtgattgcaagttctggaatgctgtggatggctgagatccccttacaatggatagccagcgccattgtcctagagttctttatgatggttctgctcatcccagaacctgagaagcagcgcaccccgcaggacaatcaacttgcatatgtggtaattggcatcctgacattggctgccataatcgcggctaacgaaatgggtctgctcgagactacgaaacgagatctggggatgtccaaggaacccggcgtggtctcaccaacctcttaccttgacgtggatctccaccctgccagcgcatggacactgtatgccgttgctactaccgtgattacacccatgttgagacataccatcgagaatagtactgcaaacgtctccctggccgcgattgctaaccaggccgtagtgttaatgggactagacaaaggctggccaatcagcaagatggacctgggggttcctctccttgcactgggatgctactctcaggtgaatcccttgacgctgacagccgctgtcctcctgcttataacccactacgccattatcggcccgggtttacaggcaaaagctactagggaggcccaaaagcggaccgcggccgggatcatgaagaacccaacagtggatggaattatgactatcgacctggatcctgtcatatatgactcaaaattcgaaaagcagctcggccaggtgatgttgctggttctatgtgcagtgcagctgctccttatgcgcacctcctgggctctgtgcgaggccttgacactggcaacgggtcccattaccactctctgggaaggcagtccagggaaattttggaatacaaccatcgctgtaagcatggccaacattttcagaggatcgtacctggccggcgcggggttagctttttctatcatgaagtccgtgggaactggcaaaaggggtacagggagccaaggagagacccttggcgaaaagtggaagaaaaagctgaatcagctctcacggaaagatttcgacctatataagaaaagtggtataacggaggtcgatcgaaccgaggcaaaggaaggcctgaaaagaggggagatcacacatcacgccgtttctcgcggatccgctaagttgcagtggtttgtggaaaggaacatggtcattcccgagggccgggtgatcgacctggggtgtggacgtggcggttggagctactattgcgccgggctcaagaaagtaactgaagtgagaggatacaccaagggcggccctgggcacgaggagccggttcccatgtcaacatatggatggaatattgtgaaacttatgagtggtaaggatgtcttctacctgccacctgaaaaatgtgacactttgctgtgcgatatcggcgagagctccccctctcctaccgtggaagagagcaggacaattcgcgtcctcaagatggtggagccatggttaaagaacaatcagttctgtatcaaagttctgaacccctacatgcctaccgtaatagaacatcttgagcggctgcaacgaaagcacgggggaatgctagtgagaaatccactctccaggaactcaactcatgaaatgtattggatttctaatggcacgggtaacatcgtcgcaagtgtgaatatggtttcgcgcctgttgctgaaccggtttacaatgacccacagacgtcccactatcgagaaagacgtggatctcggggccggaaccaggcacgtcaacgctgaaccggagacacctaatatggacgtgattggcgagcggataaagcgcatcaaagaagaacataacagcacgtggcactacgacgatgaaaatccatataagacctgggcgtaccatggctcctatgaggtaaaggccactgggtctgcatcaagcatgattaacggagtggttaaacttctgacaaagccctgggacgtcgtgcctatggtgacccagatggctatgactgatacaaccccattcggtcagcaacgagtctttaaagaaaaggttgacacaagaactcccaggtccatgccgggcacccggcgcgtgatggggatcacggccgagtggttatggagaaccctgggaaggaataaaaagcctcgattgtgcacacgggaggagttcactaagaaagtacgtaccaacgcagccatgggcgctgtgtttacagaggaaaatcagtgggatagtgccaaggcggcagtcgaggacgaagatttctggaaactcgtggacagagagcgcgagctgcacaagctaggtaaatgtgggtcttgcgtttacaacatgatgggaaagagggagaagaaacttggcgagtttggcaaagccaaagggagccgggctatttggtatatgtggctgggagccagatacctcgagttcgaggcactgggatttttgaatgaggatcattggttctcacgcgaaaactcctacagtggcgtggagggggaaggactgcacaagctcggctatatccttagggacataagcaaaatccccggtggggctatgtacgccgatgacactgctggatgggacacccgaattacggaggatgacctgcacaatgaagagaagatcacacagcagatggatccagagcatcggcaattagccaacgcaatttttaaactgacctatcagaataaggtcgtgaaggtacagagacctactcccacaggcaccgttatggacatcatatctaggaaagatcagcgcggctccgggcaagtgggaacttacggtttgaacaccttcacaaatatggaagcgcagctcattcgtcagatggagggcgaaggggtcctgtcaaaggccgacctagagaacccacaccttcccgagaaaaagatcacgcagtggctggagaccaaaggagtggagcggctcaagagaatggctatcagcggcgatgactgcgtggtcaagcctattgatgacaggtttgccaacgcactgttggctttaaatgatatgggtaaagttcgcaaggacataccacaatggcagccgtcgaaagggtggcatgattggcaacaggtgcccttctgttctcaccacttccatgaactgatcatgaaggacggacgaaaactcgtagtgccttgccggccacaagacgagcttattggcagagccaggatcagtcagggcgcagggtggtccctgaaggaaactgcctgtctaggaaaggcgtatgctcagatgtggagcctgatgtactttcaccgcagagatctccggttggcctcaaacgcaatttgctccgccgtccccgtgcattgggttcctacatctaggaccacttggagcatccacgctcatcaccaatggatgacaaccgaggacatgctgacggtgtggaatcgtgtctggatagaagataacccatggatggaggacaaaacacccgtgaccacttgggagaatgtaccttatcttggtaagcgagaagatcagtggtgtggcagtctgatcgggctcacctcccgcgccacatgggcacagaacattccgactgctatccagcaagttaggagcttaattggaaatgaggagttcctggactacatgccatctatgaaacggtttaggaaggaggaggaatcagagggcgccatctggtga

SEQ ID NO: 15308 - RNA, 9873 nt, synthetic construct
  misc_feature 1..9873: note = derived and/or modified CDS sequence (opt3) from DENV-3__HQ705613__SS-prME
  source 1..9873: mol_type = other RNA
accagcctgtgcctcatgatgatccttcccgcagctctggcattccacttgacatccagagacggcgaacctagaatgattgtggggaagaacgaacggggaaaatctttactgtttaagactgcctcaggtataaatatgtgtacgctaatcgcgatggatctcggcgaaatgtgcgacgataccgtcacctacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagcatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgactaagaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagccggtgttagtctgcttcctgtgtgccaaagctcgtccatgcggaagactgactggctcccaatggccgtcgcggctatgggcgtaccccctctgcccttgtttattttcgggctgaaggataccttaaaacgtagatcttggccactcaatgagggagtgatggccgttggcctggtgagcatccttgcatcaagtctgttgaggaacgacgtccctatggccggtcccctcgtggctgggggactgctaattgcatgttatgtaatcacgggcacatccgccgatctgaccgtggaaaaggcggctgacataacttgggaggaagaggccgaacagacaggcgtctctcacaaccttatgattaccgttgacgatgacgggactatgcgcatcaaagatgacgagacagagaatatcctcaccgtgctgttgaagacggcattactgattgtgagcggaatatttccatactccatcccggccactctcctggtctggcatacctggcagaaacagacacaacggtcaggtgtgctttgggatgttcctagtcccccagaaacccagaaggctgagctggaagagggcgtatacagaattaaacagcaggggatcttcggaaagacacaagtgggcgtcggtgtgcagaaggagggggtttttcacactatgtggcacgtgaccaggggagccgtcttgacgtataacggcaaacgactagaacccaattgggcaagtgtgaagaaagacctgatttcttacggcgggggatggcgcctctccgctcagtggcaaaagggtgaggaagtacaggtcatcgccgtggagcctggcaaaaacccaaagaattatcagacaatgcccgggactttccagaccacaaccggagaaataggcgcgatcgccctggatttcaagcctggtactagcgggtcgccgattatcaaccgggagggaaaagttgtgggcctttacggcaatggggtcgtgaccaagaacggaggttatgtttcaggcattgcacaaacaaatgctgagccagacgggcccacgcctgaattagaggaagagatgtttaaaaagagaaacctgactatcatggatctccatccaggatctggcaaaaccaggaagtacttgcccgccatagtgcgtgaagctattaagcgccggctgagaacactcatcctggcacctaccagggtcgtggccgccgagatggaggaagctcttaaaggtctgccgatccgatatcagactacagcgaccaagagtgagcacacggggcgggaaattgtagacttgatgtgccatgcaactttcacaacccgcctactgtcccccgtgagagttccaaattacaacctcatcataatggatgaggcccactttaccgaccctgctagcattgccgcaaggggatacatctctactcgggtcggcatgggcgaagccgctgcgattttcatgacagccacacccccagggacagcagatgcttttcctcagagcaatgcccccatccaggacgaggagcgagacataccagaaagatcctggaactcaggaaatgagtggattactgatttcgcaggtaaaacggtgtggtttgtgccgagtatcaaggccggcaacgacatcgctaactgtttacgcaaaaatgggaagaaggtcattcaactgagcaggaaaaccttcgatacagaatatcagaagactaaacttaacgactgggattttgtagtgaccacagacatctctgagatgggagccaatttcaaggcggatcgtgttattgaccctcggagatgcctgaaacccgtgatactcaccgatggcccagagagggtcatcttggcaggtcccatgcctgtgactgccgcttccgccgctcagcgccgagggagagttggccggaacccacagaaggaaaatgaccaatacatttttacgggacagcccctgaacaatgatgaggaccatgcacactggaccgaagccaagatgctcctggacaacatcaatacacctgagggcatcattccggctcttttcgaaccagagagggagaaatcagccgcaatagatggggaatatcgcctaaagggagagagtcgtaaaactttcgtggaactgatgagacggggtgacttgcccgtctggttagcgcacaaggtggccagcgagggcatcaaatacaccgataggaagtggtgctttgacgggcagcgcaacaatcagattctggaagagaacatggatgtagagatctggacaaaagaaggagagaagaagaaactccgacctagatggctggacgctcggacctattccgatccccttgccctgaaggagttcaaagagtttgcagctggcaggaagtctattgccctcgacttggtgactgaaatcggtcgcgttccatcgcatctggcacacagaacaaggaatgccctagataacctggtcatgctccatacgagcgagcacgggggccgggcttaccgtcacgcggtggaggaacttcctgagaccatggaaactctgttattgctgggactcatgatactgcttacaggcggggccatgctgttcctcatctcaggaaaaggtattggcaagacctccatcgggttgatttgtgtgatcgcaagttctggaatgctgtggatggctgagatacccttacaatggattgccagcgccatcgtcctagagtttttcatgatggttctgctcattccagaacctgagaagcagcgcaccccgcaggacaatcaacttgcatatgtggtaatcggcatactgacattggctgccatcattgcggctaacgaaatgggtctgctcgagactacgaaacgagatctggggatgtccaaggaacccggcgtggtctcaccaacctcttaccttgacgtggatctccatcctgccagcgcatggacactgtacgccgttgctactaccgtgatcacacccatgttgagacacaccattgagaatagtactgcaaacgtctccctggccgcgatcgctaaccaggccgtagtgttaatgggactagacaaaggctggccaataagcaagatggacctgggggttcctctccttgcactgggatgctattctcaggtgaatcccttgacgctgacagccgctgtcctcctgcttattacccattacgccatcatcggcccgggtttacaggcaaaagctactagggaggcccaaaagcggaccgcggccgggattatgaagaacccaacagtggatggaatcatgactatagacctggatcctgtcatttatgactcaaaatttgaaaagcagctcggccaggtgatgttgctggttctatgtgcagtgcagctgctccttatgcgcacctcctgggctctgtgcgaggccttgacactggcaacgggtcccatcaccactctctgggaaggcagtccagggaaattctggaatacaaccattgctgtaagcatggccaacatctttagaggatcgtacctggccggcgcggggttagctttctctataatgaagtccgtgggaactggcaaaaggggtacagggagccaaggagagacccttggcgaaaagtggaagaaaaagctgaatcagctctcacggaaagattttgacctatataagaaaagtggtatcacggaggtcgatcgaaccgaggcaaaggaaggcctgaaaagaggggagattacacaccatgccgtttctcgcggatccgctaagttgcagtggttcgtggaaaggaacatggtcatccccgagggccgggtgattgacctggggtgtggacgtggcggttggagctactattgcgccgggctcaagaaagtaactgaagtgagaggatacaccaagggcggccctgggcacgaggagccggttcccatgtcaacatacggatggaatatcgtgaaacttatgagtggtaaggatgtcttttatctgccacctgaaaaatgtgacactttgctgtgcgatattggcgagagctccccctctcctaccgtggaagagagcaggacaatccgcgtcctcaagatggtggagccatggttaaagaacaatcagttctgtataaaagttctgaacccctacatgcctaccgtaattgaacaccttgagcggctgcaacgaaagcatgggggaatgctagtgagaaatccactctccaggaactcaactcacgaaatgtattggatctctaatggcacgggtaacatcgtcgcaagtgtgaatatggtttcgcgcctgttgctgaaccggttcacaatgacccatagacgtcccactattgagaaagacgtggatctcggggccggaaccaggcacgtcaacgctgaaccggagacacctaatatggacgtgataggcgagcggatcaagcgcattaaagaagaacacaacagcacgtggcattacgacgatgaaaatccatataagacctgggcgtaccacggctcctatgaggtaaaggccactgggtctgcatcaagcatgatcaacggagtggttaaacttctgacaaagccctgggacgtcgtgcctatggtgacccagatggctatgactgatacaaccccatttggtcagcaacgagtcttcaaagaaaaggttgacacaagaactcccaggtccatgccgggcacccggcgcgtgatggggattacggccgagtggttatggagaaccctgggaaggaataaaaagcctcgattgtgcacacgggaggaatttactaagaaagtacgtaccaacgcagccatgggcgctgtgttcacagaggaaaatcagtgggatagtgccaaggcggcagtcgaggacgaagatttttggaaactcgtggacagagagcgcgagctgcataagctaggtaaatgtgggtcttgcgtttacaacatgatgggaaagagggagaagaaacttggcgagttcggcaaagccaaagggagccgggctatctggtacatgtggctgggagccagatatctcgaatttgaggcactgggtttcttgaatgaggatcactggttttcacgcgaaaactcctacagtggcgtggagggggaaggactgcataagctcggctatatacttagggacatcagcaaaattcccggtggggctatgtacgccgatgacactgctggatgggacacccgaatcacggaggatgacctgcacaatgaagagaagattacacagcagatggatccagagcaccggcaattagccaacgcaatcttcaaactgacctatcagaataaggtcgtgaaggtacagagacctactcccacaggcaccgttatggacataatttctaggaaagatcagcgcggctccgggcaagtgggaacttacggtttgaacacctttacaaatatggaagcgcagctcatccgtcagatggagggcgaaggggtcctgtcaaaggccgacctagagaacccacatcttcccgagaaaaagatcacgcagtggctggagaccaaaggagtggagcggctcaagagaatggctattagcggcgatgactgcgtggtcaagcctatagatgacaggttcgccaacgcactgttggctttaaatgatatgggtaaagttcgcaaggacatcccacaatggcagccgtcgaaagggtggcacgattggcaacaggtgcccttttgttctcatcacttccacgaactgattatgaaggacggacgaaaactcgtagtgccttgccggccacaagacgagcttatcggcagagccaggattagtcagggcgcagggtggtccctgaaggaaactgcctgtctaggaaaggcgtatgctcagatgtggagcctgatgtacttccatcgcagagatctccggttggcctcaaacgcaatctgctccgccgtccccgtgcactgggttcctacatctaggaccacttggagcatacatgctcaccatcaatggatgacaaccgaggacatgctgacggtgtggaatcgtgtctggatcgaagataacccatggatggaggacaaaacacccgtgaccacttgggagaatgtaccttaccttggtaagcgagaagatcagtggtgtggcagtctgattgggctcacctcccgcgccacatgggcacagaacatcccgactgctattcagcaagttaggagcttaatcggaaatgaggaatttctggactatatgccatctatgaaacggttcaggaaggaggaggaatcagagggcgccatttggtga

SEQ ID NO: 15309 - RNA, 9873 nt, synthetic construct
  misc_feature 1..9873: note = derived and/or modified CDS sequence (opt3) from DENV-3__HQ705615__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagcaggtgttagtctgcttcctgtgtgccaaagctcgtccatgcggaagactgactggctcccaatggccgtcgcggctatgggcgtaccccctctgcccttgtttattttctctctgaaggataccttaaaacgtagaagctggccactcaatgagggggtgatggccgttggactggtgtcaatccttgcaagttccctgttgaggaacgacgtccctatggccggccccctcgtggctggtgggctgctaattgcatgttatgtaatcacgggaacatctgccgatctgaccgtggaaaaggcggctgacataacttgggaggaagaggccgaacagacaggcgtcagccacaaccttatgattgcagttgacgatgacggcaccatgcgcatcaaagatgacgagactgagaatatcctcacagtgctgttgaagaccgccttactgattgtgtccgggatatttccatactcaatcccggctacgctcctggtctggcatacttggcagaaacagacccaacggagcggagtgctttgggatgttcctagtcccccagaaacacagaaggccgagctggaagagggtgtatacagaattaaacagcagggcatcttcgggaagacccaagtgggagtcggcgtgcagaaggagggtgtttttcacacaatgtggcacgtgactaggggggcagtcttgacctataacggaaaacgactagaacccaattgggcttctgtgaagaaagacctgatttcctacggcggcgggtggcgcctcagcgcccagtggcaaaagggagaggaagtacaggtcatcgcggtggagcctggtaaaaacccaaagaatttccagacgatgcccggcacattccagactaccacaggggaaataggagccatcgcactggattttaagcctggcacctcgggttcaccgattatcaaccgggaggggaaagttgtgggactttatggcaatggcgtcgtgactaagaacgggggatacgtttctggtattgctcaaaccaatgccgagccagacggccccacacctgaattagaggaagagatgttcaaaaagagaaacctgacgatcatggatctccatccagggagtggaaaaactaggaagtatttgcccgctatagtgcgtgaagcaattaagcgccggctgagaaccctcatcctggcccctacaagggtcgtggccgctgagatggaggaagcgcttaaaggcctgccgatccgataccagaccactgcaacaaagtccgagcacaccggtcgggaaattgtagacttgatgtgccatgccacgtttactatgcgcctactgagccccgtgagagttccaaattataacctcatcataatggatgaggctcacttcacagaccctgcctctattgcagccagggggtacatcagcacccgggtcggaatgggcgaagctgcggccatttttatgaccgcaactcccccaggcacagctgatgccttccctcagtccaatgcacccatccaggacgaggagcgagacataccagaaagatcatggaacagtgggaatgagtggattaccgattttgccggaaaaacagtgtggttcgtgccgagcatcaaggctggtaacgacatcgccaactgtttacgcaaaaatggcaagaaggtcattcaactgtctaggaaaacttttgatacggaataccagaagaccaaacttaacgactgggatttcgtagtgacaactgacatctccgagatgggggcgaattttaaggcagatcgtgttattgaccctcggagatgcctgaaacccgtgatactcaccgatggaccagagagggtcatcttggccggccccatgcctgtgacagctgcctcagctgcacagcgccgaggtagagttgggcggaacccacagaaggaaaatgaccaatatattttcaccggccagcccctgaacaatgatgaggaccatgcccactggactgaagctaagatgctcctggacaacatcaatacgcctgagggaatcattccggcccttttcgaaccagagagggagaaaagtgcagcgatagatggcgaataccgcctaaagggggagagccgtaaaacctttgtggaactgatgagacggggagacttgcccgtctggttagcccacaaggtggcttccgagggtatcaaatatacagataggaagtggtgcttcgacggccagcgcaacaatcagattctggaagagaacatggatgtagagatctggactaaagaaggggagaagaagaaactccgacctagatggctggacgcccggacctactctgatccccttgcactgaaggaatttaaagagttcgctgccggaaggaagtcgattgcactcgacttggtgacagaaatcggccgcgttccaagccatctggcccacagaaccaggaatgctctagataacctggtcatgctccatacttcagagcacggtgggcgggcgtatcgtcacgccgtggaggaacttcctgagacaatggaaacgctgttattgctgggcctcatgatactgcttaccggaggcgcaatgctgtttctcatctccgggaaaggaattggtaagactagtatcggcttgatttgtgtgatcacatctagcgggatgctgtggatggctgagatacccttacaatggattgcctccgccatcgtcctagagttctttatgatggttctgctcattccagaacctgagaagcagcgcaccccgcaggacaatcaacttgcatacgtggtaatcggaatactgaccttggctgccatcattgcggctaacgaaatgggcctgctcgagacaactaaacgagatctgggtatgtcaaaggaacccggggtggtctctccaacgagctatcttgacgtggatctccatcctgccagtgcatggaccctgtacgccgttgctacaactgtgatcacccccatgttgagacacacaattgagaattccaccgcaaacgtcagcctggccgcgatcgctaaccaggccgtagtgttaatgggcctagacaaaggatggccaatatctaagatggacctgggcgttcctctccttgcactggggtgctactcacaggtgaatcccttgactctgacggccgctgtcctcctgcttattacacattatgccatcatcggaccgggcttacaggcaaaagctaccagggaggcccaaaagcggactgcggccggtattatgaagaacccaaccgtggatgggatcatgacaatagacctggatcctgtcatttacgactccaaattcgaaaagcagctcggacaggtgatgttgctggttctatgtgcagtgcagctgctccttatgcgcactagttgggctctgtgcgaggccttgaccctggcaacaggccccatcacgaccctctgggaaggtagcccaggcaaattttggaatactacaattgctgtatcgatggccaacatcttcagagggtcttatctggccggagcgggcttagctttttccataatgaagagcgtggggaccggaaaaaggggcactggttcacaaggggagacacttggagaaaagtggaagaaaaagctgaatcagctcagtcggaaagatttcgacctatacaagaaatctggcatcaccgaggtcgatcgaacggaggcaaaggaaggtctgaaaagaggcgagattacccaccatgccgtttcccgcgggagcgctaagttgcagtggtttgtggaaaggaacatggtcatccccgagggacgggtgattgacctgggctgtgggcgtggaggctggtcatatcactgcgccggtctcaagaaagtaacagaagtgagagggtacactaagggaggccctggccacgaggagccggttcccatgagtacctatgggtggaatatcgtgaaacttatgagcggaaaggatgtcttctacctgccacctgaaaaatgtgacacattgctgtgcgatattggtgagtcctctcccagccctactgtggaagagtccaggaccatccgcgtcctcaagatggtggagccatggttaaagaacaatcagttctgtataaaagttctgaacccctacatgcctacagtaattgaacatcttgagcggctgcaacgaaagcacggcgggatgctagtgagaaatccactctcaaggaactctacccatgaaatgtattggatcagtaatggaactggcaacatcgtcgcatcggtgaatatggttagccgcctgttgctgaaccggtttacgatgacacacagacgtcccaccattgagaaagacgtggatctcggtgccgggactaggcacgtcaacgctgaaccggagacccctaatatggacgtgataggagagcggatcaagcgcattaaagaagagcataactccacatggcactacgacgatgaaaatccatataagacgtgggcgtaccatggctcttatgaggtaaaggccaccggctcagcaagctccatgatcaacggggtggttaaacttctgactaagccctgggacgtcgtgcctatggtgacacagatggctatgaccgatactacaccattcggacagcaacgagtctttaaagaaaaggttgacaccagaacacccaggagtatgccgggtactcggcgcgtgatgggcattaccgccgagtggttatggagaacgctggggaggaataaaaagcctcgattgtgcacccgggaggaattcacaaagaaagtacgtactaacgcagccatgggagctgtgtttaccgaggaaaatcagtgggattctgccaaggcggcagtcgaggacgaagatttctggaaactcgtggacagagagcgcgagctgcacaagctaggcaaatgtggtagctgcgtttacaacatgatggggaagagggaaaaaaagcttggagagtttggcaaggccaaaggctcacgggctatctggtatatgtggctgggggccagatacctcgaattcgaggcactgggatttttgaatgaggatcattggttctcccgcgaaaacagttacagcggtgtggagggcgaagggctgcacaagctcggatatatacttagggacatctctaaaattcccggcggtgctatgtacgccgatgacacagctgggtgggacactcgaatcaccgaggatgacctgcacaatgaagagaagattacgcagcagatggatccagagcatcggcaattagccaacgcaatctttaaactgacatatcagaataaggtcgtgaaggtacagagacctacccccactggaacagttatggacataatttccaggaaagatcagcgcggctcaggccaagtggggacctacggattgaacactttcaccaatatggaagcgcagctcatccgtcagatggagggtgaaggcgtcctgagcaaggccgacctagagaacccacaccttcccgaaaaaaagatcacacagtggctggagacgaaaggggtggagcggctcaagagaatggctatttcgggagatgactgcgtggtcaagcctatagatgacaggtttgccaacgcactgttggctttaaatgatatgggcaaagttcgcaaggacatcccacaatggcagccgtctaaaggttggcatgattggcagcaggtgcccttctgtagtcaccacttccatgaactgattatgaaggacgggcgaaaactcgtagtgccttgccggccacaagacgagcttatcggaagagccaggatttcccagggcgcaggctggagcctgaaggaaaccgcctgtctagggaaggcgtatgctcagatgtggtcactgatgtactttcaccgcagagatctccggttggcctccaacgcaatctgctctgccgtccccgtgcattgggttcctactagcaggacaacctggagtatacacgctcatcaccaatggatgactacagacgatatgctgaccgtgtggaatcgtgtctggatcgaggacaacccatggatggaagataaaacgcccgtgacaacctgggagaatgtaccttatcttggaaagcgagaggaccagtggtgtggttccctgattggcctcactagccgcgccacctgggcacagaacatcccgacagctattcagcaagttagatctttaatcgggaatgaagagttcctggattacatgccatcaatgaaacggtttaggaaggaagaggagagtgaaggagccatttggtga

SEQ ID NO: 15310 - RNA, 9873 nt, synthetic construct
  misc_feature 1..9873: note = derived and/or modified CDS sequence (opt3) from DENV-3__JF920398__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacaatctggtcgaatggtgtcctggaaagcgatatgattatcccaaaatccctcgcaggcccgatttcacagcacaaccataggcccgggtatcacactcaaaccgcgggaccttggcacctgggcaagcttgagttggactttaattactgcgaggggacaacggtggtgatcaccgaaaactgtggaactcgtggcccaagtctgcggacaaccactgtctctggtaaattaatacatgagtggtgctgtcgaagctgcacactcccccctctgagatatatgggggaagatggatgttggtacggcatggagattaggccaatctccgaaaaggaggagaatatggttaaatcacttgtgagcgccggttctggcaaggtagacaacttcaccatgggggtgctgtgcttggctatcctctttgaagaggtcatgcgcggaaagttcggcaaaaagcacatgattgccggggtgttcctgacgtttgttctactgctctccggacagatcacttggcgggatatggcacataccctgattatgataggcagtaatgctagcgacagaatgggtatgggggtgacatatcttgccttgatcgcaaccttcaaaattcagccctttctggccttaggattctttctcaggaagctgacttctcgcgaaaaccttctgctaggcgtcggcctcgctatggcgacaaccctgcaattgccggaggatatcgaacagatggccaatgggattgcactgggattaatggctctcaaactgatcacacagttcgagacttaccagctttggaccgccctgatatccttgacgtgttcaaacacaatctttaccctcactgtggcctggcgaaccgctacactgattctagcaggtgttagtctgcttcctgtgtgccaaagctcgtccatgcggaagactgactggctcccaatggccgtcgcggctatgggcgtaccccctctgcccttgttcatcttttctctgaaggataccttaaaacgtagaagctggccactcaatgagggggtgatggccgttggactggtgtcaattcttgcaagttccctgttgaggaacgacgtccctatggccggccccctcgtggctggtgggctgctaatcgcatgttatgtaataacgggaacatctgccgatctgaccgtggaaaaggcggctgacattacttgggaggaagaggccgaacagacaggcgtcagccacaaccttatgatcaccgttgacgatgacggcactatgcgcatcaaagatgacgagacagagaatattctcaccgtgctgttgaagacggcattactgatagtgtccgggatcttcccatactcaattccggccactctcctggtctggcatacctggcagaaacagacacaacggagcggagtgctttgggatgttcctagtcccccagaaacccagaaggctgagctggaagagggtgtatacagaatcaaacagcagggcatttttgggaagacacaagtgggagtcggcgtgcagaaggagggtgttttccacactatgtggcacgtgaccaggggggccgtcttgacgtataacggaaaacgactagaacccaattgggcatctgtgaagaaagacctgatctcctacggcggcgggtggcgcctcagcgctcagtggcaaaagggagaggaagtacaggtcatagccgtggagcctggtaaaaacccaaagaattttcagacaatgcccggcactttccagaccacaaccggggaaatcggagcgattgccctggatttcaagcctggcacttcgggttcaccgatcattaaccgggaggggaaagttgtgggactttatggcaatggcgtcgtgaccaagaacgggggatacgtttctggtatcgcacaaacaaatgctgagccagacggccccacgcctgaattagaggaagagatgtttaaaaagagaaacctgactataatggatctccatccagggagtggaaaaaccaggaagtatttgcccgccattgtgcgtgaagctatcaagcgccggctgagaacactcatcctggcacctaccagggtcgtggccgccgagatggaggaagctcttaaaggcctgccgattcgataccagactacagcgaccaagtccgagcacacgggtcgggaaatcgtagacttgatgtgccatgcaactttcacaatgcgcctactgagccccgtgagagttccaaattataacctcataattatggatgaggcccactttaccgaccctgcttctatcgccgcaagggggtacattagcacccgggtcggaatgggcgaagccgctgcgatcttcatgactgccacacccccaggcaccgcagatgcttttcctcagtccaatgcccccatacaggacgaggagcgagacattccagaaagatcatggaacagtgggaatgagtggatcacagatttcgcaggaaaaactgtgtggtttgtgccgagcatcaaggccggtaacgacattgctaactgtttacgcaaaaatggcaagaaggtcatccaactgtctaggaaaacgttcgataccgaataccagaagacaaaacttaacgactgggattttgtagtgactaccgacatttccgagatgggggccaatttcaaggcggatcgtgttatagaccctcggagatgcctgaaacccgtgatcctcacagatggaccagagagggtcattttggcaggccccatgcctgtgaccgccgcttcagccgctcagcgccgaggtagagttgggcggaacccacagaaggaaaatgaccaatatatctttactggccagcccctgaacaatgatgaggaccatgcacactggacggaagccaagatgctcctggacaacatcaatacccctgagggaattataccggctcttttcgaaccagagagggagaaaagtgccgcaatcgatggcgaataccgcctaaagggggagagccgtaaaacattcgtggaactgatgagacggggagacttgcccgtctggttagcgcacaaggtggcctccgagggtattaaatatactgataggaagtggtgctttgacggccagcgcaacaatcagatcctggaagagaacatggatgtagagatttggaccaaagaaggggagaagaagaaactccgacctagatggctggacgctcggacatactctgatccccttgccctgaaggaattcaaagagtttgcagctggaaggaagtcgatcgccctcgacttggtgaccgaaataggccgcgttccaagccatctggcacacagaactaggaatgccctagataacctggtcatgctccatacatcagagcacggtgggcgggcttatcgtcacgcggtggaggaacttcctgagacgatggaaaccctgttattgctgggcctcatgatcctgcttactggaggcgccatgctgttcctcatttccgggaaaggaatcggtaagacaagtattggcttgatctgtgtgatagcatctagcgggatgctgtggatggctgagattcccttacaatggatcgcctccgccattgtcctagagtttttcatgatggttctgctcatcccagaacctgagaagcagcgcaccccgcaggacaatcaacttgcatacgtggtaataggaatcctgaccttggctgccattatcgcggctaacgaaatgggcctgctcgagacaactaaacgagatctgggtatgtcaaaggaacccggggtggtctctccaacgagctatcttgacgtggatctccatcctgccagtgcatggaccctgtacgccgttgctacaactgtgattacccccatgttgagacacacaatcgagaattccaccgcaaacgtcagcctggccgcgatagctaaccaggccgtagtgttaatgggcctagacaaaggatggccaatttctaagatggacctgggcgttcctctccttgcactggggtgctactcacaggtgaatcccttgactctgacggccgctgtcctcctgcttatcacacattatgccatcattggaccgggcttacaggcaaaagctaccagggaggcccaaaagcggactgcggccggtatcatgaagaacccaaccgtggatgggataatgacaattgacctggatcctgtcatctacgactccaaatttgaaaagcagctcggacaggtgatgttgctggttctatgtgcagtgcagctgctccttatgcgcactagttgggctctgtgcgaggccttgaccctggcaacaggccccattacgaccctctgggaaggtagcccaggcaaattctggaatactacaatcgctgtatcgatggccaacatatttagagggtcttatctggccggagcgggcttagctttctccatcatgaagagcgtggggaccggaaaaaggggcactggttcacaaggggagacacttggagaaaagtggaagaaaaagctgaatcagctcagtcggaaagattttgacctatacaagaaatctggcattaccgaggtcgatcgaacggaggcaaaggaaggtctgaaaagaggcgagatcacccaccatgccgtttcccgcgggagcgctaagttgcagtggttcgtggaaaggaacatggtcattcccgagggacgggtgatcgacctgggctgtgggcgtggaggctggtcatattactgcgccggtctcaagaaagtaacagaagtgagagggtatactaagggaggccctggccacgaggagccggttcccatgagtacctacgggtggaatattgtgaaacttatgagcggaaaggatgtcttttacctgccacctgaaaaatgtgacacattgctgtgcgatatcggtgagtcctctcccagccctactgtggaagagtccaggaccatacgcgtcctcaagatggtggagccatggttaaagaacaatcagttctgtattaaagttctgaacccctatatgcctacagtaatcgaacaccttgagcggctgcaacgaaagcatggcgggatgctagtgagaaatccactctcaaggaactctacccacgaaatgtactggatcagtaatggaactggcaacattgtcgcatcggtgaatatggttagccgcctgttgctgaaccggttcacgatgacacatagacgtcccaccatagagaaagacgtggatctcggtgccgggactaggcacgtcaacgctgaaccggagacccctaatatggacgtgatcggagagcggattaagcgcatcaaagaagagcacaactccacatggcattatgacgatgaaaatccatacaagacgtgggcgtatcacggctcttacgaggtaaaggccaccggctcagcaagctccatgattaacggggtggttaaacttctgactaagccctgggacgtcgtgcctatggtgacacagatggctatgaccgatactacaccatttggacagcaacgagtcttcaaagaaaaggttgacaccagaacacccaggagtatgccgggtactcggcgcgtgatgggcatcaccgccgagtggttatggagaacgctggggaggaataaaaagcctcgattgtgcacccgggaggaatttacaaagaaagtacgtactaacgcagccatgggagctgtgttcaccgaggaaaatcagtgggattctgccaaggcggcagtcgaggacgaagatttttggaaactcgtggacagagagcgcgagctgcataagctaggcaaatgtggtagctgcgtttataacatgatggggaagagggaaaaaaagcttggagagttcggcaaggccaaaggctcacgggctatatggtacatgtggctgggggccagatacctcgaatttgaggcactgggattcttgaatgaggatcactggttttcccgcgaaaacagttatagcggtgtggagggcgaagggctgcataagctcggatacatccttagggacatttctaaaatccccggcggtgctatgtatgccgatgacacagctgggtgggacactcgaattaccgaggatgacctgcacaatgaagagaagatcacgcagcagatggatccagagcaccggcaattagccaacgcaatattcaaactgacataccagaataaggtcgtgaaggtacagagacctacccccactggaacagttatggacattatctccaggaaagatcagcgcggctcaggccaagtggggacctatggattgaacacttttaccaatatggaagcgcagctcatccgtcagatggagggtgaaggcgtcctgagcaaggccgacctagagaacccacatcttcccgaaaaaaagattacacagtggctggagacgaaaggggtggagcggctcaagagaatggctatatcgggagatgactgcgtggtcaagcctatcgatgacaggttcgccaacgcactgttggctttaaatgatatgggcaaagttcgcaaggacattccacaatggcagccgtctaaaggttggcacgattggcagcaggtgcccttttgtagtcatcacttccacgaactgatcatgaaggacgggcgaaaactcgtagtgccttgccggccacaagacgagcttattggaagagccaggatctcccagggcgcaggctggagcctgaaggaaaccgcctgtctagggaaggcgtacgctcagatgtggtcactgatgtatttccatcgcagagatctccggttggcctccaacgcaatatgctctgccgtccccgtgcactgggttcctactagcaggacaacctggagtatccatgctcaccatcaatggatgactacagaggacatgctgaccgtgtggaatcgtgtctggattgaagataacccatggatggaggacaaaacgcccgtgacaacctgggagaatgtaccttaccttggaaagcgagaagatcagtggtgtggttccctgatcggcctcactagccgcgccacctgggcacagaacattccgacagctatccagcaagttagatctttaattgggaatgaggaatttctggactacatgccatcaatgaaacggttcaggaaggaggaggaaagtgagggagccatatggtga

SEQ ID NO: 15311 - RNA, 9873 nt, synthetic construct
  misc_feature 1..9873: note = derived and/or modified CDS sequence (opt3) from DENV-3__JF920402__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcagaattcagggggaactagtatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtacaagaaggggagcagtattggaaaaatgtttgaagctactgcccgcggtgcaagaaggatggccatactgggcgacaccgcttgggatttcgggtctgtgggaggcgttctcaactccctgggtaagatggtgcatcagatctttgggagcgcctatacggcacttttctcgggcgtctcttgggtgatgaaaattggaatcggcgtactgttgacatggatcgggctcaattccaagaacacctcaatgagttttagctgcattgcgataggaatcattactctgtacttaggcgctgtggttcaggccgacatgggttgtgtcatcaattggaaagggaaggagctgaagtgcggatccggcattttcgtgacaaacgaggtgcacacctggactgaacagtataaatttcaagcagattctcccaagcggctagccaccgctatcgccggtgcatgggagaatggcgtctgtgggatacgaagcacaacgcgcatggaaaacctcctgtggaaacagatcgctaatgagcttaactacattttgtgggaaaataacatcaagctgaccgttgtggtgggagacattatcggcgtactcgagcaggggaaaagaactctgacaccacagcctatggagttaaagtattcatggaaaacctggggaaaggccaagatagtcacagcggaaactcaaaacagttccttcattatcgatggccccaataccccagagtgccccagcgtgtctagggcctggaacgtttgggaagtggaggactacggttttggggtcttcacgacaaatatttggctgaaacttcgggaagtgtatacccagttgtgtgaccaccgcctcatgtcagctgcagttaaggatgagagagccgtgcatgctgacatgggatactggatcgagagtcagaaaaacggcagctggaagctggaaaaagcctccctaatagaggtaaagacttgcacctggcctaagtctcacacactgtggtcgaatggtgtcctcgaaagcgatatgatcattccaaaatccctggcaggcccgatctcacagcataaccacaggcccgggtaccacactcaaaccgcgggaccttggcatcttggcaagttggagctggactttaattattgcgaggggacaacggtggtgattaccgaaaactgtggagcccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagatctatcagctttggacagccctgatatccttgacttgttcaaacaccatcttcacgctcacagtggcttggcgaaccgcaactctgattctagccggtgttagtctgcttcctatgtgccaaagctcgtccatgcggaagaccgactggctcccaatggcggtggctgccatgggcgtcccccctctgcccttgtttatcttctctctgaaggatacattaaaacgtagaagctggccactcaatgagggggtaatggcagtgggactggtttcaattcttgccagttccctgttgaggaacgacgtgcctatggctggccccctcgtcgcaggtgggctgctaatcgcctgttacgtgataactggaacctctgcggatctgacggtagaaaaggctgccgacattacatgggaggaagaggcagaacagaccggcgtgagccataaccttatgatcactgtcgacgatgacggcacaatgcgcatcaaagatgacgagaccgagaatattctcactgttctgttgaagacagccttactgatagtgtccgggatctttccatattcaattccggctaccctcctggtgtggcacacgtggcagaaacagactcaacggagcggagtcctttgggatgtgcctagtcccccagaaacccagaaggccgagctggaagagggtgtttacagaatcaaacagcagggcattttcgggaagacacaagtaggagtgggcgtccagaaggagggtgtgtttcacaccatgtggcatgttacaaggggggcagtgttgacttacaacggaaaacgactagaacccaattgggcttctgtcaagaaagacctgatctcctatggcggcgggtggcgcctcagcgcccagtggcaaaagggagaggaagtgcaggtaatagcggtcgagcctggtaaaaacccaaagaatttccagaccatgcccggcacgttccagacaactaccggggaaatcggagccattgcactggattttaagcctggcacatcgggttcaccgatcattaaccgggaggggaaagtggttggactttacggcaatggcgtggtcaccaagaacgggggatatgtgtctggtatcgctcaaactaatgccgagccagacggccccacccctgaattagaggaagagatgttcaaaaagagaaacctgacaataatggatctccacccagggagtggaaaaacgaggaagtacttgcccgctattgttcgtgaagcaatcaagcgccggctgagaactctcatcctggcccctaccagggtggtcgccgctgagatggaggaagcgcttaaaggcctgccgattcgatatcagacaaccgcaactaagtccgagcatacaggtcgggaaatcgtggacttgatgtgccacgccacctttacgatgcgcctactgagccccgtaagagtgccaaattacaacctcataattatggatgaggctcatttcactgaccctgcctctatcgcagccagggggtatattagcacacgggttggaatgggcgaagctgcggccatctttatgaccgcaacccccccaggcactgctgatgccttccctcagtccaatgcacccatacaggacgaggagcgagacattccagaaagatcatggaacagtgggaatgagtggatcacagattttgccggaaaaaccgtctggttcgtgccgagcatcaaggctggtaacgacattgccaactgtttacgcaaaaatggcaagaaggtgatccaactgtctaggaaaacatttgatactgaataccagaagacgaaacttaacgactgggatttcgtcgtaaccacagacatttccgagatgggggcgaattttaaggcagatcgtgtgatagaccctcggagatgcctgaaacccgttatcctcactgatggaccagagagggtgattttggccggccccatgcctgtcaccgctgcctcagctgcacagcgccgaggtagagtggggcggaacccacagaaggaaaatgaccaatacatcttcacaggccagcccctgaacaatgatgaggaccacgcccactggaccgaagctaagatgctcctggacaacatcaatactcctgagggaattataccggcccttttcgaaccagagagggagaaaagtgcagcgatcgatggcgaatatcgcctaaagggggagagccgtaaaacgtttgttgaactgatgagacggggagacttgcccgtgtggttagcccataaggtcgcttccgagggtattaaatacaccgataggaagtggtgcttcgacggccagcgcaacaatcagatcctggaagagaacatggatgtggagatttggacaaaagaaggggagaagaagaaactccgacctagatggctggacgcccggacttattctgatccccttgcactgaaggaatttaaagagttcgctgccggaaggaagtcgatcgcactcgacttggtaaccgaaataggccgcgtgccaagccacctggcccatagaacaaggaatgctctagataacctggttatgctccacacctcagagcacggtgggcgggcgtaccgtcatgccgtcgaggaacttcctgagactatggaaacactgttattgctgggcctcatgatcctgcttacgggaggcgcaatgctgtttctcatttccgggaaaggaatcggtaagaccagtattggcttgatctgtgtgatagcttctagcgggatgctgtggatggccgagattcccttacaatggatcgcctccgcaattgtgctagagttctttatgatggtcctgctcatcccagaacctgagaagcagcgcactccgcaggacaatcaacttgcttatgttgtgataggaatcctgacattggccgcgattatcgctgccaacgaaatgggcctgctcgagaccaccaaacgagatctgggtatgtcaaaggaacccggggtagtgtctccaacaagctaccttgacgtcgatctccaccctgcaagtgcctggactctgtatgctgtggcaacgaccgttattacacccatgttgagacatactatcgagaattccaccgccaacgtgagcctggcggctatagccaaccaggcagtcgtattaatgggcctagacaaaggatggccaatttctaagatggacctgggcgtgcctctccttgccctggggtgctactcacaggttaatcccttgacactgaccgctgccgtgctcctgcttatcactcactacgcaatcattggaccgggcttacaggctaaagccacgagggaggcgcaaaagcggacagccgcaggtatcatgaagaacccaaccgtcgatgggataatgactattgacctggatcctgtgatctatgactccaaattcgaaaagcagctcggacaggtcatgttgctggtgctatgtgttgtgcagctgctccttatgcgcaccagttgggctctgtgcgaggccttgacactggcaactggccccattaccacactctgggaaggtagcccaggcaaattttggaatacgaccatcgctgtatcgatggccaacatattcagagggtcttacctggccggagcgggcttagctttttccatcatgaagagcgtggggactggaaaaaggggcacaggttcacaaggggagacccttggagaaaagtggaagaaaaagctgaatcagctcagtcggaaagatttcgacctatataagaaatctggcattactgaggtcgatcgaacagaggcaaaggaaggtctgaaaagaggcgagatcacccatcacgccgtttcccgcgggagcgctaagttgcagtggtttgtggaaaggaacatggtcattcccgagggacgggtgatcgacctgggctgtgggcgtggaggctggtcatactattgcgccggtctcaagaaagtaacggaagtgagagggtacaccaagggaggccctggccacgaggagccggttcccatgagtacatatgggtggaatattgtgaaacttatgagcggaaaggatgtcttctacctgccacctgaaaaatgtgacactttgctgtgcgatatcggtgagtcctctcccagccctaccgtggaagagtccaggacaatacgcgtcctcaagatggtggagccatggttaaagaacaatcagttctgtattaaagttctgaacccctacatgcctactgtaatcgaacatcttgagcggctgcaacgaaagcacggcgggatgctagtgagaaatccactctcaaggaactctacccatgaaatgtattggatcagtaatggaacaggcaacattgtcgcatcggtgaatatggttagccgcctgttgctgaaccggtttaccatgactcacagacgtcccacgatagagaaagacgtggatctcggtgccgggacaaggcacgtcaacgctgaaccggagacccctaatatggacgtgatcggagagcggattaagcgcatcaaagaagagcataactccacttggcactacgacgatgaaaatccatataagacctgggcgtaccatggctcttatgaggtaaaggccacaggctcagcaagctccatgattaacggggtggttaaacttctgacgaagccctgggacgtcgtgcctatggtgacccagatggctatgactgatacaaccccattcggacagcaacgagtctttaaagaaaaggttgacactagaacacccaggagtatgccgggtacccggcgcgtgatgggcatcacagccgagtggttatggagaactctggggaggaataaaaagcctcgattgtgcacccgggaggaattcacgaagaaagtacgtaccaacgcagccatgggagctgtgtttacagaggaaaatcagtgggattctgccaaggcggcagtcgaggacgaagatttctggaaactcgtggacagagagcgcgagctgcacaagctaggcaaatgtggtagctgcgtttacaacatgatggggaagagggaaaaaaagcttggagagtttggcaaggccaaaggctcacgggctatatggtatatgtggctgggggccagatacctcgaattcgaggcactgggatttttgaatgaggatcattggttctcccgcgaaaacagttacagcggtgtggagggcgaagggctgcacaagctcggatatatccttagggacatttctaaaatccccggcggtgctatgtacgccgatgacactgctgggtgggacacccgaattacagaggatgacctgcacaatgaagagaagatcactcagcagatggatccagagcatcggcaattagccaacgcaatatttaaactgacctatcagaataaggtcgtgaaggtacagagacctacgcccacaggaaccgttatggacattatctccaggaaagatcagcgcggctcaggccaagtggggacttacggattgaacacattcaccaatatggaagcgcagctcatccgtcagatggagggtgaaggcgtcctgagcaaggccgacctagagaacccacaccttcccgaaaaaaagattactcagtggctggagaccaaaggggtggagcggctcaagagaatggctatatcgggagatgactgcgtggtcaagcctatcgatgacaggtttgccaacgcactgttggctttaaatgatatgggcaaagttcgcaaggacattccacaatggcagccgtctaaaggttggcatgattggcagcaggtgcccttctgtagtcaccacttccatgaactgatcatgaaggacgggcgaaaactcgtagtgccttgccggccacaagacgagcttattggaagagccaggatctcccagggcgcaggctggagcctgaaggaaacagcctgtctagggaaggcgtatgctcagatgtggtcactgatgtactttcaccgcagagatctccggttggcctccaacgcaatatgctctgccgtccccgtgcattgggttcctacgagcaggaccacttggagtatccacgctcatcaccaatggatgacaaccgaggacatgctgactgtgtggaatcgtgtctggattgaagataacccatggatggaggacaaaacacccgtgaccacgtgggagaatgtaccttatcttggaaagcgagaagatcagtggtgtggttccctgatcggcctcacaagccgcgccacctgggcacagaacattccgactgctatccagcaagttagatctttaattgggaatgaggaattcctggactacatgccatcaatgaaacggtttaggaaggaggaggaaagtgagggagccatatggtga

SEQ ID NO: 15312 - RNA, 9873 nt, synthetic construct
  misc_feature 1..9873: note = derived and/or modified CDS sequence (opt3) from DENV-3__JF937652__SS-prME
  source 1..9873: mol_type = other RNA
acaagcctgtgcctcatgatgatccttcccgcagctctggcattccacttgacatccagagacggcgagcctaggatgattgtggggaagaatgaacggggaaaatctttactgtttaagactgcctcaggtataaatatgtgtacgctgatcgcgatggatctcggcgagatgtgcgacaacaccgtcacatacaaatgtccacatattactgaagttgagccggaagatatcgactgctggtgtaatctgaccagtacatgggtgacctatgggacttgcaaccaggctggagagcaccgccgagataagcgtagcgtagcccttgcaccccatgtgggcatgggtctggacacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaatagagattttgttgaaggattgtcaggtgccacctgggtggacgtcgtgctggagcacggcgggtgcgtgacgactatggcgaagaacaaacccacactagatattgagctccagaagaccgaagcaactcaactggccacacttaggaaactgtgtatcgagggaaagattaccaatatcacgaccgacagccggtgccctacacagggcgaagctactttgccagaggaacaggatcagaactatgtctgtaaacacacctacgttgaccgcggttgggggaatggatgcggcctcttcggcaaggggagtctggtgacatgcgccaagtttcaatgtttagagcccatagagggaaaagtagtgcagtatgaaaacctgaagtacactgtcattatcaccgtgcatacaggtgatcagcaccaggttggcaatgagacccaaggggtgactgcagaaattacgcctcaggcttccacaaccgaggccgtcctcccagaatatggaactcttggcctggagtgctctccgcgaaccggtttggacttcaacgagatgatcctactgacaatgaaaaataaggcgtggatggtgcatagacagtggtttttcgacctccccctgccttggaccagcggggccactacagaaacgccaacctggaacaggaaagagcttctggtaacttttaagaatgcacacgctaaaaagcaagaagttgtggtcttgggctcccaggagggagccatgcacacagctctcaccggcgccacagaaatccagaactcagggggaacaagtattttcgcaggtcatctgaagtgtcggttaaaaatggataagctggagctaaaaggcatgagctacgccatgtgcaccaacacgtttgtgctcaagaaagaggtctctgaaacccagcacgggacaatactgatcaaggtggagtacaagggagaagacgttccctgtaaaattcctttctccactgaggatggccaaggtaaggctcataatgggcgtcttatcaccgcgaacccagtggtaactaagaaggaggaattggtcaatatagaggcagaacccccgttcggcgagtcaaacattgtgatcggaatcggcgacaatgccctgaaaattaactggtataagaaggggagcagtatcggaaaaatgtttgaagctactgcccgcggtgcaagaaggatggccattctcggcgataccgcttgggacttcgggtctgttggaggcgtgctaaattcccttggtaagatggtccaccagatatttgggagcgcctacacggcactgttctcgggcgtgtcttgggtaatgaaaatcggaattggcgtgttgctcacatggatcgggctgaactccaagaatacctcaatgagttttagctgcatcgcgattggaataatcactttatatctgggcgctgttgtccaggccgatatgggttgtgtgattaactggaaagggaaggagctaaagtgcggatccggcatcttcgtgacaaatgaggtccatacctggactgaacagtacaaatttcaagcagactctcctaagcggctcgccaccgctattgccggtgcatgggagaacggcgtttgtgggatccgaagcacaacgcgcatggaaaatctgctttggaaacagatagctaacgagttgaattatatcctgtgggaaaacaacattaagctcaccgtggtggtaggagatatcattggcgtcctggagcaggggaaaagaactttaacaccccagccaatggagctgaagtactcatggaaaacctggggaaaggccaagatcgtgacagcggaaactcaaaatagttccttcataattgacggccctaacacccccgagtgcccaagcgtttctagggcctggaatgtgtgggaagtcgaggattatggttttggggtgttcacgacaaacatctggcttaaattgcgggaagtttacacccagctctgtgaccaccgcctgatgtcagctgcagtgaaggacgagagagccgtacacgctgatatgggatactggattgagagtcagaaaaatggcagctggaagctagaaaaagcctccctgatcgaggtcaagacttgcacctggcccaagtctcatacactctggtcgaacggtgtgctggaaagcgacatgataatccctaaatcccttgcaggcccaatttcacagcacaattataggccggggtaccatactcaaaccgcgggaccctggcacttgggcaagctggagttagattttaactattgcgaggggacaacggtggtcatcaccgaaaattgtggaactcgtggccctagtctccggacaaccactgtttctggtaaactgattcacgagtggtgctgtcgaagctgcacacttccacccctgagatacatgggggaagacggatgttggtatggcatggagatcaggcctatatccgaaaaggaggagaacatggtgaaatcattggtaagcgccggttctggcaaggtggataatttcaccatgggggtcctctgcctggctattctatttgaagaggtgatgcgcggaaagctgggcaaaaagcatatgatcgccggggttttcttcacgtttgtgctcctgctttccggacagatcacttggcgggacatggcacacaccttgattatgatcggcagtaacgctagcgatagaatgggtatgggggtcacatacctggccttaattgcaaccttcaaaatacagccatttctcgccctgggattctttcttaggaagctgacttctcgcgaaaatctactcctgggcgtgggcttggctatggcgacaaccctgcaattacccgaggacatcgaacagatggccaacgggattgcactcggactgatggctcttaaactgatcacacagttcgagacttatcagttgtggaccgccctcatttccctgacgtgttcaaatacaatctttaccctaactgttgcctggcgaaccgctacactgatacttgccggtgtgagtctcctgccggtctgccaaagctcgtccatgcggaagactgattggttgcctatggccgtagcggctatgggcgtgccacccctgcctttattcatctttgggctcaaggacaccctgaaacgtagatcttggccccttaacgagggagttatggccgtgggcctggtcagcattttggcatcaagtctcctgaggaacgatgtgccaatggccggtcctctagtagctgggggactgcttatcgcatgttacgtgattacgggcacatccgccgacctcaccgtcgaaaaggcggctgatatcacttgggaggaagaggccgaacagacaggcgtttctcataatctgatgataaccgtggacgacgatgggactatgcgcattaaagacgatgagacagagaacatcttgaccgtgttactgaagacggcactcctgatcgtcagcggaattttcccctactccataccagccactcttctggtgtggcacacctggcagaaacagacacaacggtcaggtgttttgtgggacgtaccgagccctcccgaaacccagaaggctgagctagaagagggcgtgtatagaatcaaacagcaggggatttttggaaagacacaagtcggcgtgggtgttcagaaggagggggtgttccatactatgtggcacgtcaccaggggagccgtgctgacgtacaatggcaaacgactcgaaccaaactgggcaagtgtaaagaaagatctgatctcttatggcgggggatggcgcctttccgctcagtggcaaaagggtgaggaagtccaggtgattgccgttgagcccggcaaaaatcctaagaactttcagacaatgccagggactttccagaccacaaccggagaaatcggcgcgatagccttagacttcaagcccggtactagcgggtcgcctatcattaatcgggagggaaaagtggtcggcctgtacggcaacggggtggttaccaagaatggaggttatgtgtcaggcatcgcacaaacaaacgctgagccggatgggccaacgcccgaactcgaggaagagatgtttaaaaagagaaatttgactattatggacctgcaccctggatctggcaaaaccaggaagtacctcccagccatcgtccgtgaagctataaagcgccggctgagaacacttattctggcacccaccagggtggtagccgccgagatggaggaggctttgaaaggtctacctatccgatatcagactacagcgaccaagagtgaacatacggggcgggaaatcgtggatctgatgtgccacgcaactttcacaatgcgcctcttatccccggttagagtccccaactacaatctgattatcatggacgaggcccattttaccgatccagctagcatagccgcaaggggatacatttctacccgggtgggcatgggcgaagccgctgcgatcttcatgactgccacacctcccgggaccgcagacgcttttccacagagcaacgcccctattcaggatgaggagaaagacatccccgaacgatcctggaactcaggaaacgagtggataacagacttcgcaggtaagactgtgtggtttgtcccaagtattaaagccggcaacgatatcgctaattgtcttagaaagaacgggaagaaagtaatccaactgagccgcaagacgttcgacaccgaatatcagaaaacaaagctcaatgattgggactttgtggttactaccgatatttctgagatgggagccaacttcaaagcggacagggtgatcgatccgcgtcggtgcttgaagcctgtcattctgacagacggccccgagagagtgatactcgcaggtccaatgcccgttaccgccgcttccgccgctcagaggcgcgggcgagtgggcagaaatcctcagaaggaaaacgatcaatacatctttactggacagccactgaataacgacgaggatcacgcacattggacggaagccaaaatgcttctagacaatattaacacccccgagggcatcatccctgctctgttcgaaccggagcgggagaagtcagccgcaattgacggggaatataggttgaaaggagagagtcgcaagacattcgtcgaattaatgcgtagaggtgatctgccagtgtggctcgcgcacaaagtagccagcgagggcataaagtacactgaccggaaatggtgctttgatgggcagaggaataaccagatcctggaagagaatatggacgtggagatttggaccaaggaaggagagaagaagaaacttcgcccccgatggctggatgctagaacatattccgaccctctcgccttgaaagagttcaaagagtttgcagctggccggaaatctatcgccctggatctagttaccgaaattggtagggtcccctcgcacctggcacatcgcactagaaacgccctcgacaatcttgtgatgctgcacacaagcgagcatgggggcagggcttaccggcacgcggtggaggaattaccagagacgatggaaaccttgctgctcctgggacttatgatcctgctcactggcggggccatgttgttcctgatatcaggaaagggtatcggcaagacatccattgggttaatctgtgtcattgcaagttctggaatgctatggatggctgagatccctctgcaatggatagccagcgccattgttctcgagtttttcatgatggtgcttctgatccccgaaccagagaaacagcgtacccctcaggataaccaattggcatatgtagtgattggcatcctgaccctcgctgccataatcgcggctaatgaaatgggtctgcttgagacaactaagcgcgacctcgggatgtccaaagaaccgggcgtcgtgtcacccacgtcttacctggatgttgacttgcacccagccagcgcatggaccctgtacgccgtggctacaactgtcattacccctatgttacgacatacaatcgagaacagtaccgcaaacgtatccctagccgcgattgctaatcaggccgtggttctgatgggactcgataagggctggcccatcagcaaaatggaccttggggtgccactgttggcactgggatgctattctcaggtcaaccctctcactctgacggccgctgtgcttttactgataacacactacgccattatcggccccggtctccaggcaaaggctaccagagaggcccaaaagaggactgcggccgggatcatgaaaaatccgaccgtcgacggaattatgacaatcgatttggacccagtgatatatgattcaaagtttgaaaaacagctgggccaggttatgctactggtgctctgtgcagtacagcttctgttgatgcggacttcctgggctctgtgcgaggccctcaccctggcaacaggtcctattacgaccttatgggaaggcagtcccgggaagttctggaacactacaatcgctgtgagcatggccaatatttttcgcggatcgtaccttgccggcgcggggctggctttctctatcatgaaatccgtcggaaccggcaagagaggtactgggagccaaggagagacactcggcgaaaagtggaaaaagaaactaaaccagctgtcaaggaaggactttgatttgtataaaaagagtggtataaccgaggttgaccggacggaggcaaaagaaggcctgaagcgaggggagatcacccatcacgccgtgtctagaggatccgctaagctccagtggttcgtcgaacgcaatatggtgattccagagggcagggtaatcgatcttgggtgtggacggggcggttggagctactattgcgccgggctgaaaaaggtgacagaagttcgtggatacactaaaggcggccccgggcatgaggagcctgtgccgatgtcaacctacggatggaacattgtcaagttgatgagtggtaaagacgtgttttatctgcccccagaaaagtgtgatacactcttatgcgacatcggcgagagctccccttctcccactgtcgaagagagcagaaccattagggtgctgaagatggttgagccttggcttaaaaataaccagttctgtatcaaggtactgaatccatacatgcccacagtgatagaacacctagagcgcctccaacggaaacacgggggaatgctggtccgaaaccctttgtccagaaattcaacccatgaaatgtattggatttctaacggcactggtaatatcgtggcaagtgttaacatggtgtcgaggctgctccttaaccgcttcacgatgacacaccggagaccaaccatcgagaaggatgtcgacctgggggccggaactcgtcatgtgaatgctgaacccgagaccccgaacatggatgtaattggcgagaggataaaacggatcaaggaagaacacaatagcacatggcactacgacgacgaaaacccttataagacgtgggcgtaccatggctcctatgaggtgaaagccaccgggtctgcatcaagcatgattaatggagttgtcaagttactgactaaaccatgggatgtggtgcccatggtcacacagatggctatgaccgacactacaccttttggtcagcaacgcgttttcaaggaaaaagtggatacccgaacaccaagatccatgcccggcactaggcgggtaatggggatcaccgccgagtggttgtggcgcacgctcggaagaaacaagaagccgaggctgtgcacccgagaggaatttaccaaaaaggtgcggactaatgcagccatgggcgctgtcttcaccgaggaaaaccagtgggacagtgccaaagcggcagtggaggatgaagacttttggaagctagttgatcgtgagagagagcttcacaaactgggtaagtgtgggtcttgcgtgtacaatatgatgggaaaacgcgaaaagaagctcggcgagttcggcaaagccaaggggagcagggctatttggtacatgtggctgggagcccggtatttggaatttgaggcactgggtttcctcaacgaggaccattggttttcaagagaaaattcctacagtggcgtcgagggggaaggacttcacaaactgggctatatcttacgcgatataagcaagatccctggtggggctatgtacgccgacgatacagctggatgggacactaggattaccgaggacgatctgcataacgaagagaaaatcacgcagcagatggaccccgagcaccgacaattggccaatgcaattttcaagctcacatatcagaacaaggtggtaaaagttcagcggccaacccctactggcacagtgatggatatcatatctagaaaggaccagaggggctccgggcaagtcggaacctacggtctgaatacttttaccaacatgggcgcgcagctaattcgccagatggaaggggagggagtgctttcaaaagccgatctggaaaacccccacctcccagagaagaaaatcacacagtggctggaaacgaagggcgtggagcgtttgaagcggatggctatcagcggtgacgattgcgtcgttaaacccattgacgatagattcgccaatgcattactggctctcaacgacatggggaaggtgaggaaagatatacctcaatggcagccatcgaagggatggcatgactggcagcaggtaccgttttgttctcaccatttccacgagcttatcatgaaagatggccgcaagctggtggtcccctgccgacctcaagacgaactaattggccgggccagaatcagtcagggggcaggatggtccctgaaggagaccgcctgtctcggtaaagcgtatgctcagatgtggagcttgatgtacttccacaggcgcgacctgagacttgcctcaaatgcaatttgctccgccgtgccagttcattgggtgcccacttctcggacaacctggagcatccacgctcatcaccaatggatgactacagaagatatgctgaccgtctggaacagggtgtggatagaggacaatccttggatggaagataagacgccagtaacaacctgggagaacgttccctacctcggcaaacgtgaggaccagtggtgtgggagtttaatcggactgacttcccgagccacctgggcacagaatattcctacagctatccagcaagtgcgcagcttgattggcaacgaagagtttctggattatatgccgtctatgaagagattccggaaagaagaggagtcagaaggtgccatctggtga

SEQ ID NO: 15313 - RNA, 9873 nt, synthetic construct
  misc_feature 1..9873: note = derived and/or modified CDS sequence (opt3) from DENV-3__JF920404__SS-prME
  source 1..9873: mol_type = other RNA
accagcctgtgcctcatgatgatccttcccgcagctctggcattccacttgacttccagagacggcgagcctagaatgattgtggggaagaacgaacggggaaagtctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagcatattcgcaggtcatctgaagtgtcggttaaaaatggacaagctggagctaaaaggcatgagctacgccatgtgcaccaacgcttttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgccggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgtgtctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggtgttctttaccttcgttctactgctctccggacagattacgtggcgggatatggctcatactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatggcggtcgctgccatgggcgtaccccctctgcccttgtttattttcgggctgaaggatactttaaaacgtagatcttggccactcaatgagggagtgatggcagttggcctggtgagcatccttgcctcaagtctgttgaggaacgacgtccctatggctggtcccctcgtggcagggggactgctaattgcctgttatgtaatcaccggcacgtccgcggatctgacagtggaaaaggctgccgacataacctgggaggaaggcgcagagcagactggggtctctcacaaccttatgattacagttgacgatgacggaaccatgcgcatcaaagatgacgaaactgagaatatcctcacagtgctgttgaagaccgccttactgattgtgagcggtatatttccatactccatcccggctacgctcctggtctggcatacttggcagaaacagacccaacggtcaggcgtgctttgggatgttcctagtcccccagagacacagaaggccgaactggaggaaggggtatacagaattaaacagcagggaatcttcggcaagacccaagtgggtgtcggggtgcagaaggagggagtttttcacacaatgtggcacgtgactaggggcgcagtcttgacctataacggcaaacgactagagcccaattgggctagtgtgaagaaagacctgatttcttacgggggaggttggcgcctctccgcccagtggcaaaagggcgaagaggtacaggtcatcgcggtggaacctgggaaaaacccaaagaatttccagacgatgcccggaacattccagactaccacaggcgagataggtgccatcgcactggattttaagcctgggaccagcggatcgccgattatcaaccgggaaggcaaagttgtgggcctttatgggaatggagtcgtgactaagaacggtggctacgtttcagggattgctcaaaccaatgccgagccagacggacccacacctgagttagaagaggaaatgttcaaaaagagaaacctgacgatcatggatctccatccaggctctggtaaaactaggaagtatttgcccgctatagtgcgtgaggcaattaagcgccggctgagaaccctcatcctggcccctacaagggtcgtggccgctgaaatggaggaggcgcttaaagggctgccgatccgataccagaccactgcaacaaagagtgaacacaccggacgggagattgtagacttgatgtgccatgccacgtttactatgcgcctactgtcccccgtgagagttccaaattataacctcatcataatggatgaagctcacttcacagaccctgccagcattgcagccaggggctacatctctacccgggtcggcatgggggaggctgcggccatttttatgaccgcaactcccccaggaacagctgatgccttccctcagagcaatgcacccatccaggacgaagaacgagacataccagagagatcctggaactcaggtaatgaatggattaccgattttgccggcaaaacagtgtggttcgtgccgagtatcaaggctgggaacgacatcgccaactgtttacgcaaaaatggaaagaaggtcattcaactgagcaggaaaacttttgatacggagtaccagaagaccaaacttaacgactgggatttcgtagtgacaactgacatctctgaaatgggcgcgaattttaaggcagatcgtgttattgaccctcggagatgcctgaaacccgtgatactcaccgatggtccagagagggtcatcttggccgggcccatgcctgtgacagctgcctccgctgcacagcgccgaggcagagttggacggaacccacagaaggagaatgaccaatatattttcaccggccagcccctgaacaatgatgaagaccatgcccactggactgaggctaagatgctcctggacaacatcaatacgcctgaagggatcattccggcccttttcgagccagaaagggagaaatcagcagcgatagatggagagtaccgcctaaagggtgaaagtcgtaaaacctttgtggagctgatgagacggggcgacttgcccgtctggttagcccacaaggtggctagcgaagggatcaaatatacagataggaagtggtgcttcgacggacagcgcaacaatcagattctggaggaaaacatggatgtagagatctggactaaagagggcgaaaagaagaaactccgacctagatggctggacgcccggacctactccgatccccttgcactgaaggagtttaaagagttcgctgccggtaggaagtctattgcactcgacttggtgacagagatcgggcgcgttccatcgcatctggcccacagaaccaggaatgctctagataacctggtcatgctccatactagcgaacacggcggacgggcgtatcgtcacgccgtggaggagcttcctgaaacaatggagacgctgttattgctgggcctcatgatactgcttaccgggggagcaatgctgtttctcatctcaggtaaaggcattgggaagacttccatcggattgatttgtgtgatcgctagttctggcatgctgtggatggccgaaatacccttacaatggattgccagcgcaatcgtcctagagttctttatgatggttctgctcattccagagcctgaaaagcagcgcacaccgcaggacaatcaacttgcttacgtggtaatcggtatactgaccttggccgcgatcattgctgccaacgagatggggctgctcgaaaccacaaaacgagatctgggcatgtccaaggagcccggagtggtctcaccaacttcttatcttgacgtggatctccatcctgcaagcgcctggacgctgtacgctgttgcaaccacagtgatcactcccatgttgagacacaccattgaaaatagtacagccaacgtctccctggcggctatcgccaaccaggcagtagtgttaatgggcctagacaaagggtggccaataagcaagatggacctgggagttcctctccttgccctgggctgctactctcaggtgaatcccttgaccctgactgctgccgtcctcctgcttattacgcattatgcaatcatcggtccggggttacaggctaaagccacaagggaggcgcaaaagcggaccgccgcaggaattatgaagaacccaactgtggatggcatcatgaccatagacctggatcctgtcatttacgactcaaaattcgagaagcagctcggtcaggtgatgttgctggttctatgtgctgtgcagctgctccttatgcgcacatcctgggccctgtgcgaagcattgactctggctaccggccccatcacaacgctctgggaggggagtccaggaaaattttggaataccactattgccgtaagcatggccaacatcttcagaggctcgtatctggcgggggctggattagcattttctataatgaagtccgtgggcacaggtaaaagggggaccggaagccaaggcgaaactcttggtgagaagtggaagaaaaagctgaatcagctctcacggaaagatttcgacctatacaagaaaagtggcatcacagaagtcgatcgaaccgaggccaaggaggggctgaaaagaggagaaattacgcaccatgctgtttctcgcggctccgccaagttgcagtggtttgtggagaggaacatggtcatccccgaagggcgggtgattgacctgggatgtggccgtggtgggtggagctattactgcgcaggactcaagaaagtaaccgaggtgagaggctatacaaagggcgggcctggacacgaggaaccggttcccatgtcaacttacggttggaatatcgtgaaacttatgagtggcaaggatgtcttctacctgccacctgagaaatgtgacaccttgctgtgcgatattggggaaagctccccctctcctacagtggaggaaagcaggactatccgcgtcctcaagatggtggagccatggttaaagaacaatcagttctgtataaaagttctgaacccctatatgcctaccgtaattgagcaccttgaacggctgcaacgaaagcatggaggcatgctagtgagaaatccactctccaggaactcaacacacgagatgtactggatctctaatggtaccgggaacatcgtcgccagtgtgaatatggtttcgcgcctgttgctgaaccggtttactatgacgcatagacgtcccacaattgaaaaagacgtggatctcggagctggcaccaggcacgtcaacgcggagccggaaactcctaatatggacgtgataggcgagcggatcaagcgcattaaagaggaacacaacagcacctggcattatgacgatgagaatccatacaagacatgggcctatcacgggtcctacgaagtaaaggcaacgggatctgcttcaagcatgatcaacggtgtggttaaacttctgaccaagccctgggacgtcgtgcctatggtgactcagatggccatgacagataccactccattcggccagcaacgagtctttaaagagaaggttgacacaagaacccccaggtccatgccggggacacggcgcgtgatgggaattactgcagaatggttatggagaaccctgggcaggaataaaaagcctcgattgtgcacgcgggaggagttcaccaagaaagtacgtacaaacgccgctatgggtgccgtgtttactgaagagaatcagtgggatagtgcgaaggcagccgtcgaagacgaggatttctggaaactcgtggacagagaacgcgagctgcataagctagggaaatgtggatcttgcgtttataacatgatgggcaagagggagaagaaacttggcgaatttgggaaagctaaaggaagccgggccatctggtacatgtggctgggtgcaagatacctcgagttcgaagctctgggctttttgaatgaggatcactggttctcacgcgagaactcctatagtggggtggaaggagagggcctgcataagctcggttacatacttagggacatcagcaaaattcccgggggagccatgtatgctgatgacaccgccggctgggacacacgaatcactgaagatgacctgcacaatgaggaaaagattacccagcagatggatccagagcaccggcaattagcaaacgcgatctttaaactgacgtaccagaataaggtcgtgaaggtacagagacctacacccaccggcactgttatggacataatttctaggaaagatcagcgcgggtccggacaagtgggtacatatggcttgaacaccttcactaatatggaggcccagctcatccgtcagatggaaggggagggagtcctgtcaaaggctgacctagaaaacccacatcttcccgagaaaaagatcacccagtggctggaaacaaaaggcgtggagcggctcaagagaatggccattagcggtgatgactgcgtggtcaagcctatagatgacaggtttgcaaacgctctgttggccttaaatgatatggggaaagttcgcaaggacatcccacaatggcagccgtcgaaaggatggcacgattggcaacaggtgcccttctgttctcatcacttccacgagctgattatgaaggacggccgaaaactcgtagtgccttgccggccacaagacgaacttatcggcagagcaaggattagtcagggggccggatggtccctgaaggagacggcgtgtctaggtaaggcttacgcccagatgtggagcctgatgtattttcatcgcagagatctccggttggcatcaaacgccatctgctccgctgtccccgtgcactgggttcctacctctaggactacatggagcatacatgcccaccatcaatggatgaccactgaagacatgctgacagtgtggaatcgtgtctggatcgaggataacccatggatggaagacaaaacccccgtgacgacatgggagaatgtaccttaccttggcaagcgagaggatcagtggtgtgggagtctgattggactcacctcccgcgcaacttgggctcagaacatcccgaccgccattcagcaagttaggagcttaatcggcaatgaagagttcctggactacatgccatctatgaaacggtttaggaaggaagaggagtcagaaggtgcgatttggtga

SEQ ID NO: 15314 - RNA, 9873 nt, synthetic construct
  misc_feature 1..9873: note = derived and/or modified CDS sequence (opt3) from DENV-3__JF937641__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacgcttttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgtgtctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggtgttctttaccttcgttctactgctctccggacagattacgtggcgggatatggctcatactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatggcggtcgctgccatgggcgtaccccctctgcccttgtttattttcgggctgaaggatactttaaaacgtagatcttggccactcaatgagggagtgatggcagttggcctggtgagcatccttgcctcaagtctgttgaggaacgacgtccctatggctggtcccctcgtggcagggggactgctaattgcctgttatgtaatcaccggcacgtccgcggatctgacagtggaaaaggctgccgacataacctgggaggaagaggcagaacagactggcgtctctcacaaccttatgattacagttgacgatgacgggaccatgcgcatcaaagatgacgagactgagaatatcctcacagtgctgttgaagaccgccttactgattgtgagcggaatatttccatactccatcccggctacgctcctggtctggcatacttggcagaaacagacccaacggtcaggtgtgctttgggatgttcctagccccccagaaacacagaaggccgagctggaagagggcgtatacagaattaaacagcaggggatcttcggaaagacccaagtgggcgtcggtgtgcagaaggagggggtttttcacacaatgtggcacgtgactaggggagcagtcttgacctataacggcaaacgactagaacccaattgggctagtgtgaagaaagacctgatttcttacggcgggggatggcgcctctccgcccagtggcaaaagggtgaggaagtacaggtcatcgcggtggagcctggcaaaaacccaaagaatttccagacgatgcccgggacattccagactaccacaggagaaataggcgccatcgcactggattttaagcctggtaccagcgggtcgccgattatcaaccgggagggaaaagttgtgggcctttatggcaatggggtcgtgactaagaacggaggttacgtttcaggcattgctcaaaccaatgccgagccagacgggcccacacctgaattagaggaagagatgttcaaaaagagaaacctgacgatcatggatctccatccaggatctggcaaaactaggaagtatttgcccgctatagtgcgtgaagcaattaagcgccggctgagaaccctcatcctggcccctacaagggtcgtggccgctgagatggaggaagcgcttaaaggtctgccgatccgataccagaccactgcaacaaagagtgagcacaccgggcgggaaattgtagacttgatgtgccatgccacgtttactatgcgcctactgtcccccgtgagagttccaaattataacctcatcataatggatgaggctcacttcacagaccctgccagcattgcagccaggggatacatctctacccgggtcggcatgggcgaagctgcggccatttttatgaccgcaactcccccagggacagctgatgccttccctcagagcaatgcacccatccaggacgaggagcgagacataccagaaagatcctggaactcaggaaatgagtggattaccgattttgccggtaaaacagtgtggttcgtgccgagtatcaaggctggcaacgacatcgccaactgtttacgcaaaaatgggaagaaggtcattcaactgagcaggaaaacttttgatacggaataccagaagaccaaacttaacgactgggatttcgtagtgacaactgacatctctgagatgggagcgaattttaaggcagatcgtgttattgaccctcggagatgcctgaaacccgtgatactcaccgatggcccagagagggtcatcttggccggtcccatgcctgtgacagctgcctccgctgcacagcgccgagggagagttggccggaacccacagaaggaaaatgaccaatatattttcaccggacagcccctgaacaatgatgaggaccatgcccactggactgaagctaagatgctcctggacaacatcaatacgcctgagggcatcattccggcccttttcgaaccagagagggagaaatcagcagcgatagatggggaataccgcctaaagggagagagtcgtaaaacctttgtggaactgatgagacggggtgacttgcccgtctggttagcccacaaggtggctagcgagggcatcaaatatacagataggaagtggtgcttcgacgggcagcgcaacaatcagattctggaagagaacatggatgtagagatctggactaaagaaggagagaagaagaaactccgacctagatggctggacgcccggacctactccgatccccttgcactgaaggaatttaaagagttcgctgccggcaggaagtctattgcactcgacttggtgacagaaatcggtcgcgttccatcgcatctggcccacagaaccaggaatgctctagataacctggtcatgctccatactagcgagcacgggggccgggcgtatcgtcacgccgtggaggaacttcctgagacaatggaaacgctgttattgctgggactcatgatactgcttaccggcggggcaatgctgtttctcatctcaggaaaaggtattggcaagacttccatcgggttgatttgtgtgatcgctagttctggaatgctgtggatggccgagatacccttacaatggattgccagcgcaatcgtcctagagttctttatgatggttctgctcattccagaacctgagaagcagcgcacaccgcaggacaatcaacttgcttacgtggtaatcggcatactgaccttggccgcgatcattgctgccaacgaaatgggtctgctcgagaccacaaaacgagatctggggatgtccaaggaacccggcgtggtctcaccaacttcttatcttgacgtggatctccatcctgcaagcgcctggacgctgtacgctgttgcaaccacagtgatcactcccatgttgagacacaccattgagaatagtacagccaacgtctccctggcggctatcgccaaccaggcagtagtgttaatgggactagacaaaggctggccaataagcaagatggacctgggggttcctctccttgccctgggatgctactctcaggtgaatcccttgaccctgactgctgccgtcctcctgcttattacgcattatgcaatcatcggcccgggtttacaggctaaagccacaagggaggcgcaaaagcggaccgccgcagggattatgaagaacccaactgtggatggaatcatgaccatagacctggatcctgtcatttacgactcaaaattcgaaaagcagctcggccaggtgatgttgctggttctatgtgctgtgcagctgctccttatgcgcacatcctgggccctgtgcgaggcattgactctggctaccggtcccatcacaacgctctgggaaggcagtccagggaaattttggaataccactattgccgtaagcatggccaacatcttcagaggatcgtatctggcgggcgctgggttagcattttctataatgaagtccgtgggaacaggcaaaaggggtaccgggagccaaggagagactcttggcgaaaagtggaagaaaaagctgaatcagctctcacggaaagatttcgacctatacaagaaaagtggtatcacagaggtcgatcgaaccgaggccaaggaaggcctgaaaagaggggagattacgcaccatgctgtttctcgcggatccgccaagttgcagtggtttgtggaaaggaacatggtcatccccgagggccgggtgattgacctggggtgtggacgtggcggttggagctattactgcgcagggctcaagaaagtaaccgaagtgagaggatatacaaagggcggccctgggcacgaggagccggttcccatgtcaacttacggatggaatatcgtgaaacttatgagtggtaaggatgtcttctacctgccacctgaaaaatgtgacaccttgctgtgcgatattggcgagagctccccctctcctacagtggaagagagcaggactatccgcgtcctcaagatggtggagccatggttaaagaacaatcagttctgtataaaagttctgaacccctatatgcctaccgtaattgaacaccttgagcggctgcaacgaaagcatgggggaatgctagtgagaaatccactctccaggaactcaacacacgaaatgtactggatctctaatggcaccggtaacatcgtcgccagtgtgaatatggtttcgcgcctgttgctgaaccggtttactatgacgcatagacgtcccacaattgagaaagacgtggatctcggggctggaaccaggcacgtcaacgcggaaccggagactcctaatatggacgtgataggcgagcggatcaagcgcattaaagaagagcacaacagcacctggcattatgacgatgaaaatccatacaagacatgggcctatcacggctcctacgaggtaaaggcaacggggtctgcttcaagcatgatcaacggagtggttaaacttctgaccaagccctgggacgtcgtgcctatggtgactcagatggccatgacagataccactccattcggtcagcaacgagtctttaaagaaaaggttgacacaagaacccccaggtccatgccgggcacacggcgcgtgatggggattactgcagagtggttatggagaaccctgggaaggaataaaaagcctcgattgtgcacgcgggaggaattcaccaagaaagtacgtacaaacgccgctatgggcgccgtgtttactgaggaaaatcagtgggatagtgcgaaggcagccgtcgaggacgaagatttctggaaactcgtggacagagagcgcgagctgcataagctaggtaaatgtgggtcttgcgtttataacatgatgggaaagagggaaaaaaagcttggcgagtttggcaaggctaaagggagccgggccatctggtacatgtggctgggagcaagatacctcgaattcgaggctctgggttttttgaatgaggatcactggttctcacgcgaaaactcctatagtggcgtggagggggaaggactgcataagctcggctacatacttagggacatcagcaaaattcccggtggggccatgtatgctgatgacaccgccggatgggacacacgaatcactgaggatgacctgcacaatgaagagaagattacccagcagatggatccagagcaccggcaattagcaaacgcgatctttaaactgacgtaccagaataaggtcgtgaaggtacagagacctacacccaccggcactgttatggacataatttctaggaaagatcagcgcggctccgggcaagtgggaacatatggtttgaacaccttcactaatatggaagcccagctcatccgtcagatggagggcgaaggggtcctgtcaaaggctgacctagagaacccacatcttcccgaaaaaaagatcacccagtggctggagacaaaaggagtggagcggctcaagagaatggccattagcggcgatgactgcgtggtcaagcctatagatgacaggtttgcaaacgctctgttggccttaaatgatatgggtaaagttcgcaaggacatcccacaatggcagccgtcgaaagggtggcacgattggcagcaggtgcccttctgttctcatcacttccacgaactgattatgaaggacggacgaaaactcgtagtgccttgccggccacaagacgagcttatcggcagagcaaggattagtcagggcgccgggtggtccctgaaggaaacggcgtgtctaggaaaggcttacgcccagatgtggagcctgatgtattttcatcgcagagatctccggttggcatcaaacgccatctgctccgctgtccccgtgcactgggttcctacctctaggactacatggagcatacatgcccaccatcaatggatgaccactgaggacatgctgacagtgtggaatcgtgtctggatcgaagataacccatggatggaggacaaaacccccgtgacgacatgggagaatgtaccttaccttggtaagcgagaagatcagtggtgtggcagtctgattgggctcacctcccgcgcaacttgggctcagaacatcccgaccgccattcagcaagttagaagcttaatcggaaatgaggaattcctggactacatgccatctatgaaacggtttaggaaggaggaggaatcagagggcgcgatttggtga

SEQ ID NO: 15315 - RNA, 9873 nt, synthetic construct
  misc_feature 1..9873: note = derived and/or modified CDS sequence (opt3) from DENV-3__JF920396__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgcgctgttgacatggatcgggctcaattccaagaacacctcaatgagttttagctgcattgctataggaatcattactctgtatttaggcgccgtagtgcaggcagacatgggttgtgttgtcaattggaaagggaaggagctgaagtgcggatccggcatcttcgtgacaaacgaggtgcatacctggactgaacagtacaaatttcaagccgattctcccaagcggctagctaccgccattgcaggtgcttgggagaatggcgtctgtgggatccgaagcacaacgcgcatggaaaacctcctgtggaaacagatagccaatgagcttaactatatcttgtgggaaaataacattaagctgaccgttgtggtgggagacatcattggcgtactcgagcaggggaaaagaactctgacaccacagcctatggagttaaagtactcatggaaaacctggggaaaggcgaagatcgtcacagccgaaactcaaaacagttccttcataattgatggccccaataccccagagtgccccagcgtgtctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaaccataggcccgggtatcacactcaaaccgccggaccttggcaccttggcaagttggagctggactttaattactgcgaggggacaacggtggtgatcaccgaaaactgtggaactcgtggcccaagtttacggacaaccactgtctctggtaaactcattcatgagtggtgctgtcgaagctgcacactgccccctcttagatatatgggggaagatggatgttggtacggcatggagatcaggccaatatccgaaaaggaggagaatatggttaaatcactggtgagcgctggttctggcaaggtagacaacttcaccatgggggtgttgtgcctcgccattctgtttgaagaggtcatgcgcggaaagttcggcaaaaagcacatgatcgcaggggtgttctttacgttcgttctactgctctccggacagatcacttggcgggatatggctcataccctgattatgatcggcagtaatgccagcgacagaatgggtatgggggtgacatatcttgcattgattgccacctttaaaatacagcccttcctggctttaggatttttcctcaggaagctgacttctcgcgaaaaccttctgctaggcgtcggcctcgcgatggccacaaccctgcaattgccggaggatatcgaacagatggcaaatgggattgctctgggattaatggccctcaaactgatcacacagtttgagacttaccagctttggaccgccctgatttccttgacgtgttcaaacacaatcttcaccctcactgtggcttggcgaaccgcaacactgatactagccggtgttagtctgcttcctgtgtgccaaagctcgtccatgcggaagactgactggctcccaatggcggtcgctgccatgggcgtaccccctctgcccttgtttatcttctctctgaaggataccttaaaacgtagaagctggccactcaatgagggggtgatggcagttggactggtgtcaattcttgccagttccctgttgaggaacgacgtccctatggctggccccctcgtggcaggtgggctgctaatcgcctgttatgtaattacgggaacatctgcggatctgaccgtggaaaaggctgccgacatcacttgggaggaagaggcagaacagacaggcgtcagccacaaccttatgataaccgttgacgatgacggcactatgcgcattaaagatgacgagacagagaatatcctcaccgtgctgttgaagacggccttactgatcgtgtccgggatttttccatactcaataccggctactctcctggtctggcatacctggcagaaacagacacaacggagcggagtgctttgggatgttcctagtcccccagaaacccagaaggccgagctggaagagggtgtatacagaatcaaacagcagggcattttcgggaagacacaagtgggagtcggcgtgcagaaggagggtgtttttcacactatgtggcacgtgaccaggggggcagtcttgacgtataacggaaaacgactagaacccaattgggcttctgtgaagaaagacctgatctcctacggcggcgggtggcgcctcagcgcccagtggcaaaagggagaggaagtacaggtcattgcggtggagcctggtaaaaacccaaagaatttccagacaatgcccggcactttccagaccacaaccggggaaatcggagccatagcactggattttaagcctggcacttcgggttcaccgatcattaaccgggaggggaaagttgtgggactttatggcaatggcgtcgtgaccaagaacgggggatacgtttctggtatcgctcaaacaaatgccgagccagacggccccacgcctgaattagaggaagagatgttcaaaaagagaaacctgactattatggatctccatccagggagtggaaaaaccaggaagtatttgcccgctatcgtgcgtgaagcaataaagcgccggctgagaacactcattctggcccctaccagggtcgtggccgctgagatggaggaagcgcttaaaggcctgccgatccgataccagactacagcaaccaagtccgagcacacgggtcgggaaatcgtagacttgatgtgccatgccacttttacaatgcgcctactgagccccgtgagagttccaaattataacctcattatcatggatgaggctcacttcaccgaccctgcctctatagcagccagggggtacattagcacccgggtcggaatgggcgaagctgcggccatctttatgactgcaacacccccaggcaccgctgatgccttccctcagtccaatgcacccattcaggacgaggagcgagacatcccagaaagatcatggaacagtgggaatgagtggataacagattttgccggaaaaactgtgtggttcgtgccgagcattaaggctggtaacgacatcgccaactgtttacgcaaaaatggcaagaaggtcatccaactgtctaggaaaacgtttgataccgaataccagaagacaaaacttaacgactgggatttcgtagtgactaccgacatttccgagatgggggcgaattttaaggcagatcgtgttatcgaccctcggagatgcctgaaacccgtgattctcacagatggaccagagagggtcatattggccggccccatgcctgtgaccgctgcctcagctgcacagcgccgaggtagagttgggcggaacccacagaaggaaaatgaccaatatatcttcactggccagcccctgaacaatgatgaggaccatgcccactggacggaagctaagatgctcctggacaacattaatacccctgagggaatcatcccggcccttttcgaaccagagagggagaaaagtgcagcgattgatggcgaataccgcctaaagggggagagccgtaaaacatttgtggaactgatgagacggggagacttgcccgtctggttagcccacaaggtggcttccgagggtataaaatatactgataggaagtggtgcttcgacggccagcgcaacaatcagatcctggaagagaacatggatgtagagatttggaccaaagaaggggagaagaagaaactccgacctagatggctggacgcccggacatactctgatccccttgcactgaaggaatttaaagagttcgctgccggaaggaagtcgatcgcactcgacttggtgaccgaaattggccgcgttccaagccatctggcccacagaactaggaatgctctagataacctggtcatgctccatacatcagagcacggtgggcgggcgtatcgtcacgccgtggaggaacttcctgagacgatggaaaccctgttattgctgggcctcatgatcctgcttactggaggcgcaatgctgtttctcatatccgggaaaggaatcggtaagacaagtattggcttgatctgtgtgattgcttctagcgggatgctgtggatggccgagatccccttacaatggatagcctccgcaattgtcctagagttctttatgatggttctgctcatcccagaacctgagaagcagcgcaccccgcaggacaatcaacttgcttacgtggtaattggaatcctgaccttggccgcgataatcgctgccaacgaaatgggcctgctcgagacaactaaacgagatctgggtatgtcaaaggaacccggggtggtctctccaacgagctatcttgacgtggatctccatcctgcaagtgcctggaccctgtacgctgttgcaacaactgtgattacccccatgttgagacacacaatcgagaattccaccgccaacgtcagcctggcggctattgccaaccaggcagtagtgttaatgggcctagacaaaggatggccaatctctaagatggacctgggcgttcctctccttgccctggggtgctactcacaggtgaatcccttgactctgacggctgccgtcctcctgcttataacacattatgcaattatcggaccgggcttacaggctaaagccaccagggaggcgcaaaagcggactgccgcaggtatcatgaagaacccaaccgtggatgggattatgacaatcgacctggatcctgtcatatacgactccaaattcgaaaagcagctcggacaggtgatgttgctggttctatgtgctgtgcagctgctccttatgcgcactagttgggccctgtgcgaggcattgaccctggctacaggccccattacgaccctctgggaaggtagcccaggcaaattttggaatactacaatcgccgtatcgatggccaacattttcagagggtcttatctggcgggagctggcttagcattttccatcatgaagagcgtggggaccggaaaaaggggcactggttcacaaggggagacacttggagaaaagtggaagaaaaagctgaatcagctcagtcggaaagatttcgacctatacaagaaatctggcataaccgaggtcgatcgaacggaggccaaggaaggtctgaaaagaggcgagatcacccaccatgctgtttcccgcgggagcgccaagttgcagtggtttgtggaaaggaacatggtcattcccgagggacgggtgatcgacctgggctgtgggcgtggaggctggtcatattactgcgcaggtctcaagaaagtaacagaagtgagagggtatactaagggaggccctggccacgaggagccggttcccatgagtacctacgggtggaatattgtgaaacttatgagcggaaaggatgtcttctacctgccacctgaaaaatgtgacacattgctgtgcgatatcggtgagtcctctcccagccctactgtggaagagtccaggaccattcgcgtcctcaagatggtggagccatggttaaagaacaatcagttctgtatcaaagttctgaacccctatatgcctacagtaatagaacaccttgagcggctgcaacgaaagcatggcgggatgctagtgagaaatccactctcaaggaactctacccacgaaatgtactggattagtaatggaactggcaacatcgtcgcctcggtgaatatggttagccgcctgttgctgaaccggtttacgatgacacatagacgtcccaccatcgagaaagacgtggatctcggtgctgggactaggcacgtcaacgcggaaccggagacccctaatatggacgtgattggagagcggataaagcgcatcaaagaagagcacaactccacatggcattatgacgatgaaaatccatacaagacgtgggcctatcacggctcttacgaggtaaaggcaaccggctcagctagctccatgattaacggggtggttaaacttctgactaagccctgggacgtcgtgcctatggtgacacagatggccatgaccgatactacaccattcggacagcaacgagtctttaaagaaaaggttgacaccagaacacccaggagtatgccgggtactcggcgcgtgatgggcatcaccgcagagtggttatggagaacgctggggaggaataaaaagcctcgattgtgcacccgggaggaattcacaaagaaagtacgtactaacgccgctatgggagccgtgtttaccgaggaaaatcagtgggattctgcgaaggcagccgtcgaggacgaagatttctggaaactcgtggacagagagcgcgagctgcataagctaggcaaatgtggtagctgcgtttataacatgatggggaagagggaaaaaaagcttggagagtttggcaaggctaaaggctcacgggccatttggtacatgtggctgggggcaagatacctcgaattcgaggctctgggatttttgaatgaggatcactggttctcccgcgaaaacagttatagcggtgtggagggcgaagggctgcataagctcggatacatccttagggacatatctaaaatccccggcggtgccatgtatgctgatgacacagccgggtgggacactcgaattaccgaggatgacctgcacaatgaagagaagatcacgcagcagatggatccagagcaccggcaattagcaaacgcgatttttaaactgacataccagaataaggtcgtgaaggtacagagacctacccccactggaacagttatggacatcatatccaggaaagatcagcgcggctcaggccaagtggggacctatggattgaacactttcaccaatatggaagcccagctcattcgtcagatggagggtgaaggcgtcctgagcaaggctgacctagagaacccacatcttcccgaaaaaaagatcacacagtggctggagacgaaaggggtggagcggctcaagagaatggccatctcgggagatgactgcgtggtcaagcctattgatgacaggtttgcaaacgctctgttggccttaaatgatatgggcaaagttcgcaaggacataccacaatggcagccgtctaaaggttggcacgattggcagcaggtgcccttctgtagtcatcacttccacgaactgatcatgaaggacgggcgaaaactcgtagtgccttgccggccacaagacgagcttattggaagagcaaggatctcccagggcgccggctggagcctgaaggaaaccgcgtgtctagggaaggcttacgcccagatgtggtcactgatgtattttcatcgcagagatctccggttggcatccaacgccatttgctctgctgtccccgtgcactgggttcctactagcaggacaacctggagtatccatgcccaccatcaatggatgactacagaggacatgctgaccgtgtggaatcgtgtctggatagaagataacccatggatggaggacaaaacgcccgtgacaacctgggagaatgtaccttaccttggaaagcgagaagatcagtggtgtggttccctgatcggcctcactagccgcgcaacctgggctcagaacattccgacagccatccagcaagttagatctttaattgggaatgaggaattcctggactacatgccatcaatgaaacggtttaggaaggaggaggaaagtgagggagcgatctggtga

SEQ ID NO: 15316 - RNA, 9873 nt, synthetic construct
  misc_feature 1..9873: note = derived and/or modified CDS sequence (opt3) from DENV-3__JF920406__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacgcttttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgtgtctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggtgttctttaccttcgttctactgctctccggacagattacgtggcgggatatggctcatactctgatcatgattggcagtaatgccagcgacagaatgggtatgggggtgacctatcttgcattgatagccacatttgaaatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacataccagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatggcggtcgctgccatgggcgtaccccctctgcccttgtttattttcgggctgaaggatactttaaagcgtagatcttggccactcaatgaaggagtgatggcagttggcctggtgagcatccttgcctcaagtctgttgaggaacgacgtccctatggctggtcccctcgtggcagggggactgctaattgcctgttatgtaatcaccggcacgtccgcggatctgacagtggagaaagctgccgacataacctgggaagaggaagcagagcagactggcgtctctcacaaccttatgattacagttgacgatgacgggaccatgcgcatcaaggatgacgagactgaaaatatcctcacagtgctgttgaaaaccgccttactgattgtgagcggaatatttccatactccatcccggctacgctcctggtctggcatacttggcagaagcagacccaacggtcaggtgtgctttgggatgttcctagccccccagagacacagaaagccgaactggaggagggcgtatacagaattaagcagcaggggatcttcggaaaaacccaagtgggcgtcggtgtgcagaaggaaggggtttttcacacaatgtggcacgtgactaggggagcagtcttgacctataacggcaagcgactagagcccaattgggctagtgtgaaaaaggacctgatttcttacggcgggggatggcgcctctccgcccagtggcaaaaaggtgaagaggtacaggtcatcgcggtggaacctggcaagaacccaaaaaatttccagacgatgcccgggacattccagactaccacaggagagataggcgccatcgcactggattttaagcctggtaccagcgggtcgccgattatcaaccgggagggaaaggttgtgggcctttatggcaatggggtcgtgactaaaaacggaggttacgtttcaggcattgctcaaaccaatgccgaaccagacgggcccacacctgagttagaagaggaaatgttcaagaaaagaaacctgacgatcatggatctccatccaggatctggcaagactaggaaatatttgcccgctatagtgcgtgaggcaattaagcgccggctgagaaccctcatcctggcccctacaagggtcgtggccgctgagatggaagaggcgcttaagggtctgccgatccgataccagaccactgcaacaaaaagtgaacacaccgggcgggagattgtagacttgatgtgccatgccacgtttactatgcgcctactgtcccccgtgagagttccaaattataacctcatcataatggatgaagctcacttcacagaccctgccagcattgcagccaggggatacatctctacccgggtcggcatgggcgaggctgcggccatttttatgaccgcaactcccccagggacagctgatgccttccctcagagcaatgcacccatccaggacgaggaacgagacataccagagagatcctggaactcaggaaatgaatggattaccgattttgccggtaagacagtgtggttcgtgccgagtatcaaagctggcaacgacatcgccaactgtttacgcaagaatgggaaaaaggtcattcaactgagcaggaagacttttgatacggagtaccagaaaaccaagcttaacgactgggatttcgtagtgacaactgacatctctgagatgggagcgaattttaaagcagatcgtgttattgaccctcggagatgcctgaagcccgtgatactcaccgatggcccagaaagggtcatcttggccggtcccatgcctgtgacagctgcctccgctgcacagcgccgagggagagttggccggaacccacagaaagagaatgaccaatatattttcaccggacagcccctgaacaatgatgaagaccatgcccactggactgaggctaagatgctcctggacaacatcaatacgcctgaaggcatcattccggcccttttcgagccagagagggaaaagtcagcagcgatagatggggagtaccgcctaaaaggagaaagtcgtaagacctttgtggagctgatgagacggggtgacttgcccgtctggttagcccacaaagtggctagcgaaggcatcaagtatacagataggaaatggtgcttcgacgggcagcgcaacaatcagattctggaggagaacatggatgtagaaatctggactaaggagggagaaaaaaagaagctccgacctagatggctggacgcccggacctactccgatccccttgcactgaaagagtttaaggaattcgctgccggcaggaaatctattgcactcgacttggtgacagagatcggtcgcgttccatcgcatctggcccacagaaccaggaatgctctagataacctggtcatgctccatactagcgagcacgggggccgggcgtatcgtcacgccgtggaagagcttcctgaaacaatggagacgctgttattgctgggactcatgatactgcttaccggcggggcaatgctgtttctcatctcaggaaagggtattggcaaaacttccatcgggttgatttgtgtgatcgctagttctggaatgctgtggatggccgagatacccttacaatggattgccagcgcaatcgtcctagaattctttatgatggttctgctcattccagagcctgaaaagcagcgcacaccgcaggacaatcaacttgcttacgtggtaatcggcatactgaccttggccgcgatcattgctgccaacgagatgggtctgctcgaaaccacaaagcgagatctggggatgtccaaagagcccggcgtggtctcaccaacttcttatcttgacgtggatctccatcctgcaagcgcctggacgctgtacgctgttgcaaccacagtgatcactcccatgttgagacacaccattgagaatagtacagccaacgtctccctggcggctatcgccaaccaggcagtagtgttaatgggactagacaagggctggccaataagcaaaatggacctgggggttcctctccttgccctgggatgctactctcaggtgaatcccttgaccctgactgctgccgtcctcctgcttattacgcattatgcaatcatcggcccgggtttacaggctaaggccacaagggaagcgcaaaaacggaccgccgcagggattatgaagaacccaactgtggatggaatcatgaccatagacctggatcctgtcatttacgactcaaagttcgagaaacagctcggccaggtgatgttgctggttctatgtgctgtgcagctgctccttatgcgcacatcctgggccctgtgcgaagcattgactctggctaccggtcccatcacaacgctctgggagggcagtccagggaagttttggaataccactattgccgtaagcatggccaacatcttcagaggatcgtatctggcgggcgctgggttagcattttctataatgaaatccgtgggaacaggcaagaggggtaccgggagccaaggagaaactcttggcgagaaatggaagaagaaactgaatcagctctcacggaaggatttcgacctatacaaaaagagtggtatcacagaggtcgatcgaaccgaagccaaagagggcctgaagagaggggaaattacgcaccatgctgtttctcgcggatccgccaaattgcagtggtttgtggagaggaacatggtcatccccgaaggccgggtgattgacctggggtgtggacgtggcggttggagctattactgcgcagggctcaagaaggtaaccgaggtgagaggatatacaaaaggcggccctgggcacgaggaaccggttcccatgtcaacttacggatggaatatcgtgaagcttatgagtggtaaagatgtcttctacctgccacctgagaagtgtgacaccttgctgtgcgatattggcgaaagctccccctctcctacagtggaggagagcaggactatccgcgtcctcaaaatggtggaaccatggttaaagaacaatcagttctgtataaaggttctgaacccctatatgcctaccgtaattgagcaccttgaacggctgcaacgaaaacatgggggaatgctagtgagaaatccactctccaggaactcaacacacgagatgtactggatctctaatggcaccggtaacatcgtcgccagtgtgaatatggtttcgcgcctgttgctgaaccggtttactatgacgcatagacgtcccacaattgaaaaggacgtggatctcggggctggaaccaggcacgtcaacgcggagccggagactcctaatatggacgtgataggcgaacggatcaaacgcattaaggaggaacacaacagcacctggcattatgacgatgagaatccatacaaaacatgggcctatcacggctcctacgaagtaaaggcaacggggtctgcttcaagcatgatcaacggagtggttaagcttctgaccaaaccctgggacgtcgtgcctatggtgactcagatggccatgacagataccactccattcggtcagcaacgagtctttaaggagaaagttgacacaagaacccccaggtccatgccgggcacacggcgcgtgatggggattactgcagagtggttatggagaaccctgggaaggaataagaaacctcgattgtgcacgcgggaagagttcaccaagaaggtacgtacaaacgccgctatgggcgccgtgtttactgaagagaatcagtgggatagtgcgaaagcagccgtcgaagacgaggatttctggaagctcgtggacagagagcgcgaactgcataaactaggtaagtgtgggtcttgcgtttataacatgatgggaaaaagggagaagaaacttggcgaatttggcaaggctaaggggagccgggccatctggtacatgtggctgggagcaagatacctcgagttcgaggctctgggttttttgaatgaagatcactggttctcacgcgagaactcctatagtggcgtggaaggggagggactgcataaactcggctacatacttagggacatcagcaagattcccggtggggccatgtatgctgatgacaccgccggatgggacacacgaatcactgaagatgacctgcacaatgaggagaaaattacccagcagatggatccagaacaccggcaattagcaaacgcgatctttaagctgacgtaccagaataaagtcgtgaaggtacagagacctacacccaccggcactgttatggacataatttctaggaaggatcagcgcggctccgggcaagtgggaacatatggtttgaacaccttcactaatatggaggcccagctcatccgtcagatggaaggcgagggggtcctgtcaaaagctgacctagaaaacccacatcttcccgagaagaaaatcacccagtggctggagacaaagggagtggaacggctcaaaagaatggccattagcggcgatgactgcgtggtcaagcctatagatgacaggtttgcaaacgctctgttggccttaaatgatatgggtaaggttcgcaaagacatcccacaatggcagccgtcgaaggggtggcacgattggcagcaggtgcccttctgttctcatcacttccacgagctgattatgaaagacggacgaaagctcgtagtgccttgccggccacaagacgaacttatcggcagagcaaggattagtcagggcgccgggtggtccctgaaagagacggcgtgtctaggaaaggcttacgcccagatgtggagcctgatgtattttcatcgcagagatctccggttggcatcaaacgccatctgctccgctgtccccgtgcactgggttcctacctctaggactacatggagcatacatgcccaccatcaatggatgaccactgaagacatgctgacagtgtggaatcgtgtctggatcgaggataacccatggatggaggacaagacccccgtgacgacatgggaaaatgtaccttaccttggtaaacgagaggatcagtggtgtggcagtctgattgggctcacctcccgcgcaacttgggctcagaacatcccgaccgccattcagcaagttagaagcttaatcggaaatgaagagttcctggactacatgccatctatgaagcggtttaggaaagaggaagagtcagaaggcgcgatttggtga

SEQ ID NO: 15317 - RNA, 9873 nt, synthetic construct
  misc_feature 1..9873: note = derived and/or modified CDS sequence (opt3) from DENV-3__JF920409__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcgcccagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccacattgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcagaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgtgtctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggctttctttatgttcgtgctactgctctccggacagattacctggcgggatatggcccatacgctgatcatgattggcagtaatgcaagcgacagaatgggtatgggggttacttatcttgccttgatagctacctttaaaatccagcccttcctggcgttaggatttttcctcaggaagctgacatctcgcgaaaaccttctgctaggcgtgggcctcgccatggcaaccactctgcaattgccggaggatattgaacagatggctaatgggatcgccctgggattaatggccctcaaactgattacacagtttgagacctaccagctttggacagctctgatctccttgacttgttcaaacaccatattcacgctcacagtcgcatggcgaaccgccactctgatcctagcgggtgtgagtctgcttcctgtttgccaaagctcgtccatgcggaagaccgactggctcccaatggctgtggccgcaatgggcgtcccccctctgcccttgtttattttctctctgaaggatacattaaaacgtagaagctggccactcaatgagggggtaatggccgtgggactggtttcaatccttgctagttccctgttgaggaacgacgtgcctatggcaggccccctcgtcgccggtgggctgctaattgcgtgttatgtgatcactggaacctctgctgatctgacggtagaaaaggccgcagacataacatgggaggaagaggccgaacagaccggcgtgagccacaaccttatgattactgtcgacgatgacggcacaatgcgcatcaaagatgacgagtccgagaatatcctcaccgttctgttgaagactgctttactgattgtgtcagggatatttccatacagcatcccggccacactcctggtgtggcatacctggcagaaacagacgcaacggagtggagtcctttgggatgtgccttctcccccagaaactcagaaggcagagctggaagagggtgtttacagaattaaacagcagggcatcttcgggaagacccaagtaggagtgggcgtccagaaggagggtgtgtttcacacaatgtggcacgttaccaggggggctgtgttgacatataacggaaaacgactagaacccaattgggcctccgtcaagaaagacctgattagctacggcggcgggtggcgcctctcggcgcagtggcaaaagggagaggaagtgcaggtaatcgccgtcgagcctggtaaaaacccaaagaatttccagactatgcccggcaccttccagacgacaactggggaaataggagcaatcgctctggattttaagcctggcacctcaggttctccgattatcaaccgggaggggaaagtggttggactttatggcaatggcgtggtcacaaagaacgggggatacgtgagtggtattgcccaaaccaatgctgagccagacggccccactcctgaattagaggaagagatgttcaaaaagagaaacctgaccatcatggatctccatccagggtccggaaaaacaaggaagtatttgcccgcaatagttcgtgaagccattaagcgccggctgagaacgctcatcctggcccctactagggtggtcgctgcggagatggaggaagcacttaaaggcctgccgatccgataccagaccacagccaccaagagcgagcacactggtcgggaaattgtggacttgatgtgccatgctacatttaccatgcgcctactgtctcccgtaagagtgccaaattataacctcatcataatggatgaggcccacttcacggaccctgcaagcattgccgctagggggtacatctccactcgggttggaatgggcgaagcggccgcaatttttatgacagctacccccccaggcaccgccgatgcattccctcagtcaaatgcccccatccaggacgaggagcgagacataccagaaagaagttggaacagcgggaatgagtggattactgattttgctggaaaaacagtctggttcgtgccgtctatcaaggccggtaacgacatcgcgaactgtttacgcaaaaatggcaagaaggtgattcaactgtccaggaaaacctttgatacagaataccagaagactaaacttaacgactgggatttcgtcgtaacgaccgacatctcagagatgggggcaaattttaaggccgatcgtgtgattgaccctcggagatgcctgaaacccgttatactcacagatggaccagagagggtgatcttggctggccccatgcctgtcactgccgctagtgcagcccagcgccgaggtagagtggggcggaacccacagaaggaaaatgaccaatatattttcaccggccagcccctgaacaatgatgaggaccatgctcactggacagaagccaagatgctcctggacaacatcaatacccctgagggaatcattccggcacttttcgaaccagagagggagaaaagcgcggccatagatggcgaataccgcctaaagggggagtcccgtaaaacttttgttgaactgatgagacggggagacttgcccgtgtggttagctcacaaggtcgcctctgagggtatcaaatatacggataggaagtggtgcttcgacggccagcgcaacaatcagattctggaagagaacatggatgtggagatctggaccaaagaaggggagaagaagaaactccgacctagatggctggacgcacggacatactcggatccccttgctctgaaggaatttaaagagttcgccgcaggaaggaagagcattgccctcgacttggtaactgaaatcggccgcgtgccatcacatctggctcacagaaccaggaatgcgctagataacctggttatgctccatacatccgagcacggtgggcgggcctatcgtcacgcagtcgaggaacttcctgagaccatggaaactctgttattgctgggcctcatgatactgcttacaggaggcgctatgctgtttctcatcagtgggaaaggaattggtaagacgtctatcggcttgatttgtgtgatcgccagctccgggatgctgtggatggccgagatacccttacaatggattgcatcagctatcgtgctagagttctttatgatggtcctgctcattccagaacctgagaagcagcgcaccccgcaggacaatcaacttgcctacgttgtgatcggaatactgactttggcggctatcattgccgcaaacgaaatgggcctgctcgagacaaccaaacgagatctgggtatgtctaaggaacccggggtagtgagcccaaccagttatcttgacgtcgatctccatcctgcctccgcttggacactgtacgcagtggccactacggttatcacccccatgttgagacacacaattgagaatagcactgcgaacgtgtctctggctgccatcgcaaaccaggccgtcgtattaatgggcctagacaaaggatggccaatatcaaagatggacctgggcgtgcctctccttgctctggggtgctactcccaggttaatcccttgaccctgacagccgcagtgctcctgcttattacccattatgctatcatcggaccgggcttacaggccaaagcgactagggaggcccaaaagcggacggcagctggtattatgaagaacccaacagtcgatgggatcatgaccatagacctggatcctgtgatttacgacagtaaattcgaaaagcagctcggacaggtcatgttgctggtgctatgtgccgttcagctgctccttatgcgcactagctgggcactgtgcgaggctttgaccctggccacaggccccatcactaccctctgggaaggttcgccaggcaaattttggaatacaacgattgccgtgtctatggcgaacatcttcagagggtcctatctggctggagcaggcttagcctttagcataatgaagtcagtagggaccggaaaaaggggcactggtagtcaaggggagacacttggagaaaagtggaagaaaaagctgaatcagctctctcggaaagatttcgacctatacaagaaatccggcatcaccgaggtggatcgaactgaggctaaggaaggtctgaaaagaggcgagattacacaccatgccgtcagccgcgggtcagcaaagttgcagtggtttgttgaaaggaacatggtgatccccgagggacgggtcattgacctgggctgtgggcgtggaggctggagttattactgcgccggtctcaagaaagtgaccgaagtaagagggtatacgaagggaggccctggccacgaggagccggtgcccatgagcacctacgggtggaatatcgttaaacttatgtccggaaaggatgtgttctacctgccacctgaaaaatgtgacacattgctgtgcgatattggtgagtctagcccctcccctactgtcgaagagtcaaggaccatccgcgtgctcaagatggtcgagccatggttaaagaacaatcagttctgtataaaagtgctgaacccctatatgcctacagttattgaacaccttgagcggctgcaacgaaagcatggcgggatgctagtaagaaatccactctctaggaacagtactcacgaaatgtactggatctcgaatggaaccggcaacatcgtggctagcgtcaatatggtgtcccgcctgttgctgaaccggtttacaatgacccatagacgtcccactattgagaaagacgttgatctcggtgcggggacgaggcacgtgaacgccgaaccggagacacctaatatggacgtcataggagagcggatcaagcgcattaaagaagagcacaactctacctggcattatgacgatgaaaatccatacaagacttgggcatatcacggctcatacgaggtgaaggctaccggcagcgcctccagtatgatcaacggggtagtgaaacttctgacaaagccctgggacgttgtccctatggtgacgcagatggcaatgaccgatactacaccattcggacagcaacgagtgtttaaagaaaaggtcgacaccagaactcccaggtctatgccgggtacacggcgcgttatgggcattaccgccgagtggttatggagaacactggggaggaataaaaagcctcgattgtgcactcgggaggaattcaccaagaaagtgcgtacgaacgctgccatgggagcggtatttaccgaggaaaatcagtgggatagcgcaaaggccgctgtggaggacgaagatttctggaaactcgtcgacagagagcgcgagctgcataagctaggcaaatgtggttcatgcgtgtataacatgatggggaagagggaaaaaaagcttggagagtttggcaaggccaaaggctcccgggcaatctggtacatgtggctgggggctagatacctcgaattcgaggccctgggatttttgaatgaggatcactggttcagtcgcgaaaacagctattctggtgttgagggcgaagggctgcataagctcggatacatacttagggacatctccaaaattcccggcggtgctatgtatgccgatgacacagcagggtgggacactcgaatcaccgaggatgacctgcacaatgaagagaagattacacagcagatggatccagagcaccggcaattagcgaacgccatctttaaactgacttaccagaataaggtggtcaaggtgcagagacctacccccacgggaacagtaatggacataatttcaaggaaagatcagcgcggcagcggccaagttgggacctatggattgaacactttcacaaatatggaagctcagctcatccgtcagatggagggtgaaggcgtgctgtcgaaggccgacctagagaacccacatcttcccgaaaaaaagatcacccagtggctggagactaaaggggtcgagcggctcaagagaatggcaatttctggagatgactgcgtggtgaagcctatagatgacaggtttgctaacgccctgttggcattaaatgatatgggcaaagtccgcaaggacatcccacaatggcagccgagtaaaggttggcacgattggcagcaggttcccttctgttcccatcacttccacgaactgattatgaaggacgggcgaaaactcgtggtaccttgccggccacaagacgagcttatcggaagagccaggattagccagggcgcgggctggtcactgaaggaaaccgcttgtctagggaaggcctacgcacagatgtggtccctgatgtattttcatcgcagagatctccggttggcctctaacgctatctgcagcgccgtgcccgtccactgggtgcctacaagtaggacgacctggtccatacatgcacaccatcaatggatgactacagaggacatgctgaccgtttggaatcgtgtgtggatcgaagataacccatggatggaggacaaaactcccgtcacaacctgggagaatgtgccttaccttggaaagcgagaagatcagtggtgtggtagcctgattggcctcacgtctcgcgctacatgggcccagaacatcccgaccgcgattcagcaagtaagatcattaatcgggaatgaggaattcctggactacatgccaagtatgaaacggtttaggaaggaggaggaatccgagggagctatttggtga

SEQ ID NO: 15318 - RNA, 9873 nt, synthetic construct
  misc_feature 1..9873: note = derived and/or modified CDS sequence (opt3) from DENV-3__JF920408__SS-prME
  source 1..9873: mol_type = other RNA
accagcctgtgcctcatgatgatccttcccgccgctctggcattccacttgacatcccgggacggagaacctaggatgattgtggggaagaacgaacggggaaaatctttactgtttaagactgcctcaggtataaatatgtgtacgctaatcgcgatggatctcggagaaatgtgcgacgataccgtcacatacaaatgtccacatattactgaagttgaaccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgggacccaaggagtgactgcagagattacgcctcaggcttccacaaccgaagccatcctcccagagtatggcactcttggtctggaatgctctccgcgaaccgggttggacttcaatgagatgatcctactgacaatgaaaaacaaggcgtggatggtccatagacagtggtttttcgatctccccctgccttggaccagcggcgccactacagagacgccaacctggaataggaaagaacttctggtgacttttaagaacgcacacgctaaaaagcaagaggtagttgtgttgggatcccaggaaggcgccatgcacacagctctcaccggggccacagagattcaaaattcaggaggtactggcatattcgcagggcatctgaagtgtcggttaaaaatggacaagctggaactaaaaggaatgagttacgccatgtgcaccaacacgtttgtcctcaagaaagaggtgagcgagacccagcacggcacaatcctgattaaggtcgaatacaagggtgaggatgtgccctgtaaaatccctttctctactgaagacgggcaaggcaaggctcataacggacgtcttataaccgcgaatccagttgtgactaagaaggaggagcccgtaaacattgaagcagagccgcctttcggcgaatccaatatcgtcatcgggattggagataacgccttgaaaatcaattggtataagaagggttcaagcattggcaaaatgtttgaggctactgcccgcggggcaagaaggatggccatactgggagacaccgcttgggatttcggcagtgtgggtggggttctcaactctctgggcaagatggtgcaccagatctttggatccgcctacacggcacttttcagcggcgtctcgtgggtgatgaaaattgggatcggagtactgttgacatggatcggcctcaattctaagaacacctccatgtcatttagttgcattgcgataggtatcattactctgtatttaggggctgtggttcaggccgacatgggatgtgtcatcaattggaaaggcaaggaactgaagtgcggtagcggcattttcgtgacaaacgaggtgcatacctggactgagcagtacaaatttcaagcagattcccccaagcggctagccaccgctatcgccggggcatgggaaaatggagtctgtggcatacgatctacaacgcgcatggagaacctcctgtggaaacagatcgctaatgaacttaactatattttgtgggagaataacatcaagctgaccgttgtggtgggggacattatcggagtactcgaacagggcaaaagaactctgacaccacagcctatggagttaaagtacagctggaaaacctggggtaaggccaagatagtcacagcggagactcaaaactcaagtttcattatcgatgggcccaataccccagaatgcccctccgtgagcagggcctggaacgtttgggaggtggaagactatggatttggcgtcttcacgacaaatatttggctgaaacttcgggaggtgtacacccagttgtgtgaccaccgcctcatgtctgctgcagttaaggatgaaagagccgtgcacgctgacatgggttactggatcgagtcacagaaaaacggcagttggaagctggagaaagccagcctaatagaagtaaagacttgcacctggcctaagtcccatacactgtggtctaatggggtcctcgagtcggatatgatcattccaaaaagcctggcaggaccgatctcccagcacaaccataggcccggctatcacactcaaaccgcggggccttggcaccttggaaagttggaactggactttaattactgcgagggcacaacggtggtgattaccgagaactgtggtactcgtgggccatcattacggacaaccactgtcagtggaaaactcatccatgaatggtgctgtcgatcttgcacactgccccctcttagatatatgggcgaggatggttgttggtacggcatggaaataaggccaattagcgagaaggaagagaatatggttaaatccctggtgtcagccgggagcggaaaggtagacaacttcaccatgggcgtgttgtgcctcgctatcctgtttgaggaagtcatgcgcgggaagttcggcaagaagcacatgatcgccggcgtgttctttacgttcgttctactgctctctggtcagattacttggcgggatatggcacataccctgatcatgattgggtccaatgctagtgacagaatgggaatgggcgtgacatatcttgccttgatagcaacctttaaaatccagcccttcctggccttaggctttttcctcaggaagctgactagccgcgagaaccttctgctaggggtcggactcgctatggcgacaaccctgcaattgccggaagatattgagcagatggccaatggtatcgcactgggcttaatggctctcaaactgattacacagtttgaaacttaccagctttggaccgccctgatctctttgacgtgttccaacacaatattcaccctcactgtggcctggcgaaccgctacactgatcctagcaggggtttcactgcttcctgtgtgccaaagtagctcgatgcggaagactgactggctcccaatggccgtcgcggctatgggagtaccccctctgcccttgtttattttcggcctgaaggataccttaaaacgtagatcctggccactcaatgagggtgtgatggccgttgggctggtgtctatccttgcaagctcactgttgaggaacgacgtccctatggccggacccctcgtggctggcggcctgctaattgcatgttatgtaatcacggggacaagtgccgatctgaccgtggagaaggcggctgacataacttgggaagaggaagccgagcagacaggagtctcccacaaccttatgattaccgttgacgatgacggtactatgcgcatcaaagatgacgaaacagagaatatcctcaccgtgctgttgaagacggcattactgattgtgtctggcatatttccatacagcatcccggccactctcctggtctggcatacctggcagaaacagacacaacggtccggggtgctttgggatgttccttcacccccagagacccagaaggctgaactggaggaaggagtatacagaattaaacagcagggcatcttcggtaagacacaagtgggggtcggagtgcagaaggagggcgtttttcacactatgtggcacgtgaccaggggcgccgtcttgacgtataacgggaaacgactagagcccaattgggcaagcgtgaagaaagacctgattagttacggaggtggctggcgcctctctgctcagtggcaaaagggggaagaggtacaggtcatcgccgtggaacctggcaaaaacccaaagaatttccagacaatgcccggcactttccagaccacaaccggtgagataggggcgatcgccctggattttaagcctggaacttccggcagcccgattatcaaccgggaaggcaaagttgtggggctttatggaaatggtgtcgtgaccaagaacggcgggtacgtttcgggaattgcacaaacaaatgctgagccagacggccccacgcctgagttagaagaggaaatgttcaaaaagagaaacctgactatcatggatctccatccaggttcagggaaaaccaggaagtatttgcccgccatagtgcgtgaggctattaagcgccggctgagaacactcatcctggcacctaccagggtcgtggccgccgaaatggaggaggctcttaaaggactgccgatccgataccagactacagcgaccaagtctgaacacacgggccgggagattgtagacttgatgtgccatgcaacttttacaatgcgcctactgagtcccgtgagagttccaaattataacctcatcataatggatgaagcccacttcaccgaccctgcttccattgccgcaaggggctacatcagcacccgggtcgggatgggagaggccgctgcgatttttatgactgccacacccccaggtaccgcagatgctttccctcagtctaatgcccccatccaggacgaagaacgagacataccagagagaagctggaactccggcaatgaatggattacagattttgcagggaaaactgtgtggttcgtgccgtcaatcaaggccggaaacgacatcgctaactgtttacgcaaaaatggcaagaaggtcattcaactgagtaggaaaacgtttgataccgagtaccagaagacaaaacttaacgactgggatttcgtagtgactaccgacatcagcgaaatgggtgccaattttaaggcggatcgtgttattgaccctcggagatgcctgaaacccgtgatactcacagatgggccagagagggtcatcttggcaggccccatgcctgtgaccgccgcttctgccgctcagcgccgaggaagagttggccggaacccacagaaggagaatgaccaatatattttcactgggcagcccctgaacaatgatgaagaccatgcacactggacggaggccaagatgctcctggacaacatcaatacccctgaaggaatcattccggctcttttcgagccagaaagggagaaatccgccgcaatagatggtgagtaccgcctaaagggcgaatcacgtaaaacatttgtggagctgatgagaagaggggacttgcccgtctggttagcgcacaaggtggccagtgaaggaatcaaatatactgataggaagtggtgcttcgacggccagcgcaacaatcagattctggaggaaaacatggatgtagagatctggaccaaagagggtgaaaagaagaaactccgacctagatggctggacgctcggacatacagcgatccccttgccctgaaggagtttaaagagttcgcagctgggaggaagtccattgccctcgacttggtgaccgagatcggccgcgttccatctcatctggcacacagaactaggaatgccctagataacctggtcatgctccatacatcggaacacggaggccgggcttatcgtcacgcggtggaggagcttcctgaaacgatggagaccctgttattgctggggctcatgatactgcttactggaggtgccatgctgtttctcatcagcggcaaagggattggaaagacatcaatcggcttgatttgtgtgatcgcatccagtggtatgctgtggatggctgaaatacccttacaatggattgcctctgccatcgtcctagagttctttatgatggttctgctcattccagagcctgaaaagcagcgcaccccgcaggacaatcaacttgcatacgtggtaatcgggatactgaccttggctgccatcattgcggctaacgagatgggcctgctcgaaacaactaaacgagatctgggaatgagcaaggagcccggcgtggtctccccaacgtcatatcttgacgtggatctccatcctgcctctgcatggaccctgtacgccgttgctacaactgtgatcacccccatgttgagacacacaattgaaaatagcaccgcaaacgtcagtctggccgcgatcgctaaccaggccgtagtgttaatggggctagacaaaggatggccaatatccaagatggacctgggcgttcctctccttgcactgggttgctacagccaggtgaatcccttgactctgacggccgctgtcctcctgcttattacacattatgccatcatcgggccgggattacaggcaaaagctaccagggaggcccaaaagcggactgcggccggcattatgaagaacccaaccgtggatggtatcatgacaatagacctggatcctgtcatttacgactctaaattcgagaagcagctcggccaggtgatgttgctggttctatgtgcagtgcagctgctccttatgcgcacttcatgggctctgtgcgaagccttgaccctggcaacagggcccatcacgaccctctgggagggatccccaggcaaattttggaatactacaattgctgtaagtatggccaacatcttcagagggagctatctggccggagcgggcttagctttttcgataatgaagtctgtgggtaccgggaaaaggggaactggctcccaaggtgaaacacttggcgagaagtggaagaaaaagctgaatcagctcagccggaaagatttcgacctatacaagaaatcagggatcaccgaagtcgatcgaacggaggcaaaggagggactgaaaagaggcgaaattacccaccatgccgttagtcgcgggtctgctaagttgcagtggtttgtggagaggaacatggtcatccccgaaggacgggtgattgacctgggctgtggtcgtgggggatggtcctattactgcgccggcctcaagaaagtaacagaggtgagaggctatactaaagggggacctggtcacgaagaaccggttcccatgagcacctacggctggaatatcgtgaaacttatgtcagggaaggatgtcttctacctgccacctgagaaatgtgacacattgctgtgcgatattggagaaagtagcccctcccctactgtggaggaatctaggaccatccgcgtcctcaagatggtggagccatggttaaagaacaatcagttctgtataaaagttctgaacccctatatgcctacagtaattgagcaccttgaacggctgcaacgaaagcatggcggtatgctagtgagaaatccactcagcaggaactccacccacgagatgtactggatctcaaatgggactggaaacatcgtcgcatctgtgaatatggttagtcgcctgttgctgaaccggtttacgatgacacatagacgtcccaccattgaaaaagacgtggatctcggcgccggcactaggcacgtcaacgctgagccggaaacccctaatatggaggtgataggggagcggatcaagcgcattaaagaagaacacaactcgacatggcattatgacgacgaaaatccatacaagacgtgggcgtatcacggaagctacgaggtaaaggccaccggttccgcatcttcaatgatcaacggcgtggttaaacttctgactaagccctgggatgtcgtgcctatggtgacacagatggctatgaccgacactacaccattcgggcagcaacgagtctttaaagaaaaggttgataccagaacacccaggagcatgccgggaactcggcgcgtgatgggcattaccgccgagtggttatggagaacgctgggtaggaataaaaagcctcgattgtgcacccgggaggagttcacaaagaaagtacgtactaacgcagccatgggggctgtgtttaccgaggaaaatcagtgggactccgccaaggcggcagtcgaggatgaagacttctggaaactcgtggatagagagcgcgagctgcataagctaggaaaatgtggcagttgcgtttataacatgatgggcaagagggagaagaaacttggggagtttggaaaagccaaaggttctcgggctatctggtacatgtggctgggcgccagatacctcgagttcgaggcactggggtttttgaatgaggaccactggttcagccgcgaaaactcatattccggagtggagggcgaaggtctgcataagctcgggtacatacttagggatatcagtaaaattcccggaggcgctatgtatgccgacgatacagctggctgggacactcgaatcaccgaggacgatctgcacaatgaagagaagattacgcagcagatggacccagagcaccggcaattagccgatgcaatctttaaactgacataccagaacaaggtcgtgaaggtacagagacctacccccactgggacagttatggacataattagcaggaaagatcagcgcggatctggtcaagtgggcacctatgggttgaatactttcaccaacatggaagcgcagctcatccgtcagatggagggagaaggcgtcctgtccaaggccgacctagagaatccacatcttcccgagaaaaagatcacacagtggctggagacgaaaggtgtggagcggctcaagagaatggctatttcaggggatgactgcgtggtcaagcctatagatgacaggtttgccaacgcactgttggctttaaacgatatgggaaaagttcgcaaggacatcccacaatggcagccgagcaaaggctggcacgattggcaacaggtgcccttctgttcgcatcacttccacgaactgattatgaaggacggccgaaaactcgtagtgccttgccggccacaagacgagcttatcgggagagccaggatttctcagggagcaggttggagtctgaaggaaaccgcctgtctaggcaaggcgtacgctcagatgtggtccctgatgtattttcatcgcagagatctccggttggccagcaatgcaatctgctcagccgtccccgtgcactgggttcctacttccaggacaacctggtctatacatgctcaccatcaatggatgactacagaggacatgctgaccgtgtggaaccgtgtctggatcgaagataatccatggatggaggacaaaacgcccgtgacaacctgggagaacgtaccttaccttgggaagcgagaagatcagtggtgtggaagcctgattggcctcacaagtcgcgccacctgggcacagaatatcccgacagctattcagcaagttagatccttaatcggtaacgaggagttcctggactacatgccaagcatgaaacggtttaggaaggaggaggaatctgagggggccatttggtga

SEQ ID NO: 15319 - RNA, 9873 nt, synthetic construct
  misc_feature 1..9873: note = derived and/or modified CDS sequence (opt3) from DENV-3__JF920397__SS-prME
  source 1..9873: mol_type = other RNA
accagcctgtgcctcatgatgatccttcccgccgctctggcattccacttgacttccagagacggcgagcctaggatgattgtggggaagaacgaacggggaaagtctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtcgcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagaccttctggtgacttttaagaacgcacacgctaaaaagcaagaggtagttgtgttgggctcccaggaaggagccatgcatacagctctcaccggcgccacagagattcaaaattcagggggaacaagtatattcgcaggtcacctgaagtgtcggttaaaaatggataagctggaactaaaaggcatgagctatgccatgtgcaccaacacgtttgtcctcaagaaagaggtgtctgagacccagcatgggacaatcctgattaaggtcgaatacaagggagaggacgtgccctgtaaaatccctttctccactgaagatggccaaggtaaggctcacaacgggcgtcttataaccgcgaatccagttgtgactaagaaggaggagcccgtaaacattgaagcagagccgcctttcggcgaatcaaatatcgtcatcggaattggcgacaacgccttgaaaatcaattggtacaagaaggggagcagtattggaaaaatgtttgaggctactgcccgcggtgcaagaaggatggccatactgggcgataccgcttgggacttcgggtctgtgggaggcgttctcaactccctgggtaagatggtgcatcagatctttgggagcgcctatacggcacttttctcgggcgtctcttgggtgatgaaaattggaatcggcgtactgttgacatggatcgggctcaattccaagaacacctcaatgagttttagctgcattgcgataggaatcattactctgtacttaggcgctgtggttcaggccgatatgggttgtgtcatcaattggaaagggaaggaactgaagtgcggatccggcattttcgtgacaaacgaggtgcacacctggactgagcagtataaatttcaagcagactctcccaagcggctagccaccgctatcgccggtgcatgggaaaatggcgtctgtgggatacgaagcacaacgcgcatggagaacctcctgtggaaacagatcgctaatgaacttaactacattttgtgggagaataacatcaagctgaccgttgtggtgggagatattatcggcgtactcgaacaggggaaaagaactctgacaccacagcctatggagttaaagtattcatggaaaacctggggaaaggccaagatagtcacagcggagactcaaaacagttccttcattatcgacggccccaataccccagaatgccccagcgtgtctagggcctggaacgtttgggaggtggaagactacggttttggggtcttcacgacaaatatttggctgaaacttcgggaggtgtatacccagttgtgtgatcaccgcctcatgtcagctgcagttaaggacgaaagagccgtgcatgctgatatgggatactggatcgagagtcagaaaaacggcagctggaagctggagaaagcctccctaatagaagtaaagacttgcacctggcctaagtctcacacactgtggtcgaatggtgtcctcgagagcgacatgatcattccaaaatccctggcaggcccgatctcacagcataaccacaggcccgggtaccacactcaaaccgcgggaccttggcatcttggcaagttggaactggattttaattattgcgaggggacaacggtggtgattaccgagaactgtggaactcgtggcccaagtttacggacaaccactgtctctggtaaactcatccacgaatggtgctgtcgaagctgcacactgccccctcttagatacatgggggaggacggatgttggtatggcatggaaataaggccaatttccgagaaggaagagaatatggttaaatcactggtgagcgccggttctggcaaggtagataacttcaccatgggggtgttgtgcctcgctatcctgtttgaggaagtcatgcgcggaaagttcggcaaaaagcatatgatcgccggggtgttctttacgttcgttctactgctctccggacagattacttggcgggacatggcacacaccctgatcatgattggcagtaatgctagcgatagaatgggtatgggggtgacataccttgccttgatagcaacctttaaaatccagcccttcctggccttaggatttttcctcaggaagctgacttctcgcgagaaccttctgctaggcgtcggcctcgctatggcgacaaccctgcaattgccggaagacattgagcagatggccaatgggatcgcactgggattaatggctctcaaactgattacacagtttgaaatctatcagctttggactgccctgatatccttgacctgttcaaacacgatcttcacactcaccgtggcctggcgaactgctaccctgattctagccggtgttagtctgcttcctatgtgccaaagctcgtccatgcggaagacagattggctcccaatggccgtggcggctatgggcgtaccccctctgcccttgtttatcttctctctgaaggacactttaaaacgtagaagctggccactcaatgagggggtaatggccgtgggactggtttcaattcttgcaagttccctgttgaggaacgatgtgcctatggccggccccctcgtcgctggtgggctgctaatcgcatgttacgtgataaccggaacgtctgccgacctgacagtagagaaggcggctgacattacctgggaagaggaagccgagcagactggcgtgagccataaccttatgatcacagtcgatgacgatggcaccatgcgcatcaaagacgatgaaactgagaatattctcacagttctgttgaagaccgcattactgatagtgtccgggatctttccatattcaattccggccacgctcctggtgtggcacacttggcagaaacagacccaacggagcggagtcctttgggacgtgcctagtcccccagagacacagaaggctgaactggaggaaggtgtttacagaatcaaacagcagggcattttcgggaagacccaagtaggagtgggcgtccagaaggagggtgtgtttcacacaatgtggcatgttactagaggggcagtgttgacctacaacggaaaacgactagagcccaattgggcatctgtcaagaaagatctgatctcctatggcggcgggtggcgcctcagcacgcagtggcaaaagggagaagaggtgcaggtaatagctgtcgaacctggtaaaaacccaaagaatttccagacaatgcccggcactttccagaccacaaccggggagatcggagccattgcgctggactttaagcctggcacttcgggttcaccgatcattaaccgggaagggaaagtggttggactttacggcaatggcgtggtcaccaagaacgggggatatgtgtctggtatcgcccaaacaaatgcagagccagatggccccacgcctgagttagaagaggaaatgttcaaaaagagaaacctgactataatggacctccacccagggagtggaaaaaccaggaagtacttgcccgctattgttcgtgaggccatcaagcgccggctgagaacactcatcctggctcctaccagggtggtcgcagccgaaatggaggaggcccttaaaggcctgccgattcgatatcagactacagctaccaagtccgaacatacgggtcgggagatcgtggatttgatgtgccacgcgacttttacaatgcgcctactgagccccgtaagagtgccaaattacaacctcataattatggacgaagcacatttcaccgatcctgcctctatcgctgccagggggtatattagcacccgggttggaatgggcgaggcagccgctatctttatgactgcgacacccccaggcaccgccgacgcattccctcagtccaatgctcccatacaggacgaagaacgagatattccagagagatcatggaacagtgggaatgaatggatcacagactttgccggaaaaactgtctggttcgtgccgagcatcaaggcaggtaacgatattgccaactgtttacgcaaaaatggcaagaaggtgatccaactgtctaggaaaacgtttgacaccgagtaccagaagacaaaacttaacgattgggacttcgtcgtaactaccgatatttccgaaatgggggctaattttaaggccgaccgtgtgatagatcctcggagatgcctgaaacccgttatcctcacagacggaccagagagggtgattttggcgggccccatgcctgtcaccgcagcctcagctgcccagcgccgaggtagagtggggcggaacccacagaaggagaatgatcaatacatcttcactggccagcccctgaacaatgacgaagaccacgctcactggacggaggcaaagatgctcctggataacatcaatacccctgaaggaattataccggcccttttcgagccagaaagggagaaaagtgctgccatcgacggcgagtatcgcctaaagggggaaagccgtaaaacatttgttgagctgatgagacggggagatttgcccgtgtggttagcacataaggtcgcgtccgaaggtattaaatacactgacaggaagtggtgcttcgatggccagcgcaacaatcagatcctggaggaaaacatggacgtggagatttggaccaaagagggggaaaagaagaaactccgacctagatggctggatgcccggacatattctgacccccttgctctgaaggagtttaaagagttcgccgcaggaaggaagtcgatcgctctcgatttggtaaccgagataggccgcgtgccaagccacctggcccatagaactaggaatgcactagacaacctggttatgctccacacatcagaacacggtgggcgggcctaccgtcatgctgtcgaggagcttcctgaaacgatggagaccctgttattgctgggcctcatgatcctgcttactggaggcgcgatgctgtttctcatttccgggaaaggaatcggtaagacaagtattggcttgatctgtgtgatagcctctagcgggatgctgtggatggcagaaattcccttacaatggatcgcttccgccattgtgctagagttctttatgatggtcctgctcatcccagagcctgaaaagcagcgcaccccgcaggataatcaacttgcctatgttgtgataggaatcctgaccttggcagctattatcgccgcgaacgagatgggcctgctcgaaacaactaaacgagacctgggtatgtcaaaggagcccggggtagtgtctccaacgagctaccttgatgtcgacctccaccctgctagtgcctggaccctgtatgcagtggccacaactgttattacccccatgttgagacatacaatcgaaaattccaccgctaacgtgagcctggcagccatagcgaaccaggctgtcgtattaatgggcctagacaaaggatggccaatttctaagatggatctgggcgtgcctctccttgccctggggtgctactcacaggttaatcccttgactctgacggcagccgtgctcctgcttatcacacactacgctatcattggaccgggcttacaggccaaagcaaccagggaggctcaaaagcggactgccgcgggtatcatgaagaacccaaccgtcgacgggataatgacaattgatctggaccctgtgatctatgattccaaattcgagaagcagctcggacaggtcatgttgctggtgctatgtgttgtgcagctgctccttatgcgcacaagttgggccctgtgcgaagcattgaccctggctacaggccccattacgaccctctgggagggtagcccaggcaaattttggaatactacaatcgccgtatcgatggcaaacatattcagagggtcttacctggctggagccggcttagccttttccatcatgaaaagcgtggggaccggaaaaaggggcactggttcacaaggggaaacacttggagagaagtggaagaaaaagctgaatcagctcagtcggaaagacttcgatctatataagaaatctggcattaccgaagtcgaccgaacggaggcgaaggagggtctgaaaagaggcgaaatcacccatcacgctgtttcccgcgggagcgcaaagttgcagtggtttgtggagaggaacatggtcattcccgaaggacgggtgatcgatctgggctgtgggcgtggaggctggtcatactattgcgccggtctcaagaaagtaacagaggtgagagggtacactaagggaggccctggccacgaggaaccggttcccatgagtacctatgggtggaatattgtgaaacttatgagcggaaaggacgtcttctacctgccacctgagaaatgtgatacattgctgtgcgacatcggtgaatcctctcccagccctactgtggaggaatccaggaccatacgcgtcctcaagatggtggagccatggttaaagaacaatcagttctgtattaaagttctgaacccctacatgcctacagtaatcgagcatcttgaacggctgcaacgaaagcacggcgggatgctagtgagaaatccactctcaaggaactctacccatgagatgtattggatcagtaatggaactggcaacattgtcgcttcggtgaatatggttagccgcctgttgctgaaccggtttacgatgacacacagacgtcccaccatagaaaaagatgtggacctcggtgccgggactaggcacgtcaacgcagagccggaaacccctaatatggacgtgatcggagagcggattaagcgcatcaaagaggaacataactccacatggcactacgatgacgagaatccatataagacgtgggcctaccatggctcttatgaagtaaaggctaccggctcagcgagctccatgattaacggggtggttaaacttctgactaagccctgggatgtcgtgcctatggtgacacagatggccatgaccgacactacaccattcggacagcaacgagtctttaaagagaaggttgataccagaacacccaggagtatgccgggtactcggcgcgtgatgggcatcaccgcagaatggttatggagaacgctggggaggaataaaaagcctcgattgtgcacccgggaggagttcacaaagaaagtacgtactaacgctgccatgggagcagtgtttaccgaagagaatcagtgggactctgccaaggctgccgtcgaagatgaggacttctggaaactcgtggatagagaacgcgagctgcacaagctaggcaaatgtggtagctgcgtttacaacatgatggggaagagggagaagaaacttggagaatttggcaaagcgaaaggctcacgggcaatatggtatatgtggctgggggccagatacctcgagttcgaagctctgggatttttgaatgaggaccattggttctcccgcgagaacagttacagcggtgtggaaggcgaggggctgcacaagctcggatatatccttagggatatttctaaaatccccggcggtgccatgtacgcagacgacacagctgggtgggatactcgaattaccgaagacgatctgcacaatgaggaaaagatcacgcagcagatggacccagagcatcggcaattagccaacgctatatttaaactgacatatcagaataaggtcgtgaaggtacagagacctacccccactggaacagttatggatattatctccaggaaagaccagcgcggctcaggccaagtggggacctacggattgaacactttcaccaatatggaggcccagctcatccgtcagatggaaggtgagggcgtcctgagcaaggcagatctagaaaacccacaccttcccgagaaaaagattacacagtggctggaaacgaaaggggtggagcggctcaagagaatggcgatatcgggagacgattgcgtggtcaagcctatcgacgataggtttgccaacgctctgttggccttaaatgacatgggcaaagttcgcaaggatattccacaatggcagccgtctaaaggttggcatgactggcaacaggtgcccttctgtagtcaccacttccatgagctgatcatgaaggacgggcgaaaactcgtagtgccttgccggccacaagatgaacttattggaagggcaaggatctcccagggcgctggctggagcctgaaggagaccgcctgtctagggaaggcatatgcccagatgtggtcactgatgtactttcaccgcagagacctccggttggcgtccaacgctatatgctctgccgtccccgtgcattgggttcctactagcaggacaacctggagtatccacgcacatcaccaatggatgactacagaagatatgctgaccgtgtggaatcgtgtctggattgaggacaacccatggatggaagataaaacgcccgtgacaacctgggagaatgtaccttatcttggaaagcgagaggaccagtggtgtggttccctgatcggcctcactagccgcgccacctgggctcagaacattccgacagccatccagcaagttagatctttaattgggaatgaagagttcctggattacatgccatcaatgaaacggtttaggaaggaagaggagagtgaaggagcaatatggtga

SEQ ID NO: 15320 - RNA, 9873 nt, synthetic construct
  misc_feature 1..9873: note = derived and/or modified CDS sequence (opt3) from DENV-3__JN093513__SS-prME
  source 1..9873: mol_type = other RNA
accagcctgtgcctcatgatgatccttcccgccgctctggcattccacttgacatccagagacggcgaacctagaatgattgtggggaagaacgaacggggtaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcaaaattcagggggaacaagcatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgactaagaaggaggaacccgtaaacattgaggcagaaccgcctttcggcgagtcaaatatcgtcatcggaattggcgataacgccttgaaaatcaattggtacaagaaggggagcagtattggaaaaatgtttgaagctactgcccgcggtgcaagaaggatggccatactgggcgacaccgcttgggatttcgggtctgtgggaggcgttctcaactccctgggtaagatggtgcatcagatctttgggagcgcctatacggcacttttctcgggcgtctcttgggtgatgaaaattggaatcggcgtactgttgacatggatcgggctcaattccaagaacacctcaatgagttttagctgcattgcgataggaatcattactctgtacttaggcgctgtggttcaggccgacatgggttgtgtcatcaattggaaagggaaggagctgaagtgcggatccggcattttcgtgacaaacgaggtgcacacctggactgaacagtataaatttcaagcagattctcccaagcggctagccaccgctatcgccggtgcatgggagaatggcgtctgtgggatacgaagcacaacgcgcatggaaaacctcctgtggaaacagatcgctaatgagcttaactacattttgtgggaaaataacatcaagctgaccgttgtggtgggagacattatcggcgtactcgagcaggggaaaagaactctgacaccacagcctatggagttaaagtattcatggaaaacctggggaaaggccaagatagtcacagcggaaactcaaaacagttccttcattatcgatggccccaataccccagagtgccccagcgtgtctagggcctggaacgtttgggaagtggaggactacggttttggggtcttcacgacaaatatttggctgaaacttcgggaagtgtatacccagttgtgtgaccaccgcctcatgtcagctgcagttaaggatgagagagccgtgcatgctgacatgggatactggatcgagagtcagaaaaacggcagctggaagctggaaaaagcctccctaatagaggtaaagacttgcacctggcctaagtctcacacactgtggtcgaatggtgtcctcgaaagcgatatgatcattccaaaatccctggcaggcccgatctcacagcataaccacaggcccgggtaccacactcaaaccgcgggaccttggcatcttggcaagttggagctggactttaattattgcgaggggacaacggtggtgattaccgaaaactgtggaactcgtggcccaagtttacggacaaccactgtctctggtaaactcatccacgagtggtgctgtcgaagctgcacactgccccctcttagatacatgggggaagatggatgttggtatggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcatatgatcgccggggtgttctttacgttcgttctactgctctccggacagattacttggcgggatatggcacacaccctgatcatgattggcagtaatacaagcgacagaatgggtatgggggtgacctaccttgctttgatagccacttttaaaatccagcccttcctggcattaggatttttcctcaggaagctgacatctcgcgaaaaccttctgctaggcgtcggcctcgccatggctaccacactgcaattgccggaggatattgaacagatggcgaatgggatcgccctgggattaatggcactcaaactgattactcagtttgagatctatcagctttggaccgctctgatatccttgacgtgttcaaacacaatcttcaccctcactgtggcctggcgaaccgccacactgattctagctggtgttagtctgcttcctgtgtgccaaagctcgtccatgcggaagactgactggctcccaatggcagtcgccgcgatgggcgtaccccctctgcccttgtttatcttcgggctgaaggataccttaaaacgtagatcttggccactcaatgagggagtgatggctgttggcctggtgagcattcttgcctcaagtctgttgaggaacgacgtccctatggcaggtcccctcgtggccgggggactgctaatcgcttgttacgtaataacgggcacatccgcagatctgaccgtggaaaaggccgcggacattacttgggaggaagaggctgaacagacaggcgtctctcataaccttatgatcaccgttgacgatgacgggactatgcgcatcaaagatgacgagacagagaatattctcaccgtgctgttgaagacggccttactgatagtgagcggaatctttccatattccattccggcaactctcctggtctggcacacctggcagaaacagacacaacggtcaggtgtgctttgggatgttcctagtcccccagaaacccagaaggccgagctggaagagggcgtatacagaatcaaacagcaggggattttcggaaagacacaagtgggcgtcggtgtgcagaaggagggggtttttcacactatgtggcatgtgaccaggggagctgtcttgacgtacaacggcaaacgactagaacccaattgggccagtgtgaagaaagacctgatctcttatggcgggggatggcgcctctccgcacagtggcaaaagggtgaggaagtacaggtcatagctgtggagcctggcaaaaacccaaagaatttccagacaatgcccgggactttccagaccacaaccggagaaatcggcgccattgcgctggattttaagcctggtactagcgggtcgccgatcattaaccgggagggaaaagttgtgggcctttacggcaatggggtcgtgaccaagaacggaggttatgtttcaggcatcgcccaaacaaatgcagagccagacgggcccacgcctgaattagaggaagagatgttcaaaaagagaaacctgactataatggatctccacccaggatctggcaaaaccaggaagtacttgcccgctattgtgcgtgaagccatcaagcgccggctgagaacactcatcctggctcctaccagggtcgtggcagccgagatggaggaagcccttaaaggtctgccgattcgatatcagactacagctaccaagagtgagcatacggggcgggaaatcgtagacttgatgtgccacgcgacttttacaatgcgcctactgtcccccgtgagagttccaaattacaacctcataattatggatgaggcacatttcaccgaccctgccagcatcgctgccaggggatatatttctacccgggtcggcatgggcgaagcagccgctatctttatgactgcgacacccccagggaccgccgatgcattccctcagagcaatgctcccatacaggacgaggagcgagacattccagaaagatcctggaactcaggaaatgagtggatcacagattttgccggtaaaactgtgtggttcgtgccgagtatcaaggcaggcaacgacattgccaactgtttacgcaaaaatgggaagaaggtcatccaactgagcaggaaaacgtttgataccgaataccagaagacaaaacttaacgactgggatttcgtagtgactaccgacatttctgagatgggagctaattttaaggccgatcgtgttatagaccctcggagatgcctgaaacccgtgatcctcacagatggcccagagagggtcattttggcgggtcccatgcctgtgaccgcagcctccgctgcccagcgccgagggagagttggccggaacccacagaaggaaaatgaccaatacatcttcactggacagcccctgaacaatgatgaggaccacgctcactggacggaagcaaagatgctcctggacaacatcaatacccctgagggcattataccggcccttttcgaaccagagagggagaaatcagctgccatcgatggggaatatcgcctaaagggagagagtcgtaaaacatttgtggaactgatgagacggggtgacttgcccgtctggttagcacataaggtggcgagcgagggcattaaatacactgataggaagtggtgcttcgacgggcagcgcaacaatcagatcctggaagagaacatggatgtagagatttggaccaaagaaggagagaagaagaaactccgacctagatggctggacgcccggacatattccgatccccttgctctgaaggaatttaaagagttcgccgcaggcaggaagtctatcgctctcgacttggtgaccgaaataggtcgcgttccatcgcacctggcccatagaactaggaatgcactagataacctggtcatgctccacacaagcgagcacgggggccgggcctaccgtcatgctgtggaggaacttcctgagacgatggaaaccctgttattgctgggactcatgatcctgcttactggcggggcgatgctgtttctcatttcaggaaaaggtatcggcaagacatccattgggttgatctgtgtgatagccagttctggaatgctgtggatggcagagattcccttacaatggatcgctagcgccattgtcctagagttctttatgatggttctgctcatcccagaacctgagaagcagcgcaccccgcaggacaatcaacttgcctatgtggtaataggcatcctgaccttggcagctattatcgccgcgaacgaaatgggtctgctcgagacaactaaacgagatctggggatgtccaaggaacccggcgtggtctcaccaacgtcttaccttgacgtggatctccaccctgctagcgcctggaccctgtatgcagttgccacaactgtgattacccccatgttgagacatacaatcgagaatagtaccgctaacgtctccctggcagccatagcgaaccaggctgtagtgttaatgggactagacaaaggctggccaattagcaagatggacctgggggttcctctccttgccctgggatgctactctcaggtgaatcccttgactctgacggcagccgtcctcctgcttatcacacactacgctatcattggcccgggtttacaggccaaagcaaccagggaggctcaaaagcggactgccgcggggatcatgaagaacccaaccgtggatggaataatgacaattgacctggatcctgtcatctatgactcaaaattcgaaaagcagctcggccaggtgatgttgctggttctatgtgccgtgcagctgctccttatgcgcacttcctgggcactgtgcgaggctttgaccctggccacaggtcccattacgaccctctgggaaggcagtccagggaaattttggaatactacaatcgcagtaagcatggctaacatattcagaggatcgtacctggccggcgccgggttagcgttttctatcatgaagtccgtgggaaccggcaaaaggggtactgggagccaaggagagacacttggcgaaaagtggaagaaaaagctgaatcagctctcacggaaagatttcgacctatataagaaaagtggtattaccgaggtcgatcgaacggaggctaaggaaggcctgaaaagaggggagatcacccatcacgcagtttctcgcggatccgccaagttgcagtggtttgtggaaaggaacatggtcattcccgagggccgggtgatcgacctggggtgtggacgtggcggttggagctactattgcgctgggctcaagaaagtaacagaagtgagaggatacactaagggcggccctgggcacgaggagccggttcccatgtcaacctatggatggaatattgtgaaacttatgagtggtaaggatgtcttctacctgccacctgaaaaatgtgacacattgctgtgcgatatcggcgagagctccccctctcctactgtggaagagagcaggaccatacgcgtcctcaagatggtggagccatggttaaagaacaatcagttctgtattaaagttctgaacccctacatgcctacagtaatcgaacatcttgagcggctgcaacgaaagcacgggggaatgctagtgagaaatccactctccaggaactcaacccatgaaatgtattggatctctaatggcactggtaacattgtcgccagtgtgaatatggtttcgcgcctgttgctgaaccggtttacgatgacacacagacgtcccaccatagagaaagacgtggatctcggggcaggaactaggcacgtcaacgccgaaccggagacccctaatatggacgtgatcggcgagcggattaagcgcatcaaagaagaacataacagcacatggcactacgacgatgaaaatccatataagacgtgggcttaccatggctcctatgaggtaaaggcgaccgggtctgcctcaagcatgattaacggagtggttaaacttctgactaagccctgggacgtcgtgcctatggtgacacagatggcaatgaccgatactacaccattcggtcagcaacgagtctttaaagaaaaggttgacaccagaacacccaggtccatgccgggcactcggcgcgtgatggggatcaccgctgagtggttatggagaacgctgggaaggaataaaaagcctcgattgtgcacccgggaggagttcacaaagaaagtacgtactaacgccgcaatgggcgccgtgtttaccgaggaaaatcagtgggatagtgctaaggccgcggtcgaggacgaagatttctggaaactcgtggacagagagcgcgagctgcacaagctaggtaaatgtgggtcttgcgtttacaacatgatgggaaagagggagaagaaacttggcgagtttggcaaagcaaaagggagccgggccatatggtatatgtggctgggagctagatacctcgagttcgaggccctgggatttttgaatgaggatcattggttctcacgcgaaaactcctacagtggcgtggagggggaaggactgcacaagctcggctatatccttagggacattagcaaaatccccggtggggcaatgtacgctgatgacacagccggatgggacactcgaattaccgaggatgacctgcacaatgaagagaagatcacgcagcagatggatccagagcatcggcaattagctaacgccatatttaaactgacatatcagaataaggtcgtgaaggtacagagacctacccccactggcacagttatggacattatctctaggaaagatcagcgcggctccgggcaagtgggaacctacggtttgaacactttcaccaatatggaagcacagctcatccgtcagatggagggcgaaggggtcctgtcaaaggcggacctagagaacccacaccttcccgagaaaaagattacacagtggctggagacgaaaggagtggagcggctcaagagaatggccataagcggcgatgactgcgtggtcaagcctatcgatgacaggtttgctaacgccctgttggcattaaatgatatgggtaaagttcgcaaggacattccacaatggcagccgtcgaaagggtggcatgattggcaacaggtgcccttctgttctcaccacttccatgaactgatcatgaaggacggacgaaaactcgtagtgccttgccggccacaagacgagcttattggcagagctaggatcagtcagggcgccgggtggtccctgaaggaaaccgcatgtctaggaaaggcctatgcgcagatgtggagcctgatgtactttcaccgcagagatctccggttggcttcaaacgccatatgctccgcagtccccgtgcattgggttcctacttctaggacaacctggagcatccacgcccatcaccaatggatgactacagaggacatgctgaccgtgtggaatcgtgtctggattgaagataacccatggatggaggacaaaacgcccgtgacaacctgggagaatgtaccttatcttggtaagcgagaagatcagtggtgtggcagtctgatcgggctcacttcccgcgctacctgggcccagaacattccgacagcaatccagcaagttaggagcttaattggaaatgaggagttcctggactacatgccatctatgaaacggtttaggaaggaggaggaatcagagggcgctatatggtga

SEQ ID NO: 15321 - RNA, 9873 nt, synthetic construct
  misc_feature 1..9873: note = derived and/or modified CDS sequence (opt3) from DENV-3__JF937624__SS-prME
  source 1..9873: mol_type = other RNA
accagcctgtgcctcatgatgatccttcccgcagctctggcattccacttgacatccagagacggcgaacctagaatgattgtggggaagaacgaacggggtaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagcatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgactaagaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagccggtgttagtctgcttcctgtgtgccaaagctcgtccatgcggaagactgactggctcccaatggccgtcgcggctatgggcgtaccccctctgcccttgtttattttcgggctgaaggataccttaaaacgtagatcttggccactcaatgagggagtgatggccgttggcctggtgagcatccttgcatcaagtctgttgaggaacgacgtccctatggccggtcccctcgtggctgggggactgctaattgcatgttatgtaatcacgggcacatccgccgatctgaccgtggaaaaggcggctgacataacttgggaggaagaggccgaacagacaggcgtctctcacaaccttatgattaccgttgacgatgacgggactatgcgcatcaaagatgacgagacagagaatatcctcaccgtgctgttgaagacggcattactgattgtgagcggaatatttccatactccatcccggccactctcctggtctggcatacctggcagaaacagacacaacggtcaggtgtgctttgggatgttcctagtcccccagaaacccagaaggctgagctggaagagggcgtatacagaattaaacagcaggggatcttcggaaagacacaagtgggcgtcggtgtgcagaaggagggggtttttcacactatgtggcacgtgaccaggggagccgtcttgacgtataacggcaaacgactagaacccaattgggcaagtgtgaagaaagacctgatttcttacggcgggggatggcgcctctccgctcagtggcaaaagggtgaggaagtacaggtcatcgccgtggagcctggcaaaaacccaaagaatttccagacaatgcccgggactttccagaccataacaggagaaatcggcgcgattgccctggattttaagcctggtaccagcgggtcgccgatcattaaccgggagggaaaagttgtgggcctttatggcaatggggtcgtgactaagaacggaggttacgtttcaggcatcgcacaaaccaatgctgagccagacgggcccacacctgaattagaggaagagatgttcaaaaagagaaacctgacgataatggatctccatccaggatctggcaaaactaggaagtatttgcccgccattgtgcgtgaagctatcaagcgccggctgagaaccctcatcctggcacctacaagggtcgtggccgccgagatggaggaagctcttaaaggtctgccgattcgataccagaccactgcgacaaagagtgagcacaccgggcgggaaatcgtagacttgatgtgccatgcaacgtttactatgcgcctactgtcccccgtgagagttccaaattataacctcataattatggatgaggcccacttcacagaccctgctagcatcgccgcaaggggatacatttctacccgggtcggcatgggcgaagccgctgcgatctttatgaccgccactcccccagggacagcagatgctttccctcagagcaatgcccccatacaggacgaggagcgagacattccagaaagatcctggaactcaggaaatgagtggatcaccgattttgcaggtaaaacagtgtggttcgtgccgagtatcaaggccggcaacgacattgctaactgtttacgcaaaaatgggaagaaggtcatccaactgagcaggaaaacttttgatacggaataccagaagaccaaacttaacgactgggatttcgtagtgacaactgacatttctgagatgggagccaattttaaggcggatcgtgttatagaccctcggagatgcctgaaacccgtgatcctcaccgatggcccagagagggtcattttggcaggtcccatgcctgtgacagccgcttccgccgctcagcgccgagggagagttggccggaacccacagaaggaaaatgaccaatatatcttcaccggacagcccctgaacaatgatgaggaccatgcacactggactgaagccaagatgctcctggacaacatcaatacgcctgagggcattataccggctcttttcgaaccagagagggagaaatcagccgcaatcgatggggaataccgcctaaagggagagagtcgtaaaacctttgtggaactgatgagacggggtgacttgcccgtctggttagcgcacaaggtggccagcgagggcattaaatatacagataggaagtggtgcttcgacgggcagcgcaacaatcagatcctggaagagaacatggatgtagagatttggactaaagaaggagagaagaagaaactccgacctagatggctggacgctcggacctactccgatccccttgccctgaaggaatttaaagagttcgcagctggcaggaagtctatcgccctcgacttggtgacagaaataggtcgcgttccatcgcatctggcacacagaaccaggaatgccctagataacctggtcatgctccatactagcgagcacgggggccgggcttatcgtcacgcggtggaggaacttcctgagacaatggaaacgctgttattgctgggactcatgatcctgcttaccggcggggccatgctgtttctcatttcaggaaaaggtatcggcaagacttccattgggttgatctgtgtgatagcaagttctggaatgctgtggatggctgagattcccttacaatggatcgccagcgccattgtcctagagttctttatgatggttctgctcatcccagaacctgagaagcagcgcacaccgcaggacaatcaacttgcatacgtggtaataggcatcctgaccttggctgccattatcgcggctaacgaaatgggtctgctcgagaccacaaaacgagatctggggatgtccaaggaacccggcgtggtctcaccaacttcttatcttgacgtggatctccatcctgccagcgcatggacgctgtacgccgttgctaccacagtgattactcccatgttgagacacaccatcgagaatagtacagcaaacgtctccctggccgcgatagctaaccaggccgtagtgttaatgggactagacaaaggctggccaattagcaagatggacctgggggttcctctccttgcactgggatgctactctcaggtgaatcccttgaccctgactgccgctgtcctcctgcttatcacgcattatgccatcattggcccgggtttacaggcaaaagctacaagggaggcccaaaagcggaccgcggccgggatcatgaagaacccaactgtggatggaataatgaccattgacctggatcctgtcatctacgactcaaaattcgaaaagcagctcggccaggtgatgttgctggttctatgtgcagtgcagctgctccttatgcgcacatcctgggctctgtgcgaggccttgactctggcaaccggtcccattacaacgctctgggaaggcagtccagggaaattttggaataccactatcgctgtaagcatggccaacatattcagaggatcgtatctggccggcgcggggttagctttttctatcatgaagtccgtgggaacaggcaaaaggggtaccgggagccaaggagagactcttggcgaaaagtggaagaaaaagctgaatcagctctcacggaaagatttcgacctatacaagaaaagtggtattacagaggtcgatcgaaccgaggcaaaggaaggcctgaaaagaggggagatcacgcaccatgccgtttctcgcggatccgctaagttgcagtggtttgtggaaaggaacatggtcattcccgagggccgggtgatcgacctggggtgtggacgtggcggttggagctattactgcgccgggctcaagaaagtaaccgaagtgagaggatatacaaagggcggccctgggcacgaggagccggttcccatgtcaacttacggatggaatattgtgaaacttatgagtggtaaggatgtcttctacctgccacctgaaaaatgtgacaccttgctgtgcgatatcggcgagagctccccctctcctacagtggaagagagcaggactatacgcgtcctcaagatggtggagccatggttaaagaacaatcagttctgtattaaagttctgaacccctatatgcctaccgtaatcgaacaccttgagcggctgcaacgaaagcatgggggaatgctagtgagaaatccactctccaggaactcaacacacgaaatgtactggatctctaatggcaccggtaacattgtcgcaagtgtgaatatggtttcgcgcctgttgctgaaccggtttactatgacgcatagacgtcccacaatagagaaagacgtggatctcggggccggaaccaggcacgtcaacgctgaaccggagactcctaatatggacgtgatcggcgagcggattaagcgcatcaaagaagaacacaacagcacctggcattatgacgatgaaaatccatacaagacatgggcgtatcacggctcctacgaggtaaaggccacggggtctgcatcaagcatgattaacggagtggttaaacttctgaccaagccctgggacgtcgtgcctatggtgactcagatggctatgacagataccactccattcggtcagcaacgagtctttaaagaaaaggttgacacaagaacccccaggtccatgccgggcacacggcgcatcatggggataactgccgagtggttatggagaaccctgggaaggaataaaaagcctcgattgtgcacgcgggaggagttcaccaagaaagtgcgtacaaacgcagccatgggcgctgtatttactgaggaaaatcagtgggatagtgccaaggcggcagtggaggacgaagatttctggaaactcgtcgacagagagcgcgagctgcataagctaggtaaatgtgggtcttgcgtgtataacatgatgggaaagagggagaagaaacttggcgagtttggcaaagccaaagggagccgggctatctggtacatgtggctgggagccagatacctcgagttcgaggcactgggatttttgaatgaggatcactggttctcacgcgaaaactcctatagtggcgttgagggggaaggactgcataagctcggctacattcttagggacatcagcaaaattcccggtggggctatgtatgccgatgacaccgctggatgggacacacgaatcactgaggatgacctgcacaatgaagagaagataacccagcagatggatccagagcaccggcaattagccaacgcaatttttaaactgacgtaccagaataaggtggtcaaggtgcagagacctacacccaccggcactgtaatggacatcatctctaggaaagatcagcgcggctccgggcaagttggaacatatggtttgaacaccttcactaatatggaagcgcagctcattcgtcagatggagggcgaaggggtgctgtcaaaggccgacctagagaacccacatcttcccgagaaaaagataacccagtggctggagacaaaaggagtcgagcggctcaagagaatggctatcagcggcgatgactgcgtggtgaagcctattgatgacaggtttgccaacgcactgttggctttaaatgatatgggtaaagtccgcaaggacatcccacaatggcagccgtcgaaagggtggcacgattggcagcaggttcccttctgttctcatcacttccacgaactgattatgaaggacggacgaaaactcgtggtaccttgccggccacaagacgagcttatcggcagagccaggataagtcagggcgcagggtggtccctgaaggaaacggcctgtctaggaaaggcgtacgctcagatgtggagcctgatgtattttcatcgcagagatctccggttggcctcaaacgcaatctgctccgccgtgcccgtccactgggtgcctacctctaggactacatggagcattcatgctcaccatcaatggatgaccactgaggacatgctgacagtttggaatcgtgtgtggatcgaagataacccatggatggaggacaaaacccccgtcacgacatgggagaatgtgccttaccttggtaagcgagaagatcagtggtgtggcagtctgattgggctcacctcccgcgccacttgggcacagaacatcccgaccgctattcagcaagtaaggagcttaataggaaatgaggagttcctggactacatgccatctatgaaacggtttaggaaggaggaggaatcagagggcgccatctggtga

SEQ ID NO: 15322 - RNA, 9873 nt, synthetic construct
  misc_feature 1..9873: note = derived and/or modified CDS sequence (opt3) from DENV-3__JN000938__SS-prME
  source 1..9873: mol_type = other RNA
accagcctgtgcctcatgatgatccttcccgccgctctggcattccacttgacttccagagacggcgaacctaggatgattgtggggaagaacgaacggggaaaatctttactgtttaagactgcctcaggtataaatatgtgtacgctaatcgcgatggatctcggcgaaatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgactaagaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccattctccgaaaaggaggagaatatggttaaatcactggtgagcgccggtggcgggaaggtagacaactttaccatgggagtgttgtgcctcgctattctgttcgaagaggtcatgcgcggcaagttcgggaaaaagcacatgatcgccggagtgtttttcacgtttgttctactgctctctggccagatcacttggcgggatatggcacataccctgattatgatcggttccaatgctagtgacagaatggggatgggagtgacatatcttgccttgattgcaaccttcaaaatacagccctttctggccttaggcttctttctcaggaagctgactagccgcgaaaaccttctgctaggcgtcgggctcgctatggcgacaaccctgcaattgccggaggatatcgaacagatggccaatggaattgcactgggtttaatggctctcaaactgatcacacagttcgagacttaccagctttggaccgccctgatttctttgacgtgttccaacacaatctttaccctcactgtggcctggcgaaccgctacactgatactagcaggcgtttcactgcttcctgtgtgccaaagtagctcgatgcggaagactgactggctcccaatggccgtcgcggctatgggggtaccccctctgcccttgttcatctttggactgaaggataccttaaaacgtagatcctggccactcaatgagggcgtgatggccgttggtctggtgtctattcttgcaagctcactgttgaggaacgacgtccctatggccgggcccctcgtggctggaggcctgctaatcgcatgttatgtaattacgggcacaagtgccgatctgaccgtggaaaaggcggctgacatcacttgggaggaagaggccgaacagacaggggtctcccacaaccttatgataaccgttgacgatgacggaactatgcgcattaaagatgacgagacagagaatatcctcaccgtgctgttgaagacggcattactgatcgtgtctggtattttcccatacagcataccggccactctcctggtctggcatacctggcagaaacagacacaacggtccggcgtgctttgggatgttccttcacccccagaaacccagaaggctgagctggaagagggggtatacagaatcaaacagcagggaatttttggcaagacacaagtgggtgtcggggtgcagaaggagggagttttccacactatgtggcacgtgaccaggggcgccgtcttgacgtataacggcaaacgactagaacccaattgggcaagcgtgaagaaagacctgatcagttacgggggaggttggcgcctctctgctcagtggcaaaagggcgaggaagtacaggtcattgccgtggagcctgggaaaaacccaaagaatttccagacaatgcccggaacttttcagaccacaaccggcgaaatcggtgcgatagccctggatttcaagcctgggacttccggaagcccgatcattaaccgggagggcaaagttgtgggcctttatgggaatggagtcgtgaccaagaacggtggctacgtttcggggatcgcacaaacaaatgctgagccagacggacccacgcctgaattagaggaagagatgtttaaaaagagaaacctgactattatggatctccatccaggctcaggtaaaaccaggaagtatttgcccgccatcgtgcgtgaagctataaagcgccggctgagaacactcattctggcacctaccagggtcgtggccgccgagatggaggaagctcttaaagggctgccgatccgataccagactacagcgaccaagtctgagcacacgggacgggaaatcgtagacttgatgtgccatgcaactttcacaatgcgcctactgagtcccgtgagagttccaaattataacctcattatcatggatgaggcccactttaccgaccctgcttccatagccgcaaggggctacattagcacccgggtcggcatgggggaagccgctgcgatcttcatgactgccacacccccaggaaccgcagatgcttttcctcagtctaatgcccccattcaggacgaggagcgagacatcccagaaagaagctggaactccggtaatgagtggataacagatttcgcaggcaaaactgtgtggtttgtgccgtcaattaaggccgggaacgacatcgctaactgtttacgcaaaaatggaaagaaggtcatccaactgagtaggaaaacgttcgataccgaataccagaagacaaaacttaacgactgggattttgtagtgactaccgacattagcgagatgggcgccaatttcaaggcggatcgtgttatcgaccctcggagatgcctgaaacccgtgattctcacagatggtccagagagggtcatattggcagggcccatgcctgtgaccgccgcttctgccgctcagcgccgaggcagagttggacggaacccacagaaggaaaatgaccaatatatcttcactggccagcccctgaacaatgatgaggaccatgcacactggacggaagccaagatgctcctggacaacattaatacccctgaggggatcatcccggctctttttgaaccagagagggagaaatccgccgcaattgatggagaataccgcctaaagggtgagtcacgtaaaacattcgtggaactgatgagacggggcgacttgcccgtctggttagcgcacaaggtggccagtgaggggataaaatatactgataggaagtggtgctttgacggacagcgcaacaatcagatcctggaagagaacatggatgtagagatttggaccaaagaaggcgagaagaagaaactccgacctagatggctggacgctcggacatacagcgatccccttgccctgaaggagttcaaagagtttgcagctggtaggaagtccatcgccctcgacttggtgaccgaaattgggcgcgttccatctcatctggcacacagaactaggaatgccctagataacctggtcatgctccatacatcggagcacggcggacgggcttatcgtcacgcggtggaggaacttcctgagacgatggaaaccctgttattgctgggcctcatgatcctgcttactgggggagccatgctgttcctcataagcggtaaaggcatcgggaagacatcaattggattgatctgtgtgattgcatccagtggcatgctgtggatggctgagatccccttacaatggatagcctctgccattgtcctagagtttttcatgatggttctgctcatcccagaacctgagaagcagcgcaccccgcaggacaatcaacttgcatacgtggtaattggtatcctgaccttggctgccataatcgcggctaacgaaatggggctgctcgagacaactaaacgagatctgggcatgagcaaggaacccggagtggtctccccaacgtcatatcttgacgtggatctccatcctgcctctgcatggaccctgtacgccgttgctacaactgtgattacccccatgttgagacacacaatcgagaatagcaccgcaaacgtcagtctggccgcgattgctaaccaggccgtagtgttaatgggcctagacaaagggtggccaatctccaagatggacctgggagttcctctccttgcactgggctgctacagccaggtgaatcccttgactctgacggccgctgtcctcctgcttataacacattatgccattatcggtccggggttacaggcaaaagctaccagggaggcccaaaagcggactgcggccggaatcatgaagaacccaaccgtggatggcattatgacaatcgacctggatcctgtcatatacgactctaaatttgaaaagcagctcggtcaggtgatgttgctggttctatgtgcagtgcagctgctccttatgcgcacttcatgggctctgtgcgaggccttgaccctggcaacaggccccattacgaccctctgggaagggtccccaggaaaattctggaatactacaatcgctgtaagtatggccaacatttttagaggcagctatctggccggggcgggattagctttctcgatcatgaagtctgtgggcaccggtaaaagggggactggatcccaaggcgagacacttggtgaaaagtggaagaaaaagctgaatcagctcagccggaaagattttgacctatacaagaaatcaggcataaccgaggtcgatcgaacggaggcaaaggaagggctgaaaagaggagagatcacccaccatgccgttagtcgcggctctgctaagttgcagtggttcgtggaaaggaacatggtcattcccgaggggcgggtgatcgacctgggatgtggccgtggtgggtggtcctattactgcgccggactcaagaaagtaacagaagtgagaggctatactaagggcgggcctggacacgaggagccggttcccatgagcacctacggttggaatattgtgaaacttatgtcaggcaaggatgtcttctacctgccacctgaaaaatgtgacacattgctgtgcgatatcggggagagtagcccctcccctactgtggaagagtctaggaccattcgcgtcctcaagatggtggagccatggttaaagaacaatcagttttgtatcaaagttctgaacccctatatgcctacagtaatagaacaccttgagcggctgcaacgaaagcatggaggcatgctagtgagaaatccactcagcaggaactccacccacgaaatgtactggatttcaaatggtactgggaacatcgtcgcatctgtgaatatggttagtcgcctgttgctgaaccggttcacgatgacacatagacgtcccaccatcgagaaagacgtggatctcggagccggcactaggcacgtcaacgctgaaccggagacccctaatatggacgtgattggcgagcggataaagcgcatcaaagaagaacacaactcgacatggcattatgacgatgaaaatccatacaagacgtgggcgtatcacgggagctacgaggtaaaggccaccggatccgcatcttcaatgattaacggtgtggttaaacttctgactaagccctgggacgtcgtgcctatggtgacacagatggctatgaccgatactacaccatttggccagcaacgagtcttcaaagaaaaggttgacaccagaacacccaggagcatgccggggactcggcgcgtgatgggaatcaccgccgagtggttatggagaacgctgggcaggaataaaaagcctcgattgtgcacccgggaggaatttacaaagaaagtacgtactaacgcagccatgggtgctgtgttcaccgaggaaaatcagtgggattccgccaaggcggcagtcgaggacgaagatttttggaaactcgtggacagagagcgcgagctgcataagctagggaaatgtggaagttgcgtttataacatgatgggcaagagggagaagaaacttggcgagttcgggaaagccaaaggatctcgggctatttggtacatgtggctgggtgccagatacctcgaatttgaggcactgggcttcttgaatgaggatcactggtttagccgcgaaaactcatattccggggtggagggagaaggcctgcataagctcggttacatccttagggacataagtaaaatccccgggggagctatgtatgccgatgacacagctggctgggacactcgaattaccgaggatgacctgcacaatgaagagaagatcacgcagcagatggatccagagcaccggcaattagccaacgcaattttcaaactgacataccagaataaggtcgtgaaggtacagagacctacccccactggcacagttatggacatcataagcaggaaagatcagcgcgggtctggacaagtgggtacctatggcttgaacacttttaccaatatggaagcgcagctcattcgtcagatggagggggaaggagtcctgtccaaggccgacctagagaacccacatcttcccgagaaaaagatcacacagtggctggagacgaaaggcgtggagcggctcaagagaatggctatctcaggtgatgactgcgtggtcaagcctattgatgacaggttcgccaacgcactgttggctttaaatgatatggggaaagttcgcaaggacataccacaatggcagccgagcaaaggatggcacgattggcaacaggtgcccttctgttcgcatcactttcacgaactgatcatgaaggacggccgaaaactcgtagtgccttgccggccacaagacgagcttattggcagagccaggatctctcagggggcaggatggagtctgaaggaaaccgcctgtctaggtaaggcgtacgctcagatgtggtccctgatgtatttccatcgcagagatctccggttggccagcaacgcaatttgctcagccgtccccgtgcactgggttcctacttccaggacaacctggtctatccatgctcaccatcaatggatgactacagaggacatgctgaccgtgtggaatcgtgtctggatagaagataacccatggatggaggacaaaacgcccgtgacaacctgggagaatgtaccttaccttggcaagcgagaagatcagtggtgtgggagcctgatcggactcacaagtcgcgccacctgggcacagaacattccgacagctatccagcaagttagatccttaattggcaatgaggaatttctggactacatgccaagcatgaaacggttcaggaaggaggaggaatctgagggtgccatctggtga

SEQ ID NO: 15323 - RNA, 9873 nt, synthetic construct
  misc_feature 1..9873: note = derived and/or modified CDS sequence (opt3) from DENV-3__JN093515__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcagaattcagggggaactagtatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgacaaaacgcgaggaacccgtaaacattgaggcagaaccgcctttcggcgagtcaaatatcgtcatcggaattggcgataacgccttgaagatcaattggtacaaaaaggggagcagtattggaaagatgtttgaagctactgccagaggtgcaaggcggatggccatactgggcgacaccgcttgggatttcgggtctgtgggaggcgttctcaactccctgggtaaaatggtgcatcagatctttgggagcgcctatacggcacttttctcgggcgtctcttgggtgatgaagattggaatcggcgtactgttgacatggatcgggctcaattccaaaaacacctcaatgagttttagctgcattgcgataggaatcattactctgtacttaggcgctgtggttcaggccgacatgggttgtgtcatcaattggaaggggaaagagctgaagtgcggatccggcattttcgtgacaaacgaggtgcacacctggactgaacagtataagtttcaagcagattctcccaaacgactagccaccgctatcgccggtgcatgggagaatggcgtctgtgggatacgcagcacaacgagaatggaaaacctcctgtggaagcagatcgctaatgagcttaactacattttgtgggaaaataacatcaaactgaccgttgtggtgggagacattatcggcgtactcgagcaggggaagaggactctgacaccacagcctatggagttaaaatattcatggaagacctggggaaaagccaagatagtcacagcggaaactcaaaacagttccttcattatcgatggccccaataccccagagtgccccagcgtgtctcgggcctggaacgtttgggaagtggaggactacggttttggggtcttcacgacaaatatttggctgaagcttcgcgaagtgtatacccagttgtgtgaccacagactcatgtcagctgcagttaaagatgagagggccgtgcatgctgacatgggatactggatcgagagtcagaagaacggcagctggaaactggaaaaggcctccctaatagaggtaaaaacttgcacctggcctaagtctcacacactgtggtcgaatggtgtcctcgaaagcgatatgatcattccaaagtccctggcaggcccgatctcacagcataaccaccgtcccgggtaccacactcaaaccgcgggaccttggcatcttggcaaattggagctggactttaattattgcgaggggacaacggtggtgattaccgaaaactgtggaactcggggcccaagtttacgaacaaccactgtctctggtaagctcatccacgagtggtgctgtagaagctgcacactgccccctcttaggtacatgggggaagatggatgttggtatggcatggagatacgcccaatttccgaaaaagaggagaatatggttaagtcactggtgagcgccggttctggcaaagtagacaacttcaccatgggggtgttgtgcctcgctatcctgtttgaagaggtcatgcggggaaagttcggcaagaaacatatgatcgccggggtgttctttacgttcgttctactgctctccggacagattacttggagagatatggcacacaccctgatcatgattggcagtaatgctagcgacaggatgggtatgggggtgacataccttgccttgatagcaacctttaagatccagcccttcctggccttaggatttttcctccgcaaactgacttctcgagaaaaccttctgctaggcgtcggcctcgctatggcgacaaccctgcaattgccggaggatattgaacagatggccaatgggatcgcactgggattaatggctctcaagctgattacacagtttgagatctatcagctttggactgccctgatatccttgacctgttcaaacacgatcttcacactcaccgtggcctggcggactgctaccctgattctagcaggtgttagtctgcttcctatgtgccaaagctcgtccatgcgtaaaacagactggctcccaatggccgtggcggctatgggcgtcccccctctgcccttgtttatcttctctctgaaggatactttaaagagaaggagctggccactcaatgagggggtaatggccgtgggactggtttcaattcttgcaagttccctgttgcgcaacgacgtgcctatggccggccccctcgtcgctggtgggctgctaatcgcatgttacgtgataaccggaacgtctgccgatctgacagtagaaaaagcggctgacattacctgggaggaagaggccgaacagactggcgtgagccataaccttatgatcacagtcgacgatgacggcaccatgcggatcaaggatgacgagactgagaatattctcacagttctgttgaaaaccgcattactgatagtgtccgggatctttccatattcaattccggccacgctcctggtgtggcacacttggcagaagcagacccaaagaagcggagtcctttgggatgtgcctagtcccccagaaacacagaaagctgagctggaagagggtgtttacaggatcaagcagcagggcattttcgggaaaacccaagtaggagtgggcgtccagaaggagggtgtgtttcacacaatgtggcatgttactcgaggggccgtgttgacctacaacggaaagcgcctagaacccaattgggcatctgtcaaaaaggacctgatctcctatggcggcgggtggcggctcagcgctcagtggcaaaaaggagaggaagtgcaggtaatagccgtcgagcctggtaagaacccaaaaaatttccagacgatgcccggcacattccagactaccacaggggaaatcggagcgattgccctggattttaagcctggcacctcgggttcaccgatcattaacagagaggggaaggtggttggactttacggcaatggcgtggtcactaaaaacgggggatatgtgtctggtatcgcacaaaccaatgctgagccagacggccccacacctgaattagaggaagagatgttcaagaaaaggaacctgacgataatggatctccacccagggagtggaaagactcgtaaatacttgcccgccattgttcgcgaagctatcaagcggagactgaggaccctcatcctggcacctacacgagtggtcgccgccgagatggaggaagctcttaagggcctgccgattcggtatcagaccactgcgacaaaatccgagcataccggtcgcgaaatcgtggacttgatgtgccacgcaacgtttactatgagactactgagccccgtaagggtgccaaattacaacctcataattatggatgaggcccatttcacagaccctgcttctatcgccgcacgggggtatattagcacccgagttggaatgggcgaagccgctgcgatctttatgaccgccactcccccaggcacagcagatgctttccctcagtccaatgcccccatacaggacgaggagagagacattccagaacgctcatggaacagtgggaatgagtggatcaccgattttgcaggaaagacagtctggttcgtgccgagcatcaaagccggtaacgacattgctaactgtttaaggaagaatggcaaaaaggtgatccaactgtctcgtaagacttttgatacggaataccagaaaaccaagcttaacgactgggatttcgtcgtaacaactgacatttccgagatgggggccaattttaaagcggatcgggtgatagaccctagaaggtgcctgaagcccgttatcctcaccgatggaccagagcgcgtgattttggcaggccccatgcctgtcacagccgcttcagccgctcagcgaagaggtcgggtggggaggaacccacagaaagaaaatgaccaatacatcttcaccggccagcccctgaacaatgatgaggaccacgcacactggactgaagccaagatgctcctggacaacatcaatacgcctgagggaattataccggctcttttcgaaccagagcgcgagaagagtgccgcaatcgatggcgaatatcgtctaaaaggggagagcagaaagacctttgttgaactgatgcggaggggagacttgcccgtgtggttagcgcataaagtcgcctccgagggtattaagtacacagatcgcaaatggtgcttcgacggccagcgaaacaatcagatcctggaagagaacatggatgtggagatttggactaaggaaggggagaaaaagaagctcagacctcggtggctggacgctaggacctattctgatccccttgccctgaaagaatttaaggagttcgcagctggacgcaaatcgatcgccctcgacttggtaacagaaataggcagagtgccaagccacctggcacataggacccggaatgccctagataacctggttatgctccacacttcagagcacggtgggcgtgcttaccgccatgcggtcgaggaacttcctgagacaatggaaacgctgttattgctgggcctcatgatcctgcttaccggaggcgccatgctgtttctcatttccgggaagggaatcggtaaaactagtattggcttgatctgtgtgatagcatctagcgggatgctgtggatggctgagattcccttacaatggatcgcctccgccattgtgctagagttctttatgatggtcctgctcatcccagaacctgagaagcagcgaacaccgcaggacaatcaacttgcatatgttgtgataggaatcctgaccttggctgccattatcgcggctaacgaaatgggcctgctcgagaccacaaagagagatctgggtatgtcaaaagaacccggggtagtgtctccaactagctaccttgacgtcgatctccaccctgccagtgcatggacgctgtatgccgtggctaccacagttattactcccatgttgaggcataccatcgagaattccacagcaaacgtgagcctggccgcgatagctaaccaggccgtcgtattaatgggcctagacaagggatggccaatttctaaaatggacctgggcgtgcctctccttgcactggggtgctactcacaggttaatcccttgaccctgactgccgctgtgctcctgcttatcacgcactacgccatcattggaccgggcttacaggcaaaggctacacgggaggcccaaaaacgcaccgcggccggtatcatgaagaacccaactgtcgatgggataatgaccattgacctggatcctgtgatctatgactccaagttcgaaaaacagctcggacaggtcatgttgctggtgctatgtgttgtgcagctgctccttatgagaacaagttgggcactgtgcgaggctttgactctggccaccggccccattacaacgctctgggaaggtagcccaggcaagttttggaataccactatcgcagtatcgatggctaacatattcagggggtcttacctggccggagccggcttagcgttttccatcatgaaaagcgtggggacaggaaagcggggcaccggttcacaaggggagactcttggagaaaaatggaagaagaaactgaatcagctcagtcgaaaggatttcgacctatataaaaagtctggcattacagaggtcgatagaaccgaggctaaagaaggtctgaagcgcggcgagatcacgcatcacgcagtttccagggggagcgccaaattgcagtggtttgtggaacggaacatggtcattcccgagggacgtgtgatcgacctgggctgtgggagaggaggctggtcatactattgcgctggtctcaagaaggtaaccgaagtgagggggtacacaaaaggaggccctggccacgaggagccggttcccatgagtacttatgggtggaatattgtgaagcttatgagcggaaaagatgtcttctacctgccacctgaaaagtgtgacaccttgctgtgcgatatcggtgagtcctctcccagccctacagtggaagagtcccgcactatacgggtcctcaaaatggtggagccatggttaaagaacaatcagttctgtattaaggttctgaacccctacatgcctaccgtaatcgaacatcttgagcgactgcaaagaaaacacggcgggatgctagtgaggaatccactctcacgcaactctacacatgaaatgtattggatcagtaatggaaccggcaacattgtcgcctcggtgaatatggttagccggctgttgctgaacagatttactatgacgcaccgtaggcccacaatagagaaggacgtggatctcggtgcagggacccggcacgtcaacgccgaaccggagactcctaatatggacatcattggagagcgcatcaaacgaattaaggaagagcataactccacctggcactacgacgatgaaaatccatataaaacatgggcttaccatggctcttatgaggtgaaggcgacgggctcagccagctccatgatcaacggggtagtgaagcttctgaccaaaccctgggacgttgtccctatggtgactcagatggcaatgacagataccactccattcggacagcaaagagtgtttaaggaaaaagtcgacacaaggaccccccggagtatgccgggtacacgcagagttatgggcataactgctgagtggttatggaggaccctggggcgaaataagaaacctcggttgtgcacgcgtgaggaattcaccaagaaggtgagaacaaacgccgcaatgggagccgtatttactgaggaaaatcagtgggattctgctaaagccgcggtggaggacgaagatttctggaagctcgtcaaccgcgagagggagctgcacaaactaggcaagtgtggtagctgcgtgtacaatatgatggggaaacgggaaaagaaacttggagagtttggcaaggcaaagggctcaagagccatctggtatatgtggctgggggctcgctacctcgaattcgaggccctgggatttttgaacgaggaccattggttctccagggaaaatagttacagcggtgttgagggcgaagggctgcacaaactcggatatattcttcgagatatctctaagattcccggcggtgcaatgtacgctgacgataccgccgggtgggacacacggatcactgaggacgatctgcacaacgaagagaaaataacccagcagatggacccagagcatagacaattagctaatgccatttttaagctgacgtatcagaacaaagtggtcaaggtgcagaggcctacacccaccggaactgtaatggatatcatctcccgcaaggaccagcgtggctcaggccaagttgggacatacggattgaataccttcactaacatggaagcacagctcattcggcagatggagggtgaaggcgtgctgagcaaagcggatctagagaacccacaccttcccgaaaagaaaataacccagtggctggagacaaagggggtcgagagactcaaaaggatggccatctcgggagacgattgcgtggtgaagcctattgacgatcgctttgctaatgccctgttggcattaaacgacatgggcaaggtccgaaaagatatcccacaatggcagccgtctaagggttggcatgactggcagcaggttcccttctgtagtcaccacttccatgaactgattatgaaagatgggcggaagctcgtggtaccttgcagaccacaagacgagcttatcggaagggctcgcatatcccagggcgccggctggagcctgaaagaaacggcatgtctagggaaggcctatgcgcagatgtggtcactgatgtactttcacagacgggacctcaggttggcttccaatgccatctgctctgcagtgcccgtccattgggtgcctaccagccgtactacatggagtattcacgcccatcaccaatggatgaccactgaggatatgctgacagtttggaaccgagtgtggatcgaagacaatccatggatggaggataagacccccgtcacgacatgggagaacgtgccttatcttggaaaacgcgaagaccagtggtgtggttccctgattggcctcaccagcagagctacttgggcccagaatatcccgaccgcaattcagcaagtacggtctttaatagggaacgaggaattcctggattacatgccatcaatgaagaggtttcgcaaagaggaggaaagtgagggagctatctggtga

SEQ ID NO: 15324 - RNA, 9873 nt, synthetic construct
  misc_feature 1..9873: note = derived and/or modified CDS sequence (opt3) from DENV-3__JF937646__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcattgggaacagagactttgtagaaggattgtcaggtgccacctgggttgatgtggtcctggagcacggcgggtgcgtgacgactatggcgaagaataaacccacactagacatcgagctccagaagaccgaagcaactcaactggccacacttaggaaactgtgtattgagggaaagatcaccaacataacgaccgatagccggtgccctacacagggcgaagctactttgccagaggaacaggaccagaattatgtgtgtaaacacacctacgtcgatcgcggttgggggaacggatgcggcctcttcggcaaggggagtctggttacatgcgccaagtttcaatgtttagagcccattgagggaaaagtggtacagtatgaaaatctgaagtacactgtgatcattaccgtccatacaggtgaccagcaccaggtgggcaacgagacccaaggggttactgcagaaatcacgcctcaggcttccacaaccgaggccatcctcccagaatatggaactcttggcctggagtgctctccgcgaaccggtttggacttcaatgagatgattctactgacaatgaaaaacaaggcgtggatggtgcatagacagtggtttttcgatctccccctgccttggaccagcggggccactacagaaacgccaacctggaataggaaagagcttctggtcacttttaagaacgcacacgctaaaaagcaagaagtggtagttttgggctcccaggagggagccatgcacacagctctcaccggcgccacagaaatacagaattcagggggaactagtatcttcgcaggtcatctgaagtgtcggttaaaaatggacaagctggagctaaaaggcatgagctacgccatgtgcaccaacgcttttgtgctcaagaaagaggtctctgaaacgcagcacgggaccattctgatcaaggtggagtacaagggagaagatgtcccctgtaaaatacctttctccacagaggacggccaaggtaaggcgcataacgggcgtcttattactgcaaatccagtggttaccaaaaaggaggaacccgtgaacatcgaggccgaaccgcctttcggcgagtcaaatatcgtaattggaatcggcgataacgctttgaaaattaattggtataagaaggggagcagtataggaaaaatgtttgaagccacagcacgcggtgccagaaggatggctatcctgggcgacactgcctgggatttcgggtctgtcggaggcgtgctcaactccctgggtaagatggttcaccagatttttgggagcgcatacaccgcgcttttctcgggcgtgtcttgggtcatgaaaatcggaatcggcgtgctgttgacgtggattgggctcaattccaagaacacatcaatgagttttagctgcatagctatcggaattatcaccctgtatttaggcgccgtagtgcaggcagacatgggttgtgttattaattggaaagggaaggagctgaagtgcggatccggcatcttcgtcactaacgaggtgcatacatggaccgaacagtacaaatttcaagccgattctcccaagcggctagctactgccatagcaggtgcttgggagaatggcgtgtgtgggatccgaagcaccacacgcatggaaaacctcctgtggaaacagattgccaatgagcttaactatatcttgtgggaaaataacattaagctgacggtcgttgtgggagacatcataggcgtgctcgagcaggggaaaagaaccctgactccacagcctatggagttaaagtactcatggaaaacatggggaaaggcgaagattgtaaccgccgaaacacaaaacagttccttcatcattgatggccccaatactccagagtgccccagcgtctctagggcttggaacgtgtgggaagttgaggactatggttttggggtgttcaccacgaatatctggctgaaacttcgggaagtctacacacagttgtgtgaccaccgcctcatgtcagcagccgtgaaggatgagagagctgttcacgccgacatgggatactggatagagagtcagaaaaacggcagctggaagctggaaaaagcatccctaatcgaggtgaagacctgcacttggcctaagtctcataccctgtggtcgaatggtgtactcgaaagcgatatgattatcccaaaatccctggcgggcccgatttcacagcacaaccataggcccgggtatcacacacaaactgccggaccttggcaccttggcaagttggagctggactttaattactgcgaggggaccacagtcgtgatcacggaaaactgtggaacccgtggcccaagtttacggactacaaccgtgtctggtaaactcatacatgagtggtgctgtcgaagctgcactctgccccctcttagatatatgggggaagatggatgttggtacggcatggagattaggccaatctccgaaaaggaggagaatatggtcaaatcactggttagcgctggttctggcaaggtggacaacttcacaatgggggtattgtgcctcgccatcctgtttgaagaggtgatgcgcggaaagttcggcaaaaagcacatgattgcaggggtcttctttaccttcgtgctactgctctccggacagatcacgtggcgggatatggctcatactctgattatgataggcagtaatgccagcgacagaatgggtatgggggttacctatcttgcattgatcgccacatttaaaattcagcccttcctggctttaggatttttcctcaggaagctgacctctcgcgaaaaccttctgctaggcgtgggcctcgcgatggtcactacactgcaattgccggaggatatcgaacagatggccaatgggattgcactgggattaatggctctcaaactgatcacccagtttgagacataccagctttggactgccctgatatccttgacctgttcaaacacgatcttcacactcaccgtggcctggcgaactgctaccctgattctagcaggtgttagtctgcttcctgtgtgccaaagctcgtccatgcggaagacagactggctcccaatggccgtcgcggctatgggcgtaccccctctgcccttgtttatcttcgggctgaaggatactttaaaacgtagatcttggccactcaatgagggagtgatggccgttggcctggtgagcattcttgcatcaagtctgttgaggaacgacgtccctatggccggtcccctcgtggctgggggactgctaatcgcatgttatgtaataaccggcacgtccgccgatctgacagtggaaaaggcggctgacattacctgggaggaagaggccgaacagactggcgtctctcacaaccttatgatcacagttgacgatgacgggaccatgcgcatcaaagatgacgagactgagaatattctcacagtgctgttgaagaccgcattactgatagtgagcggaatctttccatactccattccggccacgctcctggtctggcatacttggcagaaacagacccaacggtcaggtgtgctttgggatgttcctagccccccagaaacacagaaggctgagctggaagagggcgtatacagaatcaaacagcaggggattttcggaaagacccaagtgggcgtcggtgtgcagaaggagggggtttttcacacaatgtggcacgtgactaggggagccgtcttgacctataacggcaaacgactagaacccaattgggcaagtgtgaagaaagacctgatctcttacggcgggggatggcgcctctccgctcagtggcaaaagggtgaggaagtacaggtcatagccgtggagcctggcaaaaacccaaagaatttccagacgatgcccgggacattccagactaccacaggagaaatcggcgcgattgccctggattttaagcctggtaccagcgggtcgccgatcattaaccgggagggaaaagttgtgggcctttatggcaatggggtcgtgactaagaacggaggttacgtttcaggcatcgcacaaaccaatgctgagccagacgggcccacacctgaattagaggaagagatgttcaaaaagagaaacctgacgataatggatctccatccaggatctggcaaaactaggaagtatttgcccgccattgtgcgtgaagctatcaagcgccggctgagaaccctcatcctggcacctacaagggtcgtggccgccgagatggaggaagctcttaaaggtctgccgattcgataccagaccactgcgacaaagagtgagcacaccgggcgggaaatcgtagacttgatgtgccatgcaacgtttactatgcgcctactgtcccccgtgagagttccaaattataacctcataattatggatgaggcccacttcacagaccctgctagcatcgccgcaaggggatacatttctacccgggtcggcatgggcgaagccgctgcgatctttatgaccgccactcccccagggacagcagatgctttccctcagagcaatgcccccatacaggacgaggagcgagacattccagaaagatcctggaactcaggaaatgagtggatcaccgattttgcaggtaaaacagtgtggttcgtgccgagtatcaaggtcggcaacgacattgccaactgtttacgcaaaaatgggaagaaggtaatccaactgagcaggaaaacttttgatacggaataccagaagaccaaacttaacgactgggatttcgtggttacaactgacatttctgagatgggagctaattttaaggccgatcgtgtgatagaccctcggagatgcctgaaacccgtcatcctcaccgatggcccagagagggtgattttggcgggtcccatgcctgttacagcagcctccgctgcccagcgccgagggagagtgggccggaacccacagaaggaaaatgaccaatatatcttcaccggacagcccctgaacaatgatgaggaccatgctcactggactgaagcaaagatgctcctggacaacatcaatacgcctgagggcattataccggcccttttcgaaccagagagggagaaatcagctgccatcgatggggaataccgcctaaagggagagagtcgtaaaacctttgtcgaactgatgagacggggtgacttgcccgtgtggttagcacacaaggtagcgagcgagggcattaaatatacagataggaagtggtgcttcgacgggcagcgcaacaatcagatcctggaagagaacatggatgtggagatttggactaaagaaggagagaagaagaaactccgacctagatggctggacgcccggacctactccgatccccttgctctgaaggaatttaaagagttcgccgcaggcaggaagtctatcgctctcgacttggttacagaaataggtcgcgtcccatcgcatctggcccacagaaccaggaatgcactagataacctggtgatgctccatactagcgagcacgggggccgggcctatcgtcacgctgtggaggaacttcctgagacaatggaaacgctgttattgctgggactcatgatcctgcttaccggcggggcgatgctgtttctcatttcaggaaaaggtatcggcaagacttccattgggttgatctgtgtcatagccagttctggaatgctgtggatggcagagattcccttacaatggatcgctagcgccattgttctagagttctttatgatggtgctgctcatcccagaacctgagaagcagcgcacaccgcaggacaatcaacttgcctacgtagtgataggcatcctgaccttggcagctattatcgccgcgaacgaaatgggtctgctcgagaccacaaaacgagatctggggatgtccaaggaacccggcgtcgtgtcaccaacttcttatcttgacgttgatctccatcctgctagcgcctggacgctgtacgcagtggccaccacagtcattactcccatgttgagacacaccatcgagaatagtacagctaacgtatccctggcagccatagcgaaccaggctgtggttttaatgggactagacaaaggctggccaattagcaagatggacctgggggtgcctctccttgccctgggatgctactctcaggtcaatcccttgaccctgactgcagccgtgctcctgcttatcacgcattatgctatcattggcccgggtttacaggccaaagcaacaagggaggctcaaaagcggaccgccgcggggatcatgaagaacccaactgtcgatggaataatgaccattgacctggatcctgtgatctacgactcaaaattcgaaaagcagctcggccaggttatgttgctggtgctatgtgccgtacagctgctccttatgcgcacatcctgggcactgtgcgaggctttgactctggccaccggtcccattacaacgctctgggaaggcagtccagggaaattttggaataccactatcgcagtgagcatggctaacatattcagaggatcgtatctggccggcgccgggttagcgttttctatcatgaagtccgtcggaacaggcaaaaggggtaccgggagccaaggagagactcttggcgaaaagtggaagaaaaagctgaatcagctctcacggaaagatttcgacctatacaagaaaagtggtattacagaggttgatcgaaccgaggctaaggaaggcctgaaaagaggggagatcacgcaccatgcagtgtctcgcggatccgccaagttgcagtggtttgtcgaaaggaacatggtgattcccgagggccgggtaatcgacctggggtgtggacgtggcggttggagctattactgcgctgggctcaagaaagtgaccgaagttagaggatatacaaagggcggccctgggcacgaggagccggtgcccatgtcaacttacggatggaatattgtcaaacttatgagtggtaaggatgtgttctacctgccacctgaaaaatgtgacaccttgctgtgcgatatcggcgagagctccccctctcctacagtcgaagagagcaggactatacgcgtgctcaagatggttgagccatggttaaagaacaatcagttctgtattaaagtactgaacccctatatgcctaccgtgatcgaacaccttgagcggctgcaacgaaagcatgggggaatgctagtcagaaatccactctccaggaactcaacacacgaaatgtactggatctctaatggcaccggtaacattgtggccagtgttaatatggtgtcgcgcctgttgctgaaccggtttactatgacgcatagacgtcccacaatagagaaagacgtcgatctcggggcaggaaccaggcacgtgaacgccgaaccggagactcctaatatggacgtaatcggcgagcggattaagcgcatcaaagaagagcacaacagcacctggcattatgacgatgaaaatccatacaagacatgggcttatcacggctcctacgaggtgaaggcgacggggtctgcctcaagcatgattaacggagttgtcaaacttctgaccaagccctgggacgtggtgcctatggtcactcagatggcaatgacagataccactccattcggtcagcaacgagtttttaaagaaaaggtggacacaagaacccccaggtccatgccgggcacacggcgcgtaatggggatcactgctgagtggttatggagaaccctgggaaggaataaaaagcctcgattgtgcacgcgggaggaattcaccaagaaagtgcgtacaaacgccgcaatgggcgccgtctttactgaggaaaatcagtgggatagtgctaaggccgcggtggaggacgaagatttctggaaactcgttgacagagagcgcgagctgcataagctaggtaaatgtgggtcttgcgtgtataacatgatgggaaagagggaaaaaaagcttggcgagtttggcaaggcaaaagggagccgggccatatggtacatgtggctgggagctagatacctcgaattcgaggccctgggttttttgaatgaggatcactggttctcacgcgaaaactcctatagtggcgtcgagggggaaggactgcataagctcggctacatccttagggacattagcaaaatccccggtggggcaatgtatgctgatgacaccgccggatgggacacacgaattactgaggatgacctgcacaatgaagagaagatcacccagcagatggatccagagcaccggcaattagctaacgccatatttaaactgacgtaccagaataaggtggtaaaggttcagagacctacacccaccggcactgtgatggacattatctctaggaaagatcagcgcggctccgggcaagtcggaacatatggtttgaacaccttcactaatatggaagcacagctcatccgtcagatggagggcgaaggggtgctgtcaaaggcggacctagagaacccacatcttcccgaaaaaaagattacccagtggctggagacaaaaggagtggagcggctcaagagaatggccataagcggcgatgactgcgtcgttaagcctatcgatgacaggtttgctaacgccctgttggcattaaatgatatgggtaaagtgcgcaaggacattccacaatggcagccgtcgaaagggtggcacgattggcagcaggtacccttctgttctcatcacttccacgaactgatcatgaaggacggacgaaaactcgtggtcccttgccggccacaagacgagcttattggcagagctaggatcagtcagggcgccgggtggtccctgaaggaaacggcatgtctaggaaaggcctacgcgcagatgtggagcctgatgtattttcatcgcagagatctccggttggcttcaaacgccatatgctccgcagtgcccgttcactgggtgcctacctctaggactacatggagcatccatgcccaccatcaatggatgaccactgaggacatgctgacagtctggaatcgtgtgtggattgaagataacccatggatggaggacaaaacccccgtaacgacatgggagaatgttccttaccttggtaagcgagaagatcagtggtgtggcagtctgatcgggctcacctcccgcgctacttgggcccagaacattccgaccgcaatccagcaagtgagaagcttaattggaaatgaggaattcctggactacatgccatctatgaaacggtttaggaaggaggaggaatcagagggcgctatatggtga

SEQ ID NO: 15325 - RNA, 9873 nt, synthetic construct
  misc_feature 1..9873: note = derived and/or modified CDS sequence (opt3) from DENV-3__JF937633__SS-prME
  source 1..9873: mol_type = other RNA
accagcctgtgcctcatgatgatccttcccgcagctctggcattccacttgacatccagagacggcgaacctagaatgattgtggggaagaacgaacggggtaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagcatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgactaagaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagccggtgttagtctgcttcctgtgtgccaaagctcgtccatgcggaagactgactggctcccaatggccgtcgcggctatgggcgtaccccctctgcccttgtttattttcgggctgaaggataccttaaaacgtagatcttggccactcaatgagggagtgatggccgttggcctggtgagcatccttgcatcaagtctgttgaggaacgacgtccctatggccggtcccctcgtggctgggggactgctaattgcatgttatgtaatcacgggcacatccgccgatctgaccgtggaaaaggcggctgacataacttgggaggaagaggccgaacagacaggcgtctctcacaaccttatgattaccgttgacgatgacgggactatgcgcatcaaagatgacgagacagagaatatcctcaccgtgctgttgaagacggcattactgattgtgagcggaatatttccatactccatcccggccactctcctggtctggcatacctggcagaaacagacacaacggtcaggtgtgctttgggatgttcctagtcccccagaaacccagaaggctgagctggaagagggcgtatacagaattaaacagcaggggatcttcggaaagacacaagtgggcgtcggtgtgcagaaggagggggtttttcacactatgtggcacgtgaccaggggagccgtcttgacgtataacggcaaacgactagaacccaattgggcaagtgtgaagaaagacctgatttcttacggcgggggatggcgcctctccgctcagtggcaaaagggtgaggaagtacaggtcatcgccgtggagcctggcaaaaacccaaagaatttccagacaatgcccgggactttccagaccacaaccggagaaataggcgcgatcgccctggattttaagcctggtactagcgggtcgccgattatcaaccgggagggaaaagttgtgggcctttatggcaatggggtcgtgaccaagaacggaggttacgtttcaggcattgcacaaacaaatgctgagccagacgggcccacgcctgaattagaggaagagatgttcaaaaagagaaacctgactatcatggatctccatccaggatctggcaaaaccaggaagtatttgcccgccatagtgcgtgaagctattaagcgccggctgagaacactcatcctggcacctaccagggtcgtggccgccgagatggaggaagctcttaaaggtctgccgatccgataccagactacagcgaccaagagtgagcacacggggcgggaaattgtagacttgatgtgccatgcaacttttacaatgcgcctactgtcccccgtgagagttccaaattataacctcatcataatggatgaggcccacttcaccgaccctgctagcattgccgcaaggggatacatctctacccgggtcggcatgggcgaagccgctgcgatttttatgactgccacacccccagggaccgcagatgctttccctcagagcaatgcccccatccaggacgaggagcgagacataccagaaagatcctggaactcaggaaatgagtggattacagattttgcaggtaaaactgtgtggttcgtgccgagtatcaaggccggcaacgacatcgctaactgtttacgcaaaaatgggaagaaggtcattcaactgagcaggaaaacgtttgataccgaataccagaagacaaaacttaacgactgggatttcgtagtgactaccgacatctctgagatgggagccaattttaaggcggatcgtgttattgaccctcggagatgcctgaaacccgtgatactcacagatggcccagagagggtcatcttggcaggtcccatgcctgtgaccgccgcttccgccgctcagcgccgagggagagttggccggaacccacagaaggaaaatgaccaatatattttcactggacagcccctgaacaatgatgaggaccatgcacactggacggaagccaagatgctcctggacaacatcaatacccctgagggcatcattccggctcttttcgaaccagagagggagaaatcagccgcaatagatggggaataccgcctaaagggagagagtcgtaaaacatttgtggaactgatgagacggggtgacttgcccgtctggttagcgcacaaggtggccagcgagggcatcaaatatactgataggaagtggtgcttcgacgggcagcgcaacaatcagattctggaagagaacatggatgtagagatctggaccaaagaaggagagaagaagaaactccgacctagatggctggacgctcggacatactccgatccccttgccctgaaggaatttaaagagttcgcagctggcaggaagtctattaccctcgacttggtgactgaaatcggtcgcgttccatcgcatctggcccacagaacaaggaatgcactagataacctggtcatgctccatacgagcgagcacgggggccgggcctatcgtcacgctgtggaggaacttcctgagaccatggaaactctgttattgctgggactcatgatactgcttacaggcggggcgatgctgtttctcatctcaggaaaaggtattggcaagacctccatcgggttgatttgtgtgatcgccagttctggaatgctgtggatggcagagatacccttacaatggattgctagcgccatcgtcctagagttctttatgatggttctgctcattccagaacctgagaagcagcgcaccccgcaggacaatcaacttgcctacgtggtaatcggcatactgacattggcagctatcattgccgcgaacgaaatgggtctgctcgagactacgaaacgagatctggggatgtccaaggaacccggcgtggtctcaccaacctcttatcttgacgtggatctccatcctgctagcgcctggacactgtacgcagttgccactaccgtgatcacacccatgttgagacacaccattgagaatagtactgctaacgtctccctggcagccatcgcgaaccaggctgtagtgttaatgggactagacaaaggctggccaataagcaagatggacctgggggttcctctccttgccctgggatgctactctcaggtgaatcccttgacgctgacagcagccgtcctcctgcttattacccattatgctatcatcggcccgggtttacaggccaaagcaactagggaggctcaaaagcggaccgccgcggggattatgaagaacccaacagtggatggaatcatgactatagacctggatcctgtcatttacgactcaaaattcgaaaagcagctcggccaggtgatgttgctggttctatgtgccgtgcagctgctccttatgcgcacctcctgggcactgtgcgaggctttgacactggccacgggtcccatcaccactctctgggaaggcagtccagggaaattttggaatacaaccattgcagtaagcatggctaacatcttcagaggatcgtatctggccggcgccgggttagcgttttctataatgaagtccgtgggaactggcaaaaggggtacagggagccaaggagagacccttggcgaaaagtggaagaaaaagctgaatcagctctcacggaaagatttcgacctatacaagaaaagtggtatcacggaggtcgatcgaaccgaggctaaggaaggcctgaaaagaggggagattacacaccatgcagtttctcgcggatccgccaagttgcagtggtttgtggaaaggaacatggtcatccccgagggccgggtgattgacctggggtgtggacgtggcggttggagctattactgcgctgggctcaagaaagtaactgaagtgagaggatataccaagggcggccctgggcacgaggagccggttcccatgtcaacatacggatggaatatcgtgaaacttatgagtggtaaggatgtcttctacctgccacctgaaaaatgtgacactttgctgtgcgatattggcgagagctccccctctcctaccgtggaagagagcaggacaatccgcgtcctcaagatggtggagccatggttaaagaacaatcagttctgtataaaagttctgaacccctatatgcctaccgtaattgaacaccttgagcggctgcaacgaaagcatgggggaatgctagtgagaaatccactctccaggaactcaactcacgaaatgtactggatctctaatggcacgggtaacatcgtcgccagtgtgaatatggtttcgcgcctgttgctgaaccggtttacaatgacccatagacgtcccactattgagaaagacgtggatctcggggcaggaaccaggcacgtcaacgccgaaccggagacacctaatatggacgtgataggcgagcggatcaagcgcattaaagaagaacacaacagcacgtggcattatgacgatgaaaatccatacaagacctgggcttatcacggctcctacgaggtaaaggcgactgggtctgcctcaagcatgatcaacggagtggttaaacttctgacaaagccctgggacgtcgtgcctatggtgacccagatggcaatgactgatacaaccccattcggtcagcaacgagtctttaaagaaaaggttgacacaagaactcccaggtccatgccgggcacccggcgcgtgatggggattacggctgagtggttatggagaaccctgggaaggaataaaaagcctcgattgtgcacacgggaggagttcactaagaaagtacgtaccaacgccgcaatgggcgccgtgtttacagaggaaaatcagtgggatagtgctaaggccgcggtcgaggacgaagatttctggaaactcgtggacagagagcgcgagctgcataagctaggtaaatgtgggtcttgcgtttataacatgatgggaaagagggagaagaaacttggcgagtttggcaaagcaaaagggagccgggccatctggtacatgtggctgggagctagatacctcgagttcgaggccctgggatttttgaatgaggatcactggttctcacgcgaaaactcctatagtggcgtggagggggaaggactgcataagctcggctacatacttagggacatcagcaaaattcccggtggggcaatgtatgctgatgacactgccggatgggacacccgaatcacggaggatgacctgcacaatgaagagaagattacacagcagatggatccagagcaccggcaattagctaacgccatctttaaactgacctaccagaataaggtcgtgaaggtacagagacctactcccacaggcaccgttatggacataatttctaggaaagatcagcgcggctccgggcaagtgggaacttatggtttgaacaccttcacaaatatggaagcacagctcatccgtcagatggagggcgaaggggtcctgtcaaaggcggacctagagaacccacatcttcccgagaaaaagatcacgcagtggctggagaccaaaggagtggagcggctcaagagaatggccattagcggcgatgactgcgtggtcaagcctatagatgacaggtttgctaacgccctgttggcattaaatgatatgggtaaagttcgcaaggacatcccacaatggcagccgtcgaaagggtggcacgattggcaacaggtgcccttctgttctcatcacttccacgaactgattatgaaggacggacgaaaactcgtagtgccttgccggccacaagacgagcttatcggcagagctaggattagtcagggcgccgggtggtccctgaaggaaactgcatgtctaggaaaggcctacgcgcagatgtggagcctgatgtattttcatcgcagagatctccggttggcttcaaacgccatctgctccgcagtccccgtgcactgggttcctacatctaggaccacttggagcatacatgcccaccatcaatggatgacaaccgaggacatgctgacggtgtggaatcgtgtctggatcgaagataacccatggatggaggacaaaacacccgtgaccacttgggagaatgtaccttaccttggtaagcgagaagatcagtggtgtggcagtctgattgggctcacctcccgcgctacatgggcccagaacatcccgactgcaattcagcaagttaggagcttaatcggaaatgaggagttcctggactacatgccatctatgaaacggtttaggaaggaggaggaatcagagggcgctatttggtga

SEQ ID NO: 15326 - RNA, 9873 nt, synthetic construct
  misc_feature 1..9873: note = derived and/or modified CDS sequence (opt3) from DENV-3__JF937634__SS-prME
  source 1..9873: mol_type = other RNA
accagcctgtgcctcatgatgatccttcccgccgctctggcattccacttgacatccagagacggcgagcctagaatgattgtggggaagaacgaacggggtaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagcatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgactaagaaagaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgttaatgagcttaactatattttgtgggaaaataacatcaagctgaccgtggtggtaggagacattatcggcgtcctcgagcaggggaaaagaactctgacaccacagcctatggagttaaagtactcatggaaaacctggggaaaggctaagatagtgacagccgaaactcaaaacagttccttcattatcgatggccccaataccccagagtgccccagcgtttctagggcgtggaacgtgtgggaagtcgaggactatggttttggggtgttcacgacaaatatttggctgaaacttcgggaagtttacacccagttgtgtgaccaccgcctcatgtcagccgctgtgaaggatgagagagcagtacacgccgacatgggatactggatcgagagtcagaaaaacggcagctggaagctggaaaaggcttccctaatagaggtcaagacttgcacctggcctaagtctcatacactgtggtcgaatggtgtgctcgaaagcgatatgatcattccaaaatccctggccggcccgatctcacagcacaaccataggcccgggtatcacactcaaaccgcaggaccttggcaccttggcaagttggagctggactttaattactgcgaggggacaacggtggtcattaccgaaaactgtggaactcgtggcccaagtttacggacaaccactgtttctggtaaactcatccatgagtggtgctgtcgaagctgcacactgccccctcttagatatatgggggaagatggatgttggtacggcatggagataaggccaatttccgaaaaggaggagaatatggtgaaatcactggtaagcgcgggttctggcaaggtggacaacttcaccatgggggtcttgtgcctcgccatcctgtttgaagaggtgatgcgcggaaagttcggcaaaaagcacatgatcgctggggttttctttacgttcgtgctactgctctccggacagattacttggcgggatatggcccataccctgatcatgattggcagtaatgcaagcgacagaatgggtatgggggtcacatatcttgctttgatagccacctttaaaatccagcccttcctggcattaggatttttcctcaggaagctgacttctcgcgaaaaccttctgctaggcgtgggcctcgccatggctacaaccctgcaattgccggaggatattgaacagatggcgaatgggatcgccctgggattaatggcactcaaactgattacacagtttgagacttaccagctttggaccgctctgatctccttgacgtgttcaaacacaatattcaccctcactgttgcctggcgaaccgccacactgatcctagctggtgtgagtctgcttcctgtctgccaaagctcgtccatgcggaagactgactggctcccaatggcagtagccgcgatgggcgtgccccctctgcccttgtttattttcgggctgaaggataccttaaaacgtagatcttggccactcaatgagggagttatggctgtgggcctggtcagcatccttgcctcaagtctgttgaggaacgacgtgcctatggcaggtcccctcgtagccgggggactgctaattgcttgttatgtgatcacgggcacatccgcagatctgaccgtcgaaaaggccgcggacataacttgggaggaagaggctgaacagacaggcgtttctcacaaccttatgattaccgtggacgatgacgggactatgcgcatcaaagatgacgagacagagaatatcctcaccgtgctgttgaagacggccttactgattgtcagcggaatatttccatactccatcccggcaactctcctggtgtggcatacctggcagaaacagacacaacggtcaggtgttctttgggatgtacctagtcccccagaaacccagaaggccgagctggaagagggcgtgtacagaattaaacagcaggggatcttcggaaagacacaagtcggcgtgggtgttcagaaggagggggtgtttcacactatgtggcacgtcaccaggggagctgtgttgacgtataacggcaaacgactagaacccaattgggccagtgtaaagaaagacctgatttcttacggcgggggatggcgcctctccgcacagtggcaaaagggtgaggaagtccaggtgatcgctgttgagcctggcaaaaacccaaagaatttccagacaatgcccgggactttccagaccacaaccggagaaataggcgccatcgcgctggattttaagcctggtactagcgggtcgccgattatcaaccgggagggaaaagtggtcggcctttatggcaatggggtggttaccaagaacggaggttacgtgtcaggcattgcccaaacaaatgcagagccagacgggcccacgcctgaattagaggaagagatgttcaaaaagagaaacctgactatcatggatctccatccaggatctggcaaaaccaggaagtatttgcccgctatagtccgtgaagccattaagcgccggctgagaacactcatcctggctcctaccagggtggtagcagccgagatggaggaagcccttaaaggtctgccgatccgataccagactacagctaccaagagtgagcacacggggcgggaaattgtggacttgatgtgccatgcgacttttacaatgcgcctactgtcccccgttagagtcccaaattataacctcatcataatggatgaggcacacttcaccgaccctgccagcattgctgccaggggatacatctctacccgggtgggcatgggcgaagcagccgctatttttatgactgcgacacccccagggaccgccgatgcattccctcagagcaatgctcccatccaggacgaggagcgagacataccagaaagatcctggaactcaggaaatgagtggattacagattttgccggtaaaactgtgtggttcgtcccgagtatcaaggcaggcaacgacatcgccaactgtttacgcaaaaatgggaagaaggtaattcaactgagcaggaaaacgtttgataccgaataccagaagacaaaacttaacgactgggatttcgtggttactaccgacatctctgagatgggagctaattttaaggccgatcgtgtgattgaccctcggagatgcctgaaacccgtcatactcacagatggcccagagagggtgatcttggcgggtcccatgcctgttaccgcagcctccgctgcccagcgccgagggagagtgggccggaacccacagaaggaaaatgaccaatatattttcactggacagcccctgaacaatgatgaggaccatgctcactggacggaagcaaagatgctcctggacaacatcaatacccctgagggcatcattccggcccttttcgaaccagagagggagaaatcagctgccatagatggggaataccgcctaaagggagagagtcgtaaaacatttgtcgaactgatgagacggggtgacttgcccgtgtggttagcacacaaggtagcgagcgagggcatcaaatatactgataggaagtggtgcttcgacgggcagcgcaacaatcagattctggaagagaacatggatgtggagatctggaccaaagaaggagagaagaagaaactccgacctagatggctggacgcccggacatactccgatccccttgctctgaaggaatttaaagagttcgccgcaggcaggaagtctattgctctcgacttggttaccgaaatcggtcgcgtcccatcgcatctggcccacagaactaggaatgcactagataacctggtgatgctccatacaagcgagcacgggggccgggcctatcgtcacgctgtggaggaacttcctgagacgatggaaaccctgttattgctgggactcatgatactgcttactggcggggcgatgctgtttctcatctcaggaaaaggtattggcaagacatccatcgggttgatttgtgtcatcgccagttctggaatgctgtggatggcagagatacccttacaatggattgctagcgccatcgttctagagttctttatgatggtgctgctcattccagaacctgagaagcagcgcaccccgcaggacaatcaacttgcctacgtagtgatcggcatactgaccttggcagctatcattgccgcgaacgaaatgggtctgctcgagacaactaaacgagatctggggatgtccaaggaacccggcgtcgtgtcaccaacgtcttatcttgacgttgatctccatcctgctagcgcctggaccctgtacgcagtggccacaactgtcatcacccccatgttgagacacacaattgagaatagtaccgctaacgtatccctggcagccatcgcgaaccaggctgtggttttaatgggactagacaaaggctggccaataagcaagatggacctgggggtgcctctccttgccctgggatgctactctcaggtcaatcccttgactctgacggcagccgtgctcctgcttattacacattatgctatcatcggcccgggtttacaggccaaagcaaccagggaggctcaaaagcggactgccgcggggattatgaagaacccaaccgtcgatggaatcatgacaatagacctggatcctgtgatttacgactcaaaattcgaaaagcagctcggccaggttatgttgctggtgctatgtgccgtacagctgctccttatgcgcacttcctgggcactgtgcgaggctttgaccctggccacaggtcccatcacgaccctctgggaaggcagtccagggaaattttggaatactacaattgcagtgagcatggctaacatcttcagaggatcgtatctggccggcgccgggttagcgttttctataatgaagtccgtcggaaccggcaaaaggggtactgggagccaaggagagacacttggcgaaaagtggaagaaaaagctgaatcagctctcacggaaagatttcgacctatacaagaaaagtggtatcaccgaggttgatcgaacggaggctaaggaaggcctgaaaagaggggagattacccaccatgcagtgtctcgcggatccgccaagttgcagtggtttgtcgaaaggaacatggtgatccccgagggccgggtaattgacctggggtgtggacgtggcggttggagctattactgcgctgggctcaagaaagtgacagaagttagaggatatactaagggcggccctgggcacgaggagccggtgcccatgtcaacctacggatggaatatcgtcaaacttatgagtggtaaggatgtgttctacctgccacctgaaaaatgtgacacattgctgtgcgatattggcgagagctccccctctcctactgtcgaagagagcaggaccatccgcgtgctcaagatggttgagccatggttaaagaacaatcagttctgtataaaagtactgaacccctatatgcctacagtgattgaacaccttgagcggctgcaacgaaagcatgggggaatgctagtcagaaatccactctccaggaactcaacccacgaaatgtactggatctctaatggcactggtaacatcgtggccagtgttaatatggtgtcgcgcctgttgctgaaccggtttacgatgacacatagacgtcccaccattgagaaagacgtcgatctcggggcaggaactaggcacgtgaacgccgaaccggagacccctaatatggaggtaataggcgaacggatcaagcgcattaaagaggaacacaacagcacatggcattatgacgacgagaatccatacaagacgtgggcttatcacggctcctacgaagtgaaggcgaccgggtctgcctcaagcatgatcaacggagttgtcaaacttctgactaagccctgggatgtggtgcctatggtcacacagatggcaatgaccgacactacaccattcggtcagcaacgagtttttaaagagaaggtggataccagaacacccaggtccatgccgggcactcggcgcgtaatggggattaccgctgagtggttatggagaacgctgggaaggaataaaaagcctcgattgtgcacccgggaagagttcacaaagaaagtgcgtactaacgccgcaatgggcgccgtctttaccgaagagaatcagtgggacagtgctaaggccgcggtggaagatgaggacttctggaaactcgttgatagagagcgcgaactgcataagctaggtaaatgtgggtcttgcgtgtataacatgatgggaaagagggagaagaaacttggcgaatttggcaaagcaaaagggagccgggccatctggtacatgtggctgggagctagatacctcgagttcgaggccctgggatttttgaatgaagaccactggttctcacgcgagaactcctatagtggcgtcgaaggggagggactgcataagctcggctacatacttagggatatcagcaaaattcccggtggggcaatgtatgctgacgatacagccggatgggacactcgaatcaccgaagacgatctgcacaatgaggagaagattacgcagcagatggacccagaacaccggcaattagctgatgccatctttaaactgacataccagaacaaggtggtaaaggttcagagacctacccccactggcacagtgatggacataatttctaggaaagatcagcgcggctccgggcaagtcggaacctatggtttgaatactttcaccaacatggaggcacagctcatccgtcagatggaaggcgagggggtgctgtcaaaggcggacctagaaaatccacatcttcccgagaaaaagatcacacagtggctggagacgaaaggagtggaacggctcaagagaatggccattagcggcgatgactgcgtcgttaagcctatagatgacaggtttgctaacgccctgttggcattaaacgatatgggtaaagtgcgcaaggacatcccacaatggcagccgtcgaaagggtggcacgattggcagcaggtacccttctgttctcatcacttccacgagctgattatgaaggacggacgaaaactcgtggtcccttgccggccacaagacgaacttatcggcagagctaggattagtcagggcgccgggtggtccctgaaggagaccgcatgtctaggaaaggcctacgcgcagatgtggagcctgatgtattttcatcgcagagatctccggttggcttcaaatgccatctgctccgcagtgcccgttcactgggtgcctacttctaggacaacctggagcatacatgcccaccatcaatggatgactacagaagacatgctgaccgtctggaaccgtgtgtggatcgaggataatccatggatggaggacaaaacgcccgtaacaacctgggaaaacgttccttaccttggtaagcgagaggatcagtggtgtggcagtctgattgggctcacttcccgcgctacctgggcccagaatatcccgacagcaattcagcaagtgaggagcttaatcggaaacgaagagttcctggactacatgccatctatgaaacggtttaggaaggaggaagagtcagaaggcgctatttggtga

SEQ ID NO: 15327 - RNA, 9873 nt, synthetic construct
  misc_feature 1..9873: note = derived and/or modified CDS sequence (opt3) from DENV-3__JF937636__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatggggatcttgtgcctcgctatcctgtttgaagaggtgatgcgcggaaagttcggcaaaaagcacatgattgccggggtcttctttacgttcgtgctactgctctccggacagatcacttggcgggatatggcacataccctgattatgataggcagtaatgctagcgacagaatgggtatgggggttacatatcttgccttgatcgcaacctttaaaattcagcccttcctggccttaggatttttcctcaggaagctgacttctcgcgaaaaccttctgctaggcgtgggcctcgctatggcgacaaccctgcaattgccggaggatatcgaacagatggccaatgggattgcactgggattaatggctctcaaactgatcacacagtttgagacttaccagctttggaccgccctgatatccttgacgtgttcaaacacaatcttcaccctcactgtcgcctggcgaaccgctacactgattctagcaggtgtgagtctgcttcctgtttgccaaagctcgtccatgcggaagactgactggctcccaatggccgtggcggctatgggcgtcccccctctgcccttgtttatcttctctctgaaggataccttaaaacgtagaagctggccactcaatgagggggtaatggccgtgggactggtttcaattcttgcaagttccctgttgaggaacgacgtgcctatggccggccccctcgtcgctggtgggctgctaatcgcatgttatgtgataacgggaacatctgccgatctgaccgtagaaaaggcggctgacattacttgggaggaagaggccgaacagacaggcgtgagccacaaccttatgatcaccgtcgacgatgacggcactatgcgcatcaaagatgacgagacagagaatattctcaccgttctgttgaagacggcattactgatagtgtccgggatctttccatactcaattccggccactctcctggtgtggcatacctggcagaaacagacacaacggagcggagtcctttgggatgtgcctagtcccccagaaacccagaaggctgagctggaagagggtgtttacagaatcaaacagcagggcattttcgggaagacacaagtaggagtgggcgtccagaaggagggtgtgtttcacactatgtggcacgttaccaggggggccgtgttgacgtataacggaaaacgactagaacccaattgggcatctgtcaagaaagacctgatctcctacggcggcgggtggcgcctcagcgctcagtggcaaaagggagaggaagtgcaggtaatagccgtcgagcctggtaaaaacccaaagaatttccagacaatgcccggcactttccagaccacaaccggggaaatcggagcgattgccctggattttaagcctggcacttcgggttcaccgatcattaaccgggaggggaaagtggttggactttatggcaatggcgtggtcaccaagaacgggggatacgtgtctggtatcgcacaaacaaatgctgagccagacggccccacgcctgaattagaggaagagatgttcaaaaagagaaacctgactataatggatctccatccagggagtggaaaaaccaggaagtatttgcccgccattgttcgtgaagctatccgccggagactgaggacactcatcctggcacctacccgagtggtcgccgccgagatggaggaagctcttaagggcctgccgattcggtaccagactacagcgaccaaatccgagcacacgggtcgcgaaatcgtggacttgatgtgccatgcaacttttacaatgagactactgagccccgtaagggtgccaaattataacctcataattatggatgaggcccacttcaccgaccctgcttctatcgccgcacgggggtacattagcacccgagttggaatgggcgaagccgctgcgatctttatgactgccacacccccaggcaccgcagatgctttccctcagtccaatgcccccatacaggacgaggagagagacattccagaacgctcatggaacagtgggaatgagtggatcacagattttgcaggaaagactgtctggttcgtgccgagcatcaaagccggtaacgacattgctaactgtttaaggaagaatggcaaaaaggtgatccaactgtctcgtaagacgtttgataccgaataccagaaaacaaagcttaacgactgggatttcgtcgtaactaccgacatttccgagatgggggccaattttaaagcggatcgggtgatagaccctagaaggtgcctgaagcccgttatcctcacagatggaccagagcgcgtgattttggcaggccccatgcctgtcaccgccgcttcagccgctcagcgaagaggtcgggtggggaggaacccacagaaagaaaatgaccaatatatcttcactggccagcccctgaacaatgatgaggaccatgcacactggacggaagccaagatgctcctggacaacatcaatacccctgagggaattataccggctcttttcgaaccagagcgcgagaagagtgccgcaatcgatggcgaataccgtctaaaaggggagagcagaaagacatttgttgaactgatgcggaggggagacttgcccgtgtggttagcgcacaaagtcgcctccgagggtattaagtatactgatcgcaaatggtgcttcgacggccagcgaaacaatcagatcctggaagagaacatggatgtggagatttggaccaaggaaggggagaaaaagaagctcagacctcggtggctggacgctaggacatactctgatccccttgccctgaaagaatttaaggagttcgcagctggacgcaaatcgatcgccctcgacttggtaaccgaaataggcagagtgccaagccatctggcacacaggactcggaatgccctagataacctggttatgctccatacatcagagcacggtgggcgtgcttatcgccacgcggtcgaggaacttcctgagacgatggaaaccctgttattgctgggcctcatgatcctgcttactggaggcgccatgctgtttctcatttccgggaagggaatcggtaaaacaagtattggcttgatctgtgtgatagcatctagcgggatgctgtggatggctgagattcccttacaatggatcgcctccgccattgtgctagagttctttatgatggtcctgctcatcccagaacctgagaagcagcgaaccccgcaggacaatcaacttgcatacgttgtgataggaatcctgaccttggctgccattatcgcggctaacgaaatgggcctgctcgagacaactaagagagatctgggtatgtcaaaagaacccggggtagtgtctccaacgagctatcttgacgtcgatctccatcctgccagtgcatggaccctgtacgccgtggctacaactgttattacccccatgttgaggcacacaatcgagaattccaccgcaaacgtgagcctggccgcgatagctaaccaggccgtcgtattaatgggcctagacaagggatggccaatttctaaaatggacctgggcgtgcctctccttgcactggggtgctactcacaggttaatcccttgactctgacggccgctgtgctcctgcttatcacacattatgccatcattggaccgggcttacaggcaaaggctacccgggaggcccaaaaacgcactgcggccggtatcatgaagaacccaaccgtcgatgggataatgacaattgacctggatcctgtgatctacgactccaagttcgaaaaacagctcggacaggtcatgttgctggtgctatgtgcagttcagctgctccttatgagaactagttgggctctgtgcgaggccttgaccctggcaacaggccccattacgaccctctgggaaggtagcccaggcaagttttggaatactacaatcgctgtgtcgatggccaacatattcagggggtcttatctggccggagcgggcttagctttttccatcatgaaaagcgtagggaccggaaagcggggcactggttcacaaggggagacacttggagaaaaatggaagaagaaactgaatcagctcagtcgaaaggatttcgacctatacaaaaagtctggcattaccgaggtggatagaacggaggcaaaagaaggtctgaagcgcggcgagatcacccaccatgccgtctccagggggagcgctaaattgcagtggtttgttgaacggaacatggtgattcccgagggacgtgtcatcgacctgggctgtgggagaggaggctggtcatattactgcgccggtctcaagaaggtgacagaagtaagggggtatactaaaggaggccctggccacgaggagccggtgcccatgagtacctacgggtggaatattgttaagcttatgagcggaaaagatgtgttctacctgccacctgaaaagtgtgacacattgctgtgcgatatcggtgagtcctctcccagccctactgtcgaagagtcccgcaccatacgggtgctcaaaatggtcgagccatggttaaagaacaatcagttctgtattaaggtgctgaacccctatatgcctacagttatcgaacaccttgagcgactgcaaagaaaacatggcgggatgctagtaaggaatccactctcacgcaactctacccacgaaatgtactggatcagtaatggaactggcaacattgtggcatcggtcaatatggtgagccggctgttgctgaacagatttacgatgacacatcgtaggcccaccatagagaaggacgttgatctcggtgccgggactcggcacgtgaacgctgaaccggagacccctaatatggacgtcatcggagagcgcattaaacgaatcaaggaagagcacaactccacatggcattatgacgatgaaaatccatacaaaacgtgggcgtatcacggctcttacgaggtgaaggccaccggctcagcaagctccatgattaacggggtagtgaagcttctgactaaaccctgggacgttgtccctatggtgacacagatggctatgaccgatactacaccattcggacagcaaagagtgtttaaggaaaaagtcgacaccaggacaccccggagtatgccgggtactcgcagagttatgggcatcaccgccgagtggttatggaggacgctggggcgaaataagaaacctcggttgtgcacccgtgaggaattcacaaagaaggtgagaactaacgcagccatgggagctgtatttaccgaggaaaatcagtgggattctgccaaagcggcagtggaggacgaagatttctggaagctcgtcgaccgcgagagggagctgcataaactaggcaagtgtggtagctgcgtgtataacatgatggggaaacgggaaaagaaacttggagagtttggcaaggccaagggctcaagagctatatggtacatgtggctgggggcccgctacctcgaattcgaggcactgggatttttgaatgaggatcactggttctccagggaaaacagttatagcggtgttgagggcgaagggctgcataaactcggatacatccttcgagacatttctaagatccccggcggtgctatgtatgccgatgacacagctgggtgggacactcggattaccgaggatgacctgcacaatgaagagaaaatcacgcagcagatggatccagagcacagacaattagccaacgcaatatttaagctgacataccagaataaagtggtcaaggtgcagaggcctacccccactggaacagtaatggacattatctcccgcaaggatcagcgtggctcaggccaagttgggacctatggattgaacactttcaccaatatggaagcgcagctcatccggcagatggagggtgaaggcgtgctgagcaaagccgacctagagaacccacatcttcccgaaaagaaaattacacagtggctggagacgaagggggtcgagagactcaaaaggatggctatatcgggagatgactgcgtggtgaagcctatcgatgaccgctttgccaacgcactgttggctttaaatgatatgggcaaggtccgaaaagacattccacaatggcagccgtctaagggttggcacgattggcagcaggttcccttctgtagtcatcacttccacgaactgatcatgaaagacgggcggaagctcgtggtaccttgcagaccacaagacgagcttattggaagggcccgcatctcccagggcgcaggctggagcctgaaagaaaccgcctgtctagggaaggcgtacgctcagatgtggtcactgatgtattttcatagacgggatctcaggttggcctccaacgcaatatgctctgccgtgcccgtccactgggtgcctactagccgtacaacctggagtatccatgctcaccatcaatggatgactacagaggacatgctgaccgtttggaatcgagtgtggattgaagataacccatggatggaggacaagacgcccgtcacaacctgggagaatgtgccttaccttggaaaacgcgaagatcagtggtgtggttccctgatcggcctcactagcagagccacctgggcacagaacattccgacagctatccagcaagtacggtctttaattgggaatgaggaattcctggactacatgccatcaatgaagaggtttcgcaaagaggaggaaagtgagggagccatatggtga

SEQ ID NO: 15328 - RNA, 9873 nt, synthetic construct
  misc_feature 1..9873: note = derived and/or modified CDS sequence (opt3) from DENV-3__JF937626__SS-prME
  source 1..9873: mol_type = other RNA
accagcctgtgcctcatgatgatccttcccgcagctctggcattccacttgacatccagagacggcgaacctagaatgattgtggggaagaacgaacggggtaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagcatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgactaagaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagccggtgttagtctgcttcctgtgtgccaaagctcgtccatgcggaagactgactggctcccaatggccgtcgcggctatgggcgtaccccctctgcccttgtttattttcgggctgaaggataccttaaaacgtagatcttggccactcaatgagggagtgatggccgttggcctggtgagcatccttgcatcaagtctgttgaggaacgacgtccctatggccggtcccctcgtggctgggggactgctaattgcatgttatgtaatcacgggcacatccgccgatctgaccgtggaaaaggcggctgacatgacttgggaggaagaggccgaacagacaggcgtctctcacaaccttatgataaccgttgacgatgacgggactatgcgcattaaagatgacgagacagagaatatcctcaccgtgctgttgaagacggcattactgatcgtgagcggaatttttccatactccataccggccactctcctggtctggcatacctggcagaaacagacacaacggtcaggtgtgctttgggatgttcctagtcccccagaaacccagaaggctgagctggaagagggcgtatacagaatcaaacagcaggggattttcggaaagacacaagtgggcgtcggtgtgcagaaggagggggtttttcacactatgtggcacgtgaccaggggagccgtcttgacgtataacggcaaacgactagaacccaattgggcaagtgtgaagaaagacctgatctcttacggcgggggatggcgcctctccgctcagtggcaaaagggtgaggaagtacaggtcattgccgtggagcctggcaaaaacccaaagaatttccagacaatgcccgggactttccagaccacaaccggagaaatcggcgcgatagccctggattttaagcctggtactagcgggtcgccgatcattaaccgggagggaaaagttgtgggcctttatggcaatggggtcgtgaccaagaacggaggttacgtttcaggcatcgcacaaacaaatgctgagccagacgggcccacgcctgaattagaggaagagatgttcaaaaagagaaacctgactattatggatctccatccaggatctggcaaaaccaggaagtatttgcccgccatcgtgcgtgaagctataaagcgccggctgagaacactcattctggcacctaccagggtcgtggccgccgagatggaggaagctcttaaaggtctgccgatccgataccagactacagcgaccaagagtgagcacacggggcgggaaatcgtagacttgatgtgccatgcaacttttacaatgcgcctactgtcccccgtgagagttccaaattataacctcattatcatggatgaggcccacttcaccgaccctgctagcatagccgcaaggggatacatttctacccgggtcggcatgggcgaagccgctgcgatctttatgactgccacacccccagggaccgcagatgctttccctcagagcaatgcccccattcaggacgaggagcgagacatcccagaaagatcctggaactcaggaaatgagtggataacagattttgcaggtaaaactgtgtggttcgtgccgagtattaaggccggcaacgacatcgctaactgtttacgcaaaaatgggaagaaggtcatccaactgagcaggaaaacgtttgataccgaataccagaagacaaaacttaacgactgggatttcgtagtgactaccgacatttctgagatgggagccaattttaaggcggatcgtgttatcgaccctcggagatgcctgaaacccgtgattctcacagatggcccagagagggtcatattggcaggtcccatgcctgtgaccgccgcttccgccgctcagcgccgagggagagttggccggaacccacagaaggaaaatgaccaatatatcttcactggacagcccctgaacaatgatgaggaccatgcacactggacggaagccaagatgctcctggacaacattaatacccctgagggcatcatcccggctcttttcgaaccagagagggagaaatcagccgcaattgatggggaataccgcctaaagggagagagtcgtaaaacatttgtggaactgatgagacggggtgacttgcccgtctggttagcgcacaaggtggccagcgagggcataaaatatactgataggaagtggtgcttcgacgggcagcgcaacaatcagatcctggaagagaacatggatgtagagatttggaccaaagaaggagagaagaagaaactccgacctagatggctggacgctcggacatactccgatccccttgccctgaaggaatttaaagagttcgcagctggcaggaagtctatcgccctcgacttggtgaccgaaattggtcgcgttccatcgcatctggcacacagaactaggaatgccctagataacctggtcatgctccatacaagcgagcacgggggccgggcttatcgtcacgcggtggaggaacttcctgagacgatggaaaccctgttattgctgggactcatgatcctgcttactggcggggccatgctgtttctcatatcaggaaaaggtatcggcaagacatccattgggttgatctgtgtgattgcaagttctggaatgctgtggatggctgagatccccttacaatggatagccagcgccattgtcctagagttctttatgatggttctgctcatcccagaacctgagaagcagcgcaccccgcaggacaatcaacttgcatacgtggtaattggcatcctgaccttggctgccataatcgcggctaacgaaatgggtctgctcgagacaactaaacgagatctggggatgtccaaggaacccggcgtggtctcaccaacgtcttatcttgacgtggatctccatcctgccagcgcatggaccctgtacgccgttgctacaactgtgattacccccatgttgagacacacaatcgagaatagtaccgcaaacgtctccctggccgcgattgctaaccaggccgtagtgttaatgggactagacaaaggctggccaatcagcaagatggacctgggggttcctctccttgcactgggatgctactctcaggtgaatcccttgactctgacggccgctgtcctcctgcttataacacattatgccattatcggcccgggtttacaggcaaaagctaccagggaggcccaaaagcggactgcggccgggatcatgaagaacccaaccgtggatggaattatgacaatcgacctggatcctgtcatatacgactcaaaattcgaaaagcagctcggccaggtgatgttgctggttctatgtgcagtgcagctgctccttatgcgcacttcctgggctctgtgcgaggccttgaccctggcaacaggtcccattacgaccctctgggaaggcagtccagggaaattttggaatactacaatcgctgtaagcatggccaacattttcagaggatcgtatctggccggcgcggggttagctttttctatcatgaagtccgtgggaaccggcaaaaggggtactgggagccaaggagagacacttggcgaaaagtggaagaaaaagctgaatcagctctcacggaaagatttcgacctatacaagaaaagtggtataaccgaggtcgatcgaacggaggcaaaggaaggcctgaaaagaggggagatcacccaccatgccgtttctcgcggatccgctaagttgcagtggtttgtggaaaggaacatggtcgtgcccgagggccgggtaattgacctggggtgtggacgtggcggttggagctattactgcgccgggctcaagaaagtgacagaagttagaggatatactaagggcggccctgggcacgaggagccggtgcccatgtcaacctacggatggaatatcgtcaaacttatgagtggtaaggatgtgttctacctgccacctgaaaaatgtgacacattgctgtgcgatattggcgagagctccccctctcctactgtcgaagagagcaggaccatccgcgtgctcaagatggttgagccatggttaaagaacaatcagttctgtattaaagtactgaacccctatatgcctacagtgatcgaacaccttgagcggctgcaacgaaagcatgggggaatgctagtcagaaatccactctccaggaactcaacccacgaaatgtactggatatctaatggcactggtaacattgtggcaagtgttaatatggtgtcgcgcctgttgctgaaccggtttacgatgacacatagacgtcccaccatcgagaaagacgtcgatctcggggccggaactaggcacgtgaacgctgaaccggagacccctaatatggacgtaatcggcgagcggattaagcgcataaaagaagaacacaacagcacatggcattatgacgatgaaaatccatacaagacgtgggcgtatcacggctcctacgaggtgaaggccaccgggtctgcatcaagcatgatcaacggagttgtcaaacttctgactaagccctgggacgtggtgcctatggtcacacagatggctatgaccgatactacaccattcggtcagcaacgagtttttaaagaaaaggtggacaccagaacacccaggtccatgccgggcactcggcgcgtaatggggattaccgccgagtggttatggagaacgctgggaaggaataaaaagcctcgattgtgcacccgggaggagttcacaaagaaagtgcgtactaacgcagccatgggcgctgtctttaccgaggaaaatcagtgggatagtgccaaggcggcagtggaggacgaagatttctggaaactcgttgacagagagcgcgagctgcataagctaggtaaatgtgggtcttgcgtgtataacatgatgggaaagagggagaagaaacttggcgagtttggcaaagccaaagggagccgggctatctggtacatgtggctgggagccagatacctcgagttcgaggcactgggatttttgaatgaggatcactggttctcacgcgaaaactcctatagtggcgtcgagggggaaggactgcataagctcggctacattcttagggacatcagcaaaatacccggtggggctatgtatgccgatgacacagctggatgggacactcgaatcaccgaggatgacctgcacaatgaagagaagattacgcagcagatggatccagagcaccggcaattagccaacgcaatctttaaactgacataccagaataaggtggtaaaggttcagagacctacccccactggcacagtgatggacattatctctaggaaagatcagcgcggctccgggcaagtcggaacctatggtttgaacactttcaccaatatggaagcgcagctcatacgtcagatggagggcgaaggggtgctgtcaaaggccgacctagagaacccacatcttcccgagaaaaagattacacagtggctggagacgaaaggagtggagcggctcaagagaatggctatcagcggcgatgactgcgtcgttaagcctatcgatgacaggtttgccaacgcactgttggctttaaatgatatgggtaaagtgcgcaaggacattccacaatggcagccgtcgaaagggtggcacgattggcagcaggtacccttctgttctcatcacttccacgaactgataatgaaggacggacgaaaactcgtggtcccttgccggccacaagacgagcttatcggcagagccaggattagtcagggcgcagggtggtccctgaaggaaaccgcctgtctaggaaaggcgtacgctcagatgtggagcctgatgtattttcatcgcagagatctccggttggcctcaaacgcaatctgctccgccgtgcccgttcactgggtgcctacttctaggacaacctggagcattcatgctcaccatcaatggatgactacagaggacatgctgaccgtctggaatcgtgtgtggatcgaagataacccatggatggaggacaaaacgcccgtaacaacctgggagaatgttccttaccttggtaagcgagaagatcagtggtgtggcagtctgatagggctcacttcccgcgccacctgggcacagaacatcccgacagctattcagcaagtgaggagcttaatcggaaatgaggagttcctggactacatgccatctatgaaacggtttaggaaggaggaggaatcagagggcgccatttggtga

SEQ ID NO: 15329 - RNA, 9873 nt, synthetic construct
  misc_feature 1..9873: note = derived and/or modified CDS sequence (opt3) from DENV-3__JF937621__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagcaggtgttagtctgcttcctgtgtgccaaagctcgtccatgcggaagactgactggctcccaatggccgtcgcggctatgggcgtaccccctctgcccttgtttattttcgggctgaaggataccttaaaacgtagatcttggccactcaatgagggagtgatggccgttggcctggtgagcatccttgcatcaagtctgttgaggaacgacgtccctatggccggtcccctcgtggctgggggactgctaattgcatgttatgtaatcacgggcacatccgccgatctgaccgtggaacgcgcggctgacataacttgggaggaagaggccgaacagacaggcgtctctcacaaccttatgattaccgttgacgatgacgggactatgcggatcaaggatgacgagacagagaatatcctcaccgtgctgttgaaaacggcattactgattgtgagcggaatatttccatactccatcccggccactctcctggtctggcatacctggcagaagcagacacaaagatcaggtgtgctttgggatgttcctagccccccagaaacccagaaagctgagctggaagagggcgtatacaggattaagcagcaggggatcttcggaaaaacacaagtgggcgtcggtgtgcagaaggagggggtttttcacactatgtggcacgtgacccgaggagccgtcttgacgtataacggcaagcgcctagaacccaattgggcaagtgtgaaaaaggacctgatttcttacggcgggggatggcggctctccgctcagtggcaaaaaggtgaggaagtacaggtcatcgccgtggagcctggcaagaacccaaaaaatttccagacaatgcccgggactttccagaccacaaccggagaaataggcgcgatcgccctggattttaagcctggtactagcgggtcgccgattatcaacagagagggaaaggttgtgggcctttatggcaatggggtcgtgaccaaaaacggaggttacgtttcaggcattgcacaaacaaatgctgagccagacgggcccacgcctgaattagaggaagagatgttcaagaaaaggaacctgactatcatggatctccatccaggatctggcaagacccgtaaatatttgcccgccatagtgcgcgaagctattaagcggagactgaggacactcatcctggcacctacccgagtcgtggccgccgagatggaggaagctcttaagggtctgccgatccggtaccagactacagcgaccaaaagtgagcacacggggcgcgaaattgtagacttgatgtgccatgcaacttttacaatgagactactgtcccccgtgagggttccaaattataacctcatcataatggatgaggcccacttcaccgaccctgctagcattgccgcacggggatacatctctacccgagtcggcatgggcgaagccgctgcgatttttatgactgccacacccccagggaccgcagatgctttccctcagagcaatgcccccatccaggacgaggagagagacataccagaacgctcctggaactcaggaaatgagtggattacagattttgcaggtaagactgtgtggttcgtgccgagtatcaaagccggcaacgacatcgctaactgtttaaggaagaatgggaaaaaggtcattcaactgagccgtaagacgtttgataccgaataccagaaaacaaagcttaacgactgggatttcgtagtgactaccgacatctctgagatgggagccaattttaaagcggatcgggttattgaccctagaaggtgcctgaagcccgtgatactcacagatggcccagagcgcgtcatcttggcaggtcccatgcctgtgaccgccgcttccgccgctcagcgaagagggcgggttggcaggaacccacagaaagaaaatgaccaatatattttcactggacagcccctgaacaatgatgaggaccatgcacactggacggaagccaagatgctcctggacaacatcaatacccctgagggcatcattccggctcttttcgaaccagagcgcgagaagtcagccgcaatagatggggaataccgtctaaaaggagagagtagaaagacatttgtggaactgatgcggaggggtgacttgcccgtctggttagcgcacaaagtggccagcgagggcatcaagtatactgatcgcaaatggtgcttcgacgggcagcgaaacaatcagattctggaagagaacatggatgtagagatctggaccaaggaaggagagaaaaagaagctcagacctcggtggctggacgctaggacatactccgatccccttgccctgaaagaatttaaggagttcgcagctggccgcaaatctattgccctcgacttggtgaccgaaatcggtagagttccatcgcatctggcacacaggactcggaatgccctagataacctggtcatgctccatacaagcgagcacgggggccgtgcttatcgccacgcggtggaggaacttcctgagacgatggaaaccctgttattgctgggactcatgatactgcttactggcggggccatgctgtttctcatctcaggaaagggtattggcaaaacatccatcgggttgatttgtgtgatcgcaagttctggaatgctgtggatggctgagatacccttacaatggattgccagcgccatcgtcctagagttctttatgatggttctgctcattccagaacctgagaagcagcgaaccccgcaggacaatcaacttgcatacgtggtaatcggcatactgaccttggctgccatcattgcggctaacgaaatgggtctgctcgagacaactaagagagatctggggatgtccaaagaacccggcgtggtctcaccaacgtcttatcttgacgtggatctccatcctgccagcgcatggaccctgtacgccgttgctacaactgtgatcacccccatgttgaggcacacaattgagaatagtaccgcaaacgtctccctggccgcgatcgctaaccaggccgtagtgttaatgggactagacaagggctggccaataagcaaaatggacctgggggttcctctccttgcactgggatgctactctcaggtgaatcccttgactctgacggccgctgtcctcctgcttattacacattatgccatcatcggcccgggtttacaggcaaaggctacccgggaggcccaaaaacgcactgcggccgggattatgaagaacccaaccgtggatggaatcatgacaatagacctggatcctgtcatttacgactcaaagttcgaaaaacagctcggccaggtgatgttgctggttctatgtgcagtgcagctgctccttatgagaacttcctgggctctgtgcgaggccttgaccctggcaacaggtcccatcacgaccctctgggaaggcagtccagggaagttttggaatactacaattgctgtaagcatggccaacatcttcaggggatcgtatctggccggcgcggggttagctttttctataatgaaatccgtgggaaccggcaagcggggtactgggagccaaggagagacacttggcgaaaaatggaagaagaaactgaatcagctctcacgaaaggatttcgacctatacaaaaagagtggtatcaccgaggtcgatagaacggaggcaaaagaaggcctgaagcgcggggagattacccaccatgccgtttctaggggatccgctaaattgcagtggtttgtggaacggaacatggtcatccccgagggccgtgtgattgacctggggtgtggaagaggcggttggagctattactgcgccgggctcaagaaggtaacagaagtgaggggatatactaaaggcggccctgggcacgaggagccggttcccatgtcaacctacggatggaatatcgtgaagcttatgagtggtaaagatgtcttctacctgccacctgaaaagtgtgacacattgctgtgcgatattggcgagagctccccctctcctactgtggaagagagccgcaccatccgggtcctcaaaatggtggagccatggttaaagaacaatcagttctgtataaaggttctgaacccctatatgcctacagtaattgaacaccttgagcgactgcaaagaaaacatgggggaatgctagtgaggaatccactctcccgcaactcaacccacgaaatgtactggatctctaatggcactggtaacatcgtcgcaagtgtgaatatggtttcgcggctgttgctgaacagatttacgatgacacatcgtaggcccaccattgagaaggacgtggatctcggggccggaactcggcacgtcaacgctgaaccggagacccctaatatggacgtgataggcgagcgcatcaaacgaattaaggaagagcacaacagcacatggcattatgacgatgaaaatccatacaaaacgtgggcgtatcacggctcctacgaggtaaaggccaccgggtctgcatcaagcatgatcaacggagtggttaagcttctgactaaaccctgggacgtcgtgcctatggtgacacagatggctatgaccgatactacaccattcggtcagcaaagagtctttaaggaaaaagttgacaccaggacaccccggtccatgccgggcactcgcagagtgatggggattaccgccgagtggttatggaggacgctgggacgaaataagaaacctcggttgtgcacccgtgaggaattcacaaagaaggtaagaactaacgcagccatgggcgctgtgtttaccgaggaaaatcagtgggatagtgccaaagcggcagtcgaggacgaagatttctggaagctcgtggaccgcgagagggagctgcataaactaggtaagtgtgggtcttgcgtttataacatgatgggaaaacgggaaaagaaacttggcgagtttggcaaggccaaggggagcagagctatctggtacatgtggctgggagcccgctacctcgaattcgaggcactgggttttttgaatgaggatcactggttctcaagggaaaactcctatagtggcgtggagggggaaggactgcataaactcggctacatacttcgagacatcagcaagattcccggtggggctatgtatgccgatgacacagctggatgggacactcggatcaccgaggatgacctgcacaatgaagagaaaattacgcagcagatggatccagagcacagacaattagccaacgcaatctttaagctgacataccagaataaagtcgtgaaggtacagaggcctacccccactggcacagttatggacataatttctcgcaaggatcagcgtggctccgggcaagtgggaacctatggtttgaacactttcaccaatatggaagcgcagctcatccggcagatggagggcgaaggggtcctgtcaaaagccgacctagagaacccacatcttcccgaaaagaaaatcacacagtggctggagacgaagggagtggagagactcaaaaggatggctattagcggcgatgactgcgtggtcaagcctatagatgaccgctttgccaacgcactgttggctttaaatgatatgggtaaggttcgaaaagacatcccacaatggcagccgtcgaaggggtggcacgattggcagcaggtgcccttctgttctcatcacttccacgaactgattatgaaagacggacggaagctcgtagtgccttgcagaccacaagacgagcttatcggcagggcccgcattagtcagggcgcagggtggtccctgaaagaaaccgcctgtctaggaaaggcgtacgctcagatgtggagcctgatgtattttcatagacgggatctcaggttggcctcaaacgcaatctgctccgccgtccccgtgcactgggttcctacttctcgtacaacctggagcatacatgctcaccatcaatggatgactacagaggacatgctgaccgtgtggaatcgagtctggatcgaagataacccatggatggaggacaagacgcccgtgacaacctgggagaatgtaccttaccttggtaaacgcgaagatcagtggtgtggcagtctgattgggctcacttccagagccacctgggcacagaacatcccgacagctattcagcaagttcggagcttaatcggaaatgaggaattcctggactacatgccatctatgaagaggtttcgcaaagaggaggaatcagagggcgccatttggtga

SEQ ID NO: 15330 - RNA, 9873 nt, synthetic construct
  misc_feature 1..9873: note = derived and/or modified CDS sequence (opt3) from DENV-3__JF937623__SS-prME
  source 1..9873: mol_type = other RNA
gccagcctgtgcctcatgatgatccttcccgctgcactggccttccacttgacctccagagacggcgagcctaggatgattgtggggaagaacgaacggggaaaatctttactgtttaagacagcgtcaggtataaatatgtgtactctaatcgctatggatctcggcgagatgtgcgacgatacggtcacctacaaatgtccacatattacagaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccacattgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcagaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgtgtctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcagggattttctttaccttcgtgctactgctctccggacagatcacgtggcgggatatggctcatactctgattatgataggcagtaatgccagcgacagaatgggtatgggggttacctatcttgcattgatcgccacatttaaaattcagcccttcctggctttaggatttttcctcaggaagctgacctctcgcgaaaaccttctgctaggcgtgggcctcgcgatggccactacactgcaattgccggaggatatcgaacagatggcaaatgggattgctctgggattaatggccctcaaactgatcacccagtttgagacataccagctttggactgccctgatatccttgacctgttcaaacacgatcttcacactcaccgtcgcttggcgaactgcaaccctgattctagccggtgtgagtctgcttcctgtttgccaaagctcgtccatgcggaagacagactggctcccaatggcggtggctgccatgggcgtcccccctctgcccttgtttatcttcgggctgaaggatactttaaaacgtagatcttggccactcaatgagggagtaatggcagtgggcctggttagcattcttgcctcaagtctgttgaggaacgacgtgcctatggctggtcccctcgtcgcagggggactgctaatcgcctgttatgtgataaccggcacgtccgcggatctgacagtagaaaaggctgccgacatgacctgggaggaagaggcagaacagactggcgtgtctcacaaccttatgattacagtcgacgatgacgggaccatgcgcatcaaagatgacgagactgagaatatcctcacagttctgttgaagaccgccttactgattgtgagcggaatatttccatactccatcccggctacgctcctggtgtggcatacttggcagaaacagacccaacggtcaggtgtcctttgggatgtgcctagccccccagaaacacagaaggccgagctggaagagggcatttacagaatcaaacagcaggggattttcggaaagacccaagttggcgtaggtgtgcagaaggagggggtctttcacacaatgtggcacgtgactaggggagcagttttgacctataacggcaaacgactagaacccaattgggctagtgtgaagaaagacctgatctcttacggcgggggatggcgcctctccgcccagtggcaaaagggtgaggaagtccaggtgatagcggtagagcctggcaaaaacccaaagaatttccagacgatgcccgggacattccagactaccacaggagaaatcggcgccattgcactggattttaagcctggtaccagcgggtcgccgatcattaaccgggagggaaaagtcgtgggcctttatggcaatggggttgtgactaagaacggaggttacgtctcaggcatcgctcaaaccaatgccgagccagacgggcccacacctgaattagaggaagagatgttcaaaaagagaaacctgacgataatggatctccatccaggatctggcaaaactaggaagtatttgcccgctattgtgcgtgaagcaatcaagcgccggctgagaaccctcatcctggcccctacaagggttgtggccgctgagatggaggaagcgcttaaaggtctgccgattcgataccagaccactgcaacaaagagtgagcacaccgggcgggaaatcgtcgacttgatgtgccatgccacgtttactatgcgcctactgtcccccgtgagagtaccaaattataacctcataattatggatgaggctcacttcacagaccctgccagcatcgcagccaggggatacatttctacccgggtgggcatgggcgaagctgcggccatctttatgaccgcaactcccccagggacagctgatgccttccctcagagcaatgcacccatacaggacgaggagcgagacattccagaaagatcctggaactcaggaaatgagtggatcaccgattttgccggtaaaacagtttggttcgtcccgagtatcaaggctggcaacgacattgccaactgtttacgcaaaaatgggaagaaggtgatccaactgagcaggaaaacttttgatacggaataccagaagaccaaacttaacgactgggatttcgtggtcacaactgacatttctgagatgggagcgaattttaaggcagatcgtgtaatagaccctcggagatgcctgaaacccgtgatcctcaccgatggcccagagagggttattttggccggtcccatgcctgtgacagctgcctccgctgcacagcgccgagggagagtcggccggaacccacagaaggaaaatgaccaatatatcttcaccggacagcccctgaacaatgatgaggaccatgcccactggactgaagctaagatgctcctggacaacatcaatacgcctgagggcattataccggcccttttcgaaccagagagggagaaatcagcagcgatcgatggggaataccgcctaaagggagagagtcgtaaaacctttgtggaactgatgagacggggtgacttgcccgtttggttagcccacaaggtggctagcgagggcattaaatatacagataggaagtggtgcttcgacgggcagcgcaacaatcagatcctggaagagaacatggatgtcgagatttggactaaagaaggagagaagaagaaactccgacctagatggctggacgcccggacctactccgatccccttgcactgaaggaatttaaagagttcgctgccggcaggaagtctatcgcactcgacttggtgacagaaataggtcgcgtaccatcgcatctggcccacagaaccaggaatgctctagataacctggtgatgctccatactagcgagcacgggggccgggcgtatcgtcacgccgttgaggaacttcctgagacaatggaaacgctgttattgctgggactcatgatcctgcttaccggcggggcaatgctgtttctcatttcaggaaaaggtatcggcaagacttccattgggttgatctgtgtcatagctagttctggaatgctgtggatggccgagattcccttacaatggatcgccagcgcaattgtgctagagttctttatgatggtgctgctcatcccagaacctgagaagcagcgcacaccgcaggacaatcaacttgcttacgtcgttataggcatcctgaccttggccgcgattatcgctgccaacgaaatgggtctgctcgagaccacaaaacgagatctggggatgtccaaggaacccggcgtggtatcaccaacttcttatcttgacgtggatctccatcctgcaagcgcctggacgctgtacgctgtcgcaaccacagtgattactcccatgttgagacacaccatcgagaatagtacagccaacgtttccctggcggctatagccaaccaggcagtggtcttaatgggactagacaaaggctggccaattagcaagatggacctgggggtacctctccttgccctgggatgctactctcaggtgaatcccttgaccctgactgctgccgttctcctgcttatcacgcattatgcaatcattggcccgggtttacaggctaaagccacaagggaggcgcaaaagcggaccgccgcagggatcatgaagaacccaactgtggatggaataatgaccattgacctggatcctgtcatctacgactcaaaattcgaaaagcagctcggccaggtgatgttgctggtcctatgtgctgtgcagctgctccttatgcgcacatcctgggccctgtgcgaggcattgactctggctaccggtcccattacaacgctctgggaaggcagtccagggaaattttggaataccactatcgccgttagcatggccaacatattcagaggatcgtatctggcgggcgctgggttagcattttctatcatgaagtccgtgggaacaggcaaaaggggtaccgggagccaaggagagactcttggcgaaaagtggaagaaaaagctgaatcagctctcacggaaagatttcgacctatacaagaaaagtggtattacagaggtagatcgaaccgaggccaaggaaggcctgaaaagaggggagatcacgcaccatgctgtgtctcgcggatccgccaagttgcagtggtttgtcgaaaggaacatggttattcccgagggccgggtgatcgacctggggtgtggacgtggcggttggagctattactgcgcagggctcaagaaagtcaccgaagtgagaggatatacaaagggcggccctgggcacgaggagccggtacccatgtcaacttacggatggaatattgtgaaacttatgagtggtaaggatgttttctacctgccacctgaaaaatgtgacaccttgctgtgcgatatcggcgagagctccccctctcctacagtggaagagagcaggactatacgcgtcctcaagatggtggagccatggttaaagaacaatcagttctgtattaaagtcctgaacccctatatgcctaccgtgatcgaacaccttgagcggctgcaacgaaagcatgggggaatgctagttagaaatccactctccaggaactcaacacacgaaatgtactggatctctaatggcaccggtaacattgtagccagtgtgaatatggtctcgcgcctgttgctgaaccggtttactatgacgcatagacgtcccacaatagagaaagacgtggatctcggggctggaaccaggcacgttaacgcggaaccggagactcctaatatggacgtgatcggcgagcggattaagcgcatcaaagaagagcacaacagcacctggcattatgacgatgaaaatccatacaagacatgggcctatcacggctcctacgaggtcaaggcaacggggtctgcttcaagcatgattaacggagtggtaaaacttctgaccaagccctgggacgtggttcctatggtcactcagatggccatgacagataccactccattcggtcagcaacgagtgtttaaagaaaaggtggacacaagaacccccaggtccatgccgggcacacggcgcgtcatggggatcactgcagagtggttatggagaaccctgggaaggaataaaaagcctcgattgtgcacgcgggaggaattcaccaagaaagttcgtacaaacgccgctatgggcgccgtgtttactgaggaaaatcagtgggatagtgcgaaggcagccgtagaggacgaagatttctggaaactcgtggacagagagcgcgagctgcataagctaggtaaatgtgggtcttgcgtctataacatgatgggaaagagggaaaaaaagcttggcgagtttggcaaggctaaagggagccgggccatatggtacatgtggctgggagcaagatacctcgaattcgaggctctgggttttttgaatgaggatcactggttctcacgcgaaaactcctatagtggcgtggagggggaaggactgcataagctcggctacatccttagggacattagcaaaatccccggtggggccatgtatgctgatgacaccgccggatgggacacacgaattactgaggatgacctgcacaatgaagagaagatcacccagcagatggatccagagcaccggcaattagcaaacgcgatatttaaactgacgtaccagaataaggttgtgaaggtccagagacctacacccaccggcactgtgatggacattatctctaggaaagatcagcgcggctccgggcaagtaggaacatatggtttgaacaccttcactaatatggaagcccagctcatccgtcagatggagggcgaaggggttctgtcaaaggctgacctagagaacccacatcttcccgaaaaaaagattacccagtggctggagacaaaaggagtggagcggctcaagagaatggccataagcggcgatgactgcgtcgtgaagcctatcgatgacaggtttgcaaacgctctgttggccttaaatgatatgggtaaagtgcgcaaggacattccacaatggcagccgtcgaaagggtggcacgattggcagcaggtccccttctgttctcatcacttccacgaactgatcatgaaggacggacgaaaactcgttgtgccttgccggccacaagacgagcttattggcagagcaaggatcagtcagggcgccgggtggtccctgaaggaaacggcgtgtctaggaaaggcttacgcccagatgtggagcctgatgtattttcatcgcagagatctccggttggcatcaaacgccatatgctccgctgtacccgtgcactgggtccctacctctaggactacatggagcatccatgcccaccatcaatggatgaccactgaggacatgctgacagtgtggaatcgtgtttggattgaagataacccatggatggaggacaaaacccccgtgacgacatgggagaatgtcccttaccttggtaagcgagaagatcagtggtgtggcagtctgatcgggctcacctcccgcgcaacttgggctcagaacattccgaccgccatccagcaagtgagaagcttaattggaaatgaggaattcctggactacatgccatctatgaaacggtttaggaaggaggaggaatcagagggcgcgatatggtga

SEQ ID NO: 15331 - RNA, 9873 nt, synthetic construct
  misc_feature 1..9873: note = derived and/or modified CDS sequence (opt3) from DENV-3__JF937637__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacgcttttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgtgtctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccataggcccgggtatcacacacaaactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggtgttctttaccttcgttctactgctctccggacagattacgtggcgggatatggctcatactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatggcggtcgctgccatgggcgtaccccctctgcccttgtttattttcgggctgaaggatactttaaaacgtagatcttggccactcaatgagggagtgatggcagttggcctggtgagcatccttgcctcaagtctgttgaggaacgacgtccctatggctggtcccctcgtggcagggggactgctaattgcctgttatgtaatcaccggcacgtccgcggatctgacagtggaaaaggctgccgacataacctgggaggaagaggcagaacagactggcgtctctcacaaccttatgattacagttgacgatgacgggaccatgcgcatcaaagatgacgagactgagaatatcctcacagtgctgttgaagaccgccttactgattgtgagcggaatatttccatactccatcccggctacgctcctggtctggcatacttggcagaaacagacccaacggtcaggtgtgctttgggatgttcctagccccccagaaacacagaaggccgagctggaagagggcgtatacagaattaaacagcaggggatcttcggaaagacccaagtgggcgtcggtgtgcagaaggagggggtttttcacacaatgtggcacgtgactaggggagcagtcttgacctataacggcaaacgactagaacccaattgggctagtgtgaagaaagacctgatttcttacggcgggggatggcgcctctccgcccagtggcaaaagggtgaggaagtacaggtcatcgcggtggagcctggcaaaaacccaaagaatttccagacgatgcccgggacattccagactaccacaggagaaataggcgccatcgcactggattttaagcctggtaccagcgggtcgccgattatcaaccgggagggaaaagttgtgggcctttatggcaatggggtcgtgactaagaacggaggttacgtttcaggcattgctcaaaccaatgccgagccagacgggcccacacctgaattagaggaagagatgttcaaaaagagaaacctgacgatcatggatctccatccaggatctggcaaaactaggaagtatttgcccgctatagtgcgtgaagcaattaagcgccggctgagaaccctcatcctggcccctacaagggtcgtggccgctgagatggaggaagcgcttaaaggtctgccgatccgataccagaccactgcaacaaagagtgagcacaccgggcgggaaattgtagacttgatgtgccatgccacgtttactatgcgcctactgtcccccgtgagagttccaaattataacctcatcataatggatgaggctcacttcacagaccctgccagcattgcagccaggggatacatctctacccgggtcggcatgggcgaagctgcggccatttttatgaccgcaactcccccagggacagctgatgccttccctcagagcaatgcacccatccaggacgaggagcgagacataccagaaagatcctggaactcaggaaatgagtggattaccgattttgccggtaaaacagtgtggttcgtgccgagtatcaaggctggcaacgacatcgccaactgtttacgcaaaaatgggaagaaggtcattcaactgagcaggaaaacttttgatacggaataccagaagaccaaacttaacgactgggatttcgtagtgacaactgacatctctgagatgggagcgaattttaaggcagatcgtgttattgaccctcggagatgcctgaaacccgtgatactcaccgatggcccagagagggtcatcttggccggtcccatgcctgtgacagctgcctccgctgcacagcgccgagggagagttggccggaacccacagaaggaaaatgaccaatatattttcaccggacagcccctgaacaatgatgaggaccatgcccactggactgaagctaagatgctcctggacaacatcaatacgcctgagggcatcattccggcccttttcgaaccagagagggagaaatcagcagcgatagatggggaataccgcctaaagggagagagtcgtaaaacctttgtggaactgatgagacggggtgacttgcccgtctggttagcccacaaggtggctagcgagggcatcaaatatacagataggaagtggtgcttcgacgggcagcgcaacaatcagattctggaagagaacatggatgtagagatctggactaaagaaggagagaagaagaaactccgacctagatggctggacgcccggacctactccgatccccttgcactgaaggaatttaaagagttcgctgccggcaggaagtctattgcactcgacttggtgacagaaatcggtcgcgttccatcgcatctggcccacagaaccaggaatgctctagataacctggtcatgctccatactagcgagcacgggggccgggcgtatcgtcacgccgtggaggaacttcctgagacaatggaaacgctgttattgctgggactcatgatactgcttaccggcggggcaatgctgtttctcatctcaggaaaaggtattggcaagacttccatcgggttgatttgtgtgatcgctagttctggaatgctgtggatggccgagatacccttacaatggattgccagcgcaatcgtcctagagttctttatgatggttctgctcattccagaacctgagaagcagcgcacaccgcaggacaatcaacttgcttacgtggtaatcggcatactgaccttggccgcgatcattgctgccaacgaaatgggtctgctcgagaccacaaaacgagatctggggatgtccaaggaacccggcgtggtctcaccaacttcttatcttgacgtggatctccatcctgcaagcgcctggacgctgtacgctgttgcaaccacagtgatcactcccatgttgagacacaccattgagaatagtacagccaacgtctccctggcggctatcgccaaccaggcagtagtgttaatgggactagacaaaggctggccaataagcaagatggacctgggggttcctctccttgccctgggatgctactctcaggtgaatcccttgaccctgactgctgccgtcctcctgcttattacgcattatgcaatcatcggcccgggtttacaggctaaagccacaagggaggcgcaaaagcggaccgccgcagggattatgaagaacccaactgtggatggaatcatgaccatagacctggatcctgtcatttacgactcaaaattcgaaaagcagctcggccaggtgatgttgctggttctatgtgctgtgcagctgctccttatgcgcacatcctgggccctgtgcgaggcattgactctggctaccggtcccatcacaacgctctgggaaggcagtccagggaaattttggaataccactattgccgtaagcatggccaacatcttcagaggatcgtatctggcgggcgctgggttagcattttctataatgaagtccgtgggaacaggcaaaaggggtaccgggagccaaggagagactcttggcgaaaagtggaagaaaaagctgaatcagctctcacggaaagatttcgacctatacaagaaaagtggtatcacagaggtcgatcgaaccgaggccaaggaaggcctgaaaagaggggagattacgcaccatgctgtttctcgcggatccgccaagttgcagtggtttgtggaaaggaacatggtcatccccgagggccgggtgattgacctggggtgtggacgtggcggttggagctattactgcgcagggctcaagaaagtaaccgaagtgagaggatatacaaagggcggccctgggcacgaggagccggttcccatgtcaacttacggatggaatatcgtgaaacttatgagtggtaaggatgtcttctacctgccacctgaaaaatgtgacaccttgctgtgcgatattggcgagagctccccctctcctacagtggaagagagcaggactatccgcgtcctcaagatggtggagccatggttaaagaacaatcagttctgtataaaagttctgaacccctatatgcctaccgtaattgaacaccttgagcggctgcaacgaaagcatgggggaatgctagtgagaaatccactctccaggaactcaacacacgaaatgtactggatctctaatggcaccggtaacatcgtcgccagtgtgaatatggtttcgcgcctgttgctgaaccggtttactatgacgcatagacgtcccacaattgagaaagacgtggatctcggggctggaaccaggcacgtcaacgcggaaccggagactcctaatatggacgtgataggcgagcggatcaagcgcattaaagaagagcacaacagcacctggcattatgacgatgaaaatccatacaagacatgggcctatcacggctcctacgaggtaaaggcaacggggtctgcttcaagcatgatcaacggagtggttaaacttctgaccaagccctgggacgtcgtgcctatggtgactcagatggccatgacagataccactccattcggtcagcaacgagtctttaaagaaaaggttgacacaagaacccccaggtccatgccgggcacacggcgcgtgatggggattactgcagagtggttatggagaaccctgggaaggaataaaaagcctcgattgtgcacgcgggaggaattcaccaagaaagtacgtacaaacgccgctatgggcgccgtgtttactgaggaaaatcagtgggatagtgcgaaggcagccgtcgaggacgaagatttctggaaactcgtggacagagagcgcgagctgcataagctaggtaaatgtgggtcttgcgtttataacatgatgggaaagagggaaaaaaagcttggcgagtttggcaaggctaaagggagccgggccatctggtacatgtggctgggagcaagatacctcgaattcgaggctctgggttttttgaatgaggatcactggttctcacgcgaaaactcctatagtggcgtggagggggaaggactgcataagctcggctacatacttagggacatcagcaaaattcccggtggggccatgtatgctgatgacaccgccggatgggacacacgaatcactgaggatgacctgcacaatgaagagaagattacccagcagatggatccagagcaccggcaattagcaaacgcgatctttaaactgacgtaccagaataaggtcgtgaaggtacagagacctacacccaccggcactgttatggacataatttctaggaaagatcagcgcggctccgggcaagtgggaacatatggtttgaacaccttcactaatatggaagcccagctcatccgtcagatggagggcgaaggggtcctgctaaaggctgaccttgagaacccacatctgcccgaaaaaaagatcacccagtggctcgagacaaaaggagtggagcggctgaagagaatggccatttcaggcgatgactgcgtggtcaagcctatagatgacaggtttgcaaacgctttgttagccctgaatgatatgggtaaagttcgcaaggacatcccacaatggcagccgagcaaagggtggcacgattggcagcaggtgcccttctgttcgcatcacttccacgaactcattatgaaggacggacgaaaacttgtagtgccttgccggccacaagacgagctgatcggcagagcaaggatttctcagggcgccgggtggagtctaaaggaaacggcgtgtctgggaaaggcttacgcccagatgtggtccctcatgtattttcatcgcagagatttgcggctggcaagcaacgccatctgctcagctgtccccgtgcactgggttcctacctccaggactacatggtctatacatgcccaccatcaatggatgaccactgaggacatgcttacagtgtggaatcgtgtctggatcgaagataacccatggatggaggacaaaacccccgtgacgacatgggagaatgtaccttacctgggtaagcgagaagatcagtggtgtggcagcctcattgggttaaccagtcgcgcaacttgggctcagaacatcccgaccgccattcagcaagttagatccctgatcggaaatgaggaattcttggactacatgccaagcatgaaacggtttaggaaggaggaggaatctgagggcgcgatttggtga

SEQ ID NO: 15332 - RNA, 9873 nt, synthetic construct
  misc_feature 1..9873: note = derived and/or modified CDS sequence (opt3) from DENV-3__JF937638__SS-prME
  source 1..9873: mol_type = other RNA
accagcctgtgcctccttatgatcctgcccgccgctttggcattccacttaacatccagagacggcgagcctaggatgattgtggggaagaacgaacggggaaaatctctgctatttaagactgcctcaggtataaatatgtgtacgctcatcgcgatggatctgggcgagatgtgcgacgataccgtcacatacaaatgtccacatattactgaagttgagccggaagacatcgattgctggtgtaaccttaccagtacatgggtgacctatgggacttgcaatcaggctggagagcaccgccgagacaagcgtagcgtagccctggcaccccatgtgggcatgggtttggatacaagaacccaaacgtggatgtccgccgagggggcttggaggcaggtcgaaaaagtggagacttgggcactccggcaccctggattcaccattctggccctgtttctcgctcattacatcggcacatctttaactcagaaggttgtgatattcatcctgcttatgttggtcaccccatcgatgacaatgcgctgtgtgggcgtagggaacagagactttgttgaaggactgtcaggtgccacctgggtggatgtcgtgctagagcacggcgggtgcgtgacgactatggcgaagaataaacccacactcgacattgagctgcagaagaccgaagcaactcaacttgccacactgaggaaattgtgtatcgagggaaagattaccaacatcacgaccgatagccggtgccctacacagggcgaagctactctcccagaggaacaggaccagaattatgtctgtaaacacacctacgttgatcgcggttgggggaacggatgcggcctgttcggcaaggggagtttagtgacatgcgccaagtttcaatgtctggagcccatagagggaaaagtagtgcagtatgaaaatctcaagtacactgtcattatcaccgtgcatacaggtgaccagcaccaggttggcaacgagacccaaggggtgactgcagaaattacgcctcaggcttccacaaccgaggccatccttccagaatatggaactctgggcttggagtgctctccgcgaaccggtctagacttcaatgagatgatcctgctcacaatgaaaaacaaggcgtggatggtccatagacagtggtttttcgatctgccccttccttggaccagcggggccactacagaaacgccaacctggaataggaaagagctgttggtgacttttaagaacgcacacgctaaaaagcaagaagtagttgtgctcggctcccaggagggagccatgcacacagctctgaccggcgccacagaaattcagaattcagggggaactagtatattcgcaggtcatttaaagtgtcggctgaaaatggacaagctagagctcaaaggcatgagctacgccatgtgcaccaacacgtttgtcctgaagaaagaggtgtctgaaacccagcacgggacaatccttattaaggtcgagtacaagggagaagatgtgccctgtaaaatccctttctccactgaggacggccaaggtaaggctcataacgggcgtttgataaccgcgaatccagttgtgacaaaaaaggaggaacccgtaaacattgaggcagaaccgcctttcggcgagtcaaatatcgtcatcggaattggcgataacgccctgaaaatcaattggtataagaaggggagcagtattggaaaaatgtttgaagctactgcccgcggtgcaagaaggatggccatactcggcgacaccgcttgggatttcgggtctgtgggaggcgttctgaactcccttggtaagatggtgcaccagatctttgggagcgcctacacggcactgttctcgggcgtctcttgggtgatgaaaattggaatcggcgtattgctcacatggatcgggctgaattccaagaacacctcaatgagttttagctgcattgcgataggaatcattactttatatctgggcgctgtggttcaggccgacatgggttgtgtcatcaattggaaagggaaggagctaaagtgcggatccggcattttcgtgacaaacgaggtgcatacctggactgaacagtacaaatttcaagcagattctcccaagcggctcgccaccgctatcgccggtgcatgggagaatggcgtctgtgggatacgaagcacaacgcgcatggaaaacctgctttggaaacagatcgctaatgagttgaactatattctgtgggaaaataacatcaagctcaccgttgtggtgggagacattatcggcgtactggagcaggggaaaagaactttaacaccacagcctatggagctgaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggcttaaattgcgggaagtgtacacccagctctgtgaccaccgcctgatgtcagctgcagttaaggatgagagagccgtgcacgctgacatgggatactggatcgagagtcagaaaaacggcagctggaagctagaaaaagcctccctgatagaggtaaagacttgcacctggcctaagtctcatacactctggtcgaatggtgtcctggaaagcgatatgatcattccaaaatcccttgcaggcccgatctcacagcacaaccataggcccgggtatcacactcaaaccgcgggaccttggcacttgggcaagctggagttagactttaattactgcgaggggacaacggtggtgattaccgaaaactgtggaactcgtggcccaagtctccggacaaccactgtctctggtaaactgatccatgagtggtgctgtcgaagctgcacacttccccctctgagatatatgggggaagatggatgttggtacggcatggagataaggccaatttccgaaaaggaggagaatatggttaaatcattggtgagcgccggttctggcaaggtagacaacttcaccatgggggtgctctgcctggctatcctatttgaagaggtcatgcgcggaaagttcggcaaaaagcacatgatcgccggggtgttctttacgttcgttctgctcctgtccggacagattacttggcgggatatggcacatacccttatcatgattggcagtaatgctagcgacagaatgggtatgggggtgacatatttggccctgatagcaacctttaaaatccagcccttcttagccctcggatttttcctgaggcgccttacttctcgagaaaacctgctactcggcgtcggcctggctatggcgacaaccttgcaactgccggaggatattgaacagatggccaatgggatcgcattaggactcatggctctgaagcttattacacagtttgagacttaccagctgtggaccgccttgatctccctcacgtgttcaaacacaatattcaccctgactgtggcctggcggaccgctacactaatcctggcaggtgttagtcttctccctgtgtgccgtagctcgtccatgagaaaaactgactggctgccaatggccgtcgcggctatgggcgtaccccctttgcccctgtttattttctctttaaaggataccctcaagaggcgcagctggccactgaatgagggggtgatggccgttggacttgtgtcaatcctggcaagttccttgctccggaacgacgtccctatggccggccccctggtggctggtgggctactgattgcatgttatgtaatcacgggaacatctgccgatcttaccgtggaaaaagcggctgacataacttgggaggaagaggccgaacaaacaggcgtcagccacaacctcatgattaccgttgacgatgacggcactatgagaatcaaggatgacgagacagagaatatcctgaccgtgttgttaaaaacggcactgctcattgtgtccgggatatttccatactcaatcccggccactctgcttgtctggcatacctggcagaagcagacacagaggagcggagtgctgtgggatgttcctagtcccccagaaacccaaaaagctgagttggaagagggtgtataccgaattaagcagcagggcatcttcgggaaaacacaggtgggagtcggcgtgcaaaaggagggtgtttttcacactatgtggcacgtgacccgcggggccgtcctaacgtataacggaaagcggctggaacccaattgggcatctgtgaaaaaggacctcatttcctacggcggcgggtggagactgagcgctcagtggcagaaaggagaggaagtacaagtcatcgccgtggagcctggtaagaacccaaaaaatttccagacaatgcccggcactttccagaccacaaccggggaaataggagcgatcgcccttgattttaagcctggcacttcgggttcaccgattatcaacagggaggggaaggttgtgggattatatggcaatggcgtcgtgaccaaaaacgggggatacgtttctggtattgcacagacaaatgctgagccagacggccccacgcctgaactggaggaagagatgttcaagaaacgtaacctcactatcatggatttgcatccagggagtggaaagacccgcaaatatctgcccgccatagtgcgggaagctattaagagaaggctccgaacactgatccttgcacctacccgggtcgtggccgccgagatggaggaagctctgaagggcttgccgatccgctaccaaactacagcgaccaaatccgagcacacgggtagagaaattgtagacctaatgtgccatgcaacttttacaatgaggctgctcagccccgtgcgggttccaaattataacttaatcataatggatgaggcccacttcaccgaccctgcttctattgccgcacgagggtacatcagcaccagagtcggaatgggcgaagccgctgcgatttttatgactgccacacccccaggcaccgcagatgctttccctcagtccaatgcccccatccaggacgaggagcgcgacataccagaaaggtcatggaacagtgggaatgagtggattacagattttgcaggaaagactgtgtggttcgtgccgagcatcaaagccggtaacgacatcgctaactgtctgcgtaagaatggcaaaaaggtcattcagctttctcggaagacgtttgataccgaataccaaaaaacaaagctgaacgactgggatttcgtagtgactaccgacatctccgagatgggggccaattttaaagcggatagagttattgaccctaggcgctgcctcaagcccgtgatattgacagatggaccagagcgagtcatcctggcaggccccatgcctgtgaccgccgcttcagccgctcagagacggggtagggttgggcgcaacccacagaaagaaaatgaccagtatattttcactggccaacccctcaacaatgatgaggaccatgcacactggacggaagccaagatgctgcttgacaacatcaatacccctgagggaatcattccggctctattcgaaccagagcgtgagaagagtgccgcaatagatggcgaatacagactgaaaggggagagccggaagacatttgtggaattgatgaggcgcggagacttacccgtctggctggcgcacaaagtggcctccgagggtatcaagtatactgatcgaaaatggtgcttcgacggccagagaaacaatcagattctcgaagagaacatggatgtagagatctggaccaaggaaggggagaaaaagaagctgcggcctaggtggcttgacgctcgcacatactctgatcccctggccctcaaagaatttaaggagttcgcagctggaagaaaatcgattgccttggacctggtgaccgaaatcggcagggttccaagccatctagcacaccggactcgtaatgccctggataacctcgtcatgcttcatacatcagagcacggtgggcgcgcttatcgacacgcggtggaggaactgcctgagacgatggaaaccttattgctgctcggcctgatgatacttctgactggaggcgccatgctctttttgatctccgggaagggaattggtaaaacaagtatcggcctgatttgtgtgatcgcatctagcgggatgttatggatggctgagatacccctacagtggattgcctccgccatcgtcctggagttctttatgatggttctccttattccagaacctgagaagcaaagaaccccgcaggacaatcagctggcatacgtggtaatcggaatattgaccctggctgccatcattgcggctaacgaaatgggcctcctggagacaactaagagggatcttggtatgtcaaaagaacccggggtggtctctccaacgagctatctcgacgtggatctgcatcctgccagtgcatggaccttgtacgccgttgctacaactgtgatcacccccatgctgcggcacacaattgagaattccaccgcaaacgtcagcttagccgcgatcgctaaccaagccgtagtgctaatgggcctggacaagggatggccaatatctaaaatggacctcggcgttcctcttctggcattggggtgctactcacaggtgaatcccctgactctcacggccgctgtcctgcttttaattacacattatgccatcatcggaccgggcctgcaggcaaaggctacccgcgaggcccagaaaagaactgcggccggtattatgaagaacccaaccgtggatgggatcatgacaatagacctcgatcctgtcatttacgactccaagttcgaaaaacaattgggacaggtgatgctgctagttctgtgtgcagtgcagctccttctgatgaggactagttgggctttgtgcgaggccctgaccctcgcaacaggccccatcacgaccctgtgggaaggtagcccaggcaagttttggaatactacaattgctgtatcgatggccaacatcttccgggggtcttatttagccggagcgggccttgctttttccataatgaaaagcgtggggaccggaaagcgaggcactggttcacagggggagacactgggagaaaaatggaagagaaagctcaatcaactaagtcgcaaagatttcgacctgtacaagaaatctggcatcaccgaggtcgataggacggaggcaaaggaaggtttgaaacggggcgagattacccaccatgccgtttcccgtgggagcgctaagctgcagtggtttgtggaaagaaacatggtcacacccgagggaagggtgatcgacctcggctgtgggcgcggaggctggtcatattactgcgccggtcttaaaaaggtaactgaagtgcgggggtataccaagggaggccctggccacgaggagccggttcccatgagtacatacgggtggaatattgtgaaactgatgagcggaaaggatgtcttctacttgccacctgaaaaatgtgacactctgctctgcgatatcggtgagtcctctcccagccctaccgtggaagagtcccgaacaattagagtcttaaagatggtggagccatggctgaaaaacaatcagttctgtatcaaggttcttaacccctatatgcctaccgtaatagaacacctggagaggctacagcgcaagcatggcgggatgctcgtgcggaatccactgtcaagaaactctactcacgaaatgtactggattagtaatggaacgggcaacatcgtcgcatcggtgaatatggttagccgtttgctgctcaacaggtttacaatgacccatcggcgccccactatcgagaaagacgtggatcttggtgccgggacccgacacgtcaacgctgaaccggagacacctaatatggacgtgattggagagagaataaagaggatcaaagaagagcacaacctgacgtggcattatgacgatgaaaatccatacaagacctgggcgtatcacggctcctacgaggtaaaagccactggctctgcatcaagcatgattaacggggtggttaagttactgacaaagccctgggacgtcgtgcctatggtgacccaaatggctatgactgatacaaccccattcggacagcagcgggtctttaaagaaaaggttgacacacgcactcccagatccatgccgggtaccaggcgagtgatgggcatcacggccgagtggttgtggcggaccctcgggcgtaataaaaagcctagactgtgcacacgcgaggaattcactaaaaaggtaaggaccaacgcagccatgggagctgtgtttacagaggaaaatcaatgggatagtgccaaggcggcagtcgaggacgaagatttctggaaactagtggaccgggagagagagcttcataagctgggcaaatgtggttcttgcgtttataacatgatggggaagcgcgaaaaaaagctcggagagtttggcaaagccaagggcagcagggctatttggtacatgtggctgggggcccgatacttggaattcgaggcactgggatttctcaatgaggatcactggttctcacgggaaaactcctatagtggtgtggagggcgaagggcttcataagctgggatacatcttaagagacataagcaaaatccccggcggtgctatgtatgccgatgacactgctgggtgggacaccaggattacggaggatgacctgcacaatgaagagaagatcacacagcagatggatccagagcaccgccagttggccaacgcaatttttaaactcacctaccaaaataaggtcgtgaaagtacagcgtcctactcccacaggaaccgttatggacatcatatctcggaaggatcagagaggctccggccaggtggggacttatggactgaacaccttcacaaatatggaagcgcaaattatcaggcagatggagggtgaaggcgtcctatcaaaggccgaccttgagaacccacatctgcccgaaaaaaagatcacgcagtggctcgagaccaaaggggtggagcgcctgaagcgaatggctattagcggagatgactgcgtggtcaaacctatagatgaccggtttgccaacgcattgttagctctgaatgatatgggcaaggttagaaaggacatcccacagtggcaaccgtcgaaaggttggcacgattggcagcaggtgcccttctgttctcatcacttccacgaactcattatgaaggacgggaggaaacttgtagtgccttgccgcccacaggacgagctgatcggaagagcccggattagtcaaggcgcaggctggtccctaaaggaaactgcctgtctggggaaagcgtacgctcagatgtggagcctcatgtattttcataggcgtgatttgcgactggcctcaaacgcaatctgctccgccgtccccgtgcactgggttcctacatctcgcaccacttggagcatacatgctcaccatcagtggatgacaaccgaggacatgcttacggtgtggaatagagtctggatcgaagataacccatggatggaggacaagacacccgtgaccacttgggagaatgtaccttacctgggaaagcgggaagatcaatggtgtggtagtctcattggcttaacctccagggccacatgggcacagaacatcccgactgctattcagcaggttcgcagcctgatcgggaatgaggaattcttggactacatgccatctatgaaaagatttcggaaggaggaggaatcagagggagccatttggtga

SEQ ID NO: 15333 - RNA, 9873 nt, synthetic construct
  misc_feature 1..9873: note = derived and/or modified CDS sequence (opt3) from DENV-3__JF937639__SS-prME
  source 1..9873: mol_type = other RNA
accagcctgtgcctcatgatgatccttcccgcagctctggcattccacttgacttccagagacggcgaacctaggatgattgtggggaagaacgaacggggaaaatctttactgtttaagactgcctcaggtataaatatgtgtacgctcatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgctccctgtaaaatccctttctccactgaggacggccaaggtaaggcgcataacgggcgtcttataaccgcaaatccagtggttactaagaaggaggaacccgtgaacattgaggccgaaccgcctttcggcgagtcaaatatcgtaatcggaattggcgataacgctttgaaaatcaattggtataagaaggggagcagtattggaaaaatgtttgaagccactgcacgcggtgccagaaggatggctatactgggcgacaccgcctgggatttcgggtctgtcggaggcgtgctcaactccctgggtaagatggttcaccagatctttgggagcgcatacacggcgcttttctcgggcgtgtcttgggtcatgaaaattggaatcggcgtgctgttgacatggatcgggctcaattcccggaacacctcaatgagttttagctgcattgctataggaatcattactctgtatttaggcgccgtagtgcaggcagacatgggttgtgttatcaattggaaggggaaagagctgaagtgcggatccggcattttcgtcacaaacgaggtgcatacctggactgaacagtacaagtttcaagccgattctcccaaacgactagctaccgccatcgccggtgcttgggagaatggcgtgtgtgggatacgcagcacaacgagaatggaaaacctcctgtggaagcagatcgccaatgagcttaactatattttgtgggaaaataacatcaaactgaccgtcgttgtgggagacattatcggcgtgctcgagcaggggaagaggactctgacaccacagcctatggagttaaaatactcatggaagacctggggaaaagcgaagatagtaacagccgaaactcaaaacagttccttcattatcgatggccccaataccccagagtgccccagcgtctctcgggcttggaacgtgtgggaagttgaggactatggttttggggtgttcacgacaaatatttggctgaaacttcgcgaagcatacacccagttgtgtgaccacagactcatgtcagccgctgtcaaagatgagagggccgtgcacgcagacatgggatactggatcgagagtcagaagaacggcagctggaaactggaaaaggcgtccctaatagaggttaaaacttgcacctggcctaagtctcatacaatctggtcgaatggtgtgctggaaagcgatatgattatcccaaagtccctcgccggcccgatttcacagcacaaccatcgtcccgggtatcacactcaaaccgctggaccttggcacctgggcaaacttgagttggactttaattactgcgaggggacaacggtagtcatcaccgaaaactgtggaactcggggcccaagtctgcgaacaaccactgtgtctggtaagttaatacatgagtggtgctgtagaagctgcacactaccccctctgaggtatatgggggaagatggatgttggtacggcatggagattcgcccaatctccgaaaaagaggagaatatggtgaagtcacttgtcagcgccggttctggcaaagttgacaacttcaccatgggggtgctgtgcttggcaatcctctttgaagaggtaatgcggggaaagttcggcaagaaacacatgattgctggggtgttcctgacgtttgtcctactgctctccggacagatcacttggagagatatggcccataccctgattatgataggcagtaatgcaagcgacaggatgggtatgggggtgacatatcttgccttgatcgctaccttcaagattcagccctttctggcgttaggattctttctccgcaaactgacttctcgagaaaaccttctgctaggcgttggcctcgccatggcaacaaccctgcaattgccggaggatatcgaacagatggctaatgggattgccctgggattaatggccctcaagctgatcacacagttcgagacttaccagctttggaccgctctgatatccttgacgtgttcaaacacaatctttaccctcactgtggcatggcggaccgccacactgattctagcgggtgtcagtctgcttcctgtgtgccaaagctcgtccatgcgtaaaactgactggctcccaatggctgttgccgcaatgggcgtgccccctctgcccttgttcatcttttctctgaaggataccttaaagagaaggagctggccactcaatgagggggtcatggccgtaggactggtgtcaattcttgctagttccctgttgcgcaacgacgttcctatggcaggccccctcgtggccggtgggctgctaatcgcgtgttatgtcataacgggaacatctgctgatctgaccgtggaaaaagccgcagacattacttgggaggaagaggccgaacagacaggcgtaagccacaaccttatgatcaccgtggacgatgacggcactatgcggatcaaggatgacgagacagagaatattctcaccgtcctgttgaaaacggctttactgatagtttccgggatcttcccatactcaattccggccactctcctggtgtggcatacctggcagaagcagacaaaaagaagcggagtgctttgggatgtccctagtcccccagaaacccaaaaggcagagctggaagagggtgtgtacaggatcaaacagcagggcatttttgggaagacacaggttggagtaggcgtgcaaaaggagggtgtcttccacactatgtggcacgtgacccgaggggctgttttgacgtataacggaaaacgcctagaacccaattgggcctctgtgaagaaagacctgatctcctacggcggcgggtggcggctcagcgcgcagtggcagaagggagaggaagtccaagtgatagccgtagagcctggtaaaaacccaaagaattttcagacaatgcccggcactttccagaccacaaccggggaaatcggagcaattgctctggatttcaagcctggcacttcgggttcaccgatcattaacagagaggggaaagtcgtgggactttatggcaatggcgttgtgaccaagaacgggggatacgtctctggtatcgcccagacaaatgctgagccagacggccccacgcctgaattagaggaagagatgtttaaaaagaggaacctgactataatggatctccatccagggagtggaaaaacccgtaagtatttgcccgcaattgtgcgcgaagccatcaagcggagactgaggacactcatcctggcccctacccgagttgtggctgcggagatggaggaagcacttaaaggcctgccgattcggtaccaaactacagccaccaagtccgagcacacgggtcgcgaaatcgtcgacttgatgtgccatgctactttcacaatgagactactgagccccgtgagggtaccaaattataacctcataattatggatgaggcccactttaccgaccctgcatctatcgccgctcgggggtacattagcacccgagtgggaatgggcgaagcggccgcaatcttcatgactgctacacccccaggcaccgccgatgcatttcctcagtccaatgcccccatacaggacgaggagagagacattccagaacgctcatggaacagtgggaatgagtggatcacagatttcgctggaaaaactgtttggtttgtcccgagcatcaaggccggtaacgacattgcgaactgtttaaggaaaaatggcaagaaggtgatccagctgtctcgtaaaacgttcgataccgaataccaaaagacaaaacttaacgactgggattttgtggtcactaccgacatttccgagatgggggcaaatttcaaggccgatcgggtaatagaccctagaaggtgcctgaaacccgtgatcctcacagatggaccagagcgcgttattttggctggccccatgcctgtgaccgccgcttcagcagcccagcgaagaggtcgggtcgggaggaacccacagaaggaaaatgaccagtatatctttactggccaacccctgaacaatgatgaggaccatgctcactggacggaagccaagatgctcctggacaacatcaatacccctgagggaattataccggcacttttcgaaccagagcgcgagaaaagtgcggccatcgatggcgaataccgtctaaagggggagagcagaaaaacattcgtggaactgatgcggaggggagacttgcccgtttggttagctcacaaggtggcctccgagggtattaaatatactgatcgcaagtggtgctttgacggccagcgaaacaatcagatcctggaagagaacatggatgtcgagatttggaccaaagaaggggagaagaagaaactcagacctcggtggctggacgcaaggacatactctgatccccttgctctgaaggagttcaaagagtttgccgcaggacgcaagtcgatcgccctcgacttggtgaccgaaataggcagagtaccaagccatctggctcacaggactcggaatgcgctagataacctggtgatgctccatacatcagagcacggtgggcgtgcctatcgccacgcagttgaggaacttcctgagacgatggaaaccctgttattgctgggcctcatgatcctgcttactggaggcgctatgctgttcctcatttccgggaaaggaatcggtaagacaagtattggcttgatctgtgtcatagcctctagcgggatgctgtggatggccgagattcccttacagtggatcgcatccgctattgtgctagagtttttcatgatggtgctgctcatcccagaacctgagaagcaacgaaccccgcaggacaatcagcttgcctacgtcgttataggaatcctgaccttggcggctattatcgccgcaaacgaaatgggcctgctcgagacaactaaaagagatctgggtatgtcaaaggaacccggggtggtatctccaacgagctatcttgacgtggatctccatcctgccagtgcttggaccctgtacgcagtcgccacaactgtgattacccccatgttgaggcacacaatcgaaaattccaccgcgaacgttagcctggctgccatagcaaaccaagccgtggtcttaatgggcctagacaaaggatggccaatttctaagatggacctgggcgtacctctccttgctctggggtgctactcacaggtgaatcccttgactctgacggccgcagttctcctgcttatcacacattatgctatcattggaccgggcttacaggccaaagcgacccgggaggcccagaagcgcactgcagctggtatcatgaagaacccaaccgtggatgggataatgacaattgacctggatcctgtcatctacgactccaaatttgaaaagcaactcggacaggtgatgttgctggtcctatgtgccgtgcagctgctccttatgagaacaagttgggcactgtgcgaggctttgaccctggccacaggccccattacgaccctctgggaaggtagcccaggcaaattctggaatactacaatcgccgtttcgatggcgaacatatttagggggtcttatctggctggagcaggcttagccttctccatcatgaaaagcgtggggaccggaaaacggggcactggttcacagggggagacacttggagaaaagtggaagaaaaagctgaatcaactcagtcgaaaagattttgacctatacaagaaatctggcattaccgaggtagatagaacggaggctaaggaaggtctgaaacgcggcgagatcacccaccatgccgtgtccagggggagcgcaaagttgcagtggttcgtcgaacggaacatggttattcccgagggacgtgtgatcgacctgggctgtgggagaggaggctggtcatattactgcgccggtctcaagaaagtcacagaagtgagggggtatactaagggaggccctggccacgaggagccggtacccatgagtacctacgggtggaatattgtgaaacttatgagcggaaaggatgtgttttacctgccacctgaaaaatgtgacacattgctgtgcgatatcggtgagtcctctcccagccctactgttgaagagtcccgcaccatacgggtcctcaagatggtggagccatggttaaagaacaatcagttctgtattaaagtcctgaacccctatatgcctacagtgatcgaacaccttgagcgactgcagagaaagcatggcgggatgctagttaggaatccactctcacgcaactctacccacgaaatgtactggatcagtaatggaactggcaacattgtagcttcggtgaatatggtcagccggctgttgctgaacagattcacgatgacacatcgtaggcccaccatagagaaagacgtggatctcggtgcggggactcggcacgttaacgccgaaccggagacccctaatatggacgtgatcggagagcgcattaagcgaatcaaagaagaacacaactccacatggcattatgacgatgaaaatccatacaagacgtgggcatatcacggctcttacgaggtcaaggctaccggctcagccagctccatgattaacggggtggtaaaacttctgactaagccctgggacgtggttcctatggtcacacaaatggcaatgaccgatactacaccatttggacagcagagagtgttcaaagaaaaggtggacaccaggacaccccggagtatgccgggtactcgcagagtcatgggcatcaccgccgagtggttatggaggacgctggggcgaaataaaaagcctcggttgtgcacccgtgaggaatttacaaagaaagttagaactaacgctgccatgggagcggtgttcaccgaggaaaatcaatgggattctgcaaaggccgctgtagaggacgaagatttttggaaactcgtggaccgcgagagggagctgcataagctaggcaaatgtggtagctgcgtctataacatgatggggaagcgggagaagaaacttggagagttcggcaaggccaaaggctcaagagcaatatggtacatgtggctgggggctcgctacctcgaatttgaggccctgggattcttgaatgaggatcactggttttccagggaaaacagttatagcggtgtggagggcgaagggctgcataagctcggatacatccttcgagacatttctaaaatccccggcggtgctatgtatgccgatgacacagcagggtgggacactcggattaccgaggatgacctgcacaatgaagagaagatcacgcagcagatggatccagagcacagacagttagcgaacgccatattcaaactgacataccaaaataaggttgtgaaggtccagaggcctacccccactggaacagtgatggacattatctcccgcaaagatcagcgtggctcaggccaggtagggacctatggattgaacacttttaccaatatggaagctcaactcatccggcagatggagggtgaaggcgttctgagcaaggccgacctagagaacccacatcttcccgagaagaagattacacagtggctggagacgaaaggggtggagagactcaagaggatggcaatatcgggagatgactgcgtcgtgaagcctatcgatgaccgcttcgctaacgccctgttggcattaaatgatatgggcaaagtgcgaaaggacattccacagtggcaaccgtctaaaggttggcacgattggcagcaggtccccttttgtagtcatcacttccacgaactgatcatgaaggacgggcggaaactcgttgtgccttgcagaccacaggacgagcttattggaagggcccgcatctcccaaggcgcgggctggagcctgaaggaaaccgcttgtctagggaaggcctacgcacagatgtggtcactgatgtatttccatagacgggatctcaggttggcctccaacgctatatgctctgccgtacccgtgcactgggtccctactagccgtacaacctggagtatccatgcacaccatcagtggatgactacagaggacatgctgaccgtgtggaatcgagtttggattgaagataacccatggatggaggacaaaacgcccgtgacaacctgggagaatgtcccttaccttggaaagcgcgaagatcaatggtgtggttccctgatcggcctcactagcagagctacctgggcccagaacattccgacagcgatccaacaggtgcggtctttaattgggaatgaggaatttctggactacatgccatcaatgaaaaggttccgcaaggaggaggaaagtgagggagctatatggtga

SEQ ID NO: 15334 - RNA, 9873 nt, synthetic construct
  misc_feature 1..9873: note = derived and/or modified CDS sequence (opt3) from DENV-3__JF937627__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcagaattcagggggaactagtatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgacaaaacgcgaggaacccgtaaacattgaggcagaaccgcctttcggcgagtcaaatatcgtcatcggaattggcgataacgccttgaagatcaattggtacaaaaaggggagcagtattggaaagatgtttgaagctactgccagaggtgcaaggcggatggccatactgggcgacaccgcttgggatttcgggtctgtgggaggcgttctcaactccctgggtaaaatggtgcatcagatctttgggagcgcctatacggcacttttctcgggcgtctcttgggtgatgaagattggaatcggcgtactgttgacatggatcgggctcaattccaaaaacacctcaatgagttttagctgcattgcgataggaatcattactctgtacttaggcgctgtggttcaggccgacatgggttgtgtcatcaattggaaggggaaagagctgaagtgcggatccggcattttcgtgacaaacgaggtgcacacctggactgaacagtataagtttcaagcagattctcccaaacgactagccaccgctatcgccggtgcatgggagaatggcgtctgtgggatacgcagcacaacgagaatggaaaacctcctgtggaagcagatcgctaatgagcttaactacattttgtgggaaaataacatcaaactgaccgttgtggtgggagacattatcggcgtactcgagcaggggaagaggactctgacaccacagcctatggagttaaaatattcatggaagacctggggaaaagccaagatagtcacagcggaaactcaaaacagttccttcattatcgatggccccaataccccagagtgccccagcgtgtctcgggcctggaacgtttgggaagtggaggactacggttttggggtcttcacgacaaatatttggctgaagcttcgcgaagtgtatacccagttgtgtgaccacagactcatgtcagctgcagttaaagatgagagggccgtgcatgctgacatgggatactggatcgagagtcagaagaacggcagctggaaactggaaaaggcctccctaatagaggtaaaaacttgcacctggcctaagtctcacacactgtggtcgaatggtgtcctcgaaagcgatatgatcattccaaagtccctggcaggcccgatctcacagcataaccaccgtcccgggtaccacactcaaaccgcgggaccttggcatcttggcaaattggagctggactttaattattgcgaggggacaacggtggtgattaccgaaaactgtggaactcggggcccaagtttacgaacaaccactgtctctggtaagctcatccacgagtggtgctgtagaagctgcacactgccccctcttaggtacatgggggaagatggatgttggtatggcatggagatacgcccaatttccgaaaaagaggagaatatggttaagtcactggtgagcgccggttctggcaaagtagacaacttcaccatgggggtgttgtgcctcgctatcctgtttgaagaggtcatgcggggaaagttcggcaagaaacatatgatcgccggggtgttctttacgttcgttctactgctctccggacagattacttggagagatatggcacacaccctgatcatgattggcagtaatgctagcgacaggatgggtatgggggtgacataccttgccttgatagcaacctttaagatccagcccttcctggccttaggatttttcctccgcaaactgacttctcgagaaaaccttctgctaggcgtcggcctcgctatggcgacaaccctgcaattgccggaggatattgaacagatggccaatgggatcgcactgggattaatggctctcaagctgattacacagtttgagatctatcagctttggactgccctgatatccttgacctgttcaaacacgatcttcacactcaccgtggcctggcggactgctaccctgattctagcaggtgttagtctgcttcctatgtgccaaagctcgtccatgcgtaaaacagactggctcccaatggccgtggcggctatgggcgtcccccctctgcccttgtttatcttctctctgaaggatactttaaagagaaggagctggccactcaatgagggggtaatggccgtgggactggtttcaattcttgcaagttccctgttgcgcaacgacgtgcctatggccggccccctcgtcgctggtgggctgctaatcgcatgttacgtgataaccggaacgtctgccgatctgacagtagaaaaagcggctgacattacctgggaggaagaggccgaacagactggcgtgagccataaccttatgatcacagtcgacgatgacggcaccatgcggatcaaggatgacgagactgagaatattctcacagttctgttgaaaaccgcattactgatagtgtccgggatctttccatattcaattccggccacgctcctggtgtggcacacttggcagaagcagacccaaagaagcggagtcctttgggatgtgcctagtcccccagaaacacagaaagctgagctggaagagggtgtttacaggatcaagcagcagggcattttcgggaaaacccaagtaggagtgggcgtccagaaggagggtgtgtttcacacaatgtggcatgttactcgaggggccgtgttgacctacaacggaaagcgcctagaacccaattgggcatctgtcaaaaaggacctgatctcctatggcggcgggtggcggctcagcgctcagtggcaaaaaggagaggaagtgcaggtaatagccgtcgagcctggtaagaacccaaaaaatttccagacgatgcccggcacattccagactaccacaggggaaatcggagcgattgccctggattttaagcctggcacctcgggttcaccgatcattaacagagaggggaaggtggttggactttacggcaatggcgtggtcactaaaaacgggggatatgtgtctggtatcgcacaaaccaatgctgagccagacggccccacacctgaattagaggaagagatgttcaagaaaaggaacctgacgataatggatctccacccagggagtggaaagactcgtaaatacttgcccgccattgttcgcgaagctatcaagcggagactgaggaccctcatcctggcacctacacgagtggtcgccgccgagatggaggaagctcttaagggcctgccgattcggtatcagaccactgcgacaaaatccgagcataccggtcgcgaaatcgtggacttgatgtgccacgcaacgtttactatgagactactgagccccgtaagggtgccaaattacaacctcataattatggatgaggcccatttcacagaccctgcttctatcgccgcacgggggtatattagcacccgagttggaatgggcgaagccgctgcgatctttatgaccgccactcccccaggcacagcagatgctttccctcagtccaatgcccccatacaggacgaggagagagacattccagaacgctcatggaacagtgggaatgagtggatcaccgattttgcaggaaagacagtctggttcgtgccgagcatcaaagccggtaacgacattgctaactgtttaaggaagaatggcaaaaaggtgatccaactgtctcgtaagacttttgatacggaataccagaaaaccaagcttaacgactgggatttcgtcgtaacaactgacatttccgagatgggggccaattttaaagcggatcgggtgatagaccctagaaggtgcctgaagcccgttatcctcaccgatggaccagagcgcgtgattttggcaggccccatgcctgtcacagccgcttcagccgctcagcgaagaggtcgggtggggaggaacccacagaaagaaaatgaccaatacatcttcaccggccagcccctgaacaatgatgaggaccacgcacactggactgaagccaagatgctcctggacaacatcaatacgcctgagggaattataccggctcttttcgaaccagagcgcgagaagagtgccgcaatcgatggcgaatatcgtctaaaaggggagagcagaaagacctttgttgaactgatgcggaggggagacttgcccgtgtggttagcgcataaagtcgcctccgagggtattaagtacacagatcgcaaatggtgcttcgacggccagcgaaacaatcagatcctggaagagaacatggatgtggagatttggactaaggaaggggagaaaaagaagctcagacctcggtggctggacgctaggacctattctgatccccttgccctgaaagaatttaaggagttcgcagctggacgcaaatcgatcgccctcgacttggtaacagaaataggcagagtgccaagccacctggcacataggacccggaatgccctagataacctggttatgctccacacttcagagcacggtgggcgtgcttaccgccatgcggtcgaggaacttcctgagacaatggaaacgctgttattgctgggcctcatgatcctgcttaccggaggcgccatgctgtttctcatttccgggaagggaatcggtaaaactagtattggcttgatctgtgtgatagcatctagcgggatgctgtggatggctgagattcccttacaatggatcgcctccgccattgtgctagagttctttatgatggtcctgctcatcccagaacctgagaagcagcgaacaccgcaggacaatcaacttgcatatgttgtgataggaatcctgaccttggctgccattatcgcggctaacgaaatgggcctgctcgagaccacaaagagagatctgggtatgtcaaaagaacccggggtagtgtctccaactagctaccttgacgtcgatctccaccctgccagtgcatggacgctgtatgccgtggctaccacagttattactcccatgttgaggcataccatcgagaattccacagcaaacgtgagcctggccgcgatagctaaccaggccgtcgtattaatgggcctagacaagggatggccaatttctaaaatggacctgggcgtgcctctccttgcactggggtgctactcacaggttaatcccttgaccctgactgccgctgtgctcctgcttatcacgcactacgccatcattggaccgggcttacaggcaaaggctacacgggaggcccaaaaacgcaccgcggccggtatcatgaagaacccaactgtcgatgggataatgaccattgacctggatcctgtgatctatgactccaagttcgaaaaacagctcggacaggtcatgttgctggtgctatgtgttgtgcagctgctccttatgagaacaagttgggcactgtgcgaggctttgactctggccaccggccccattacaacgctctgggaaggtagcccaggcaagttttggaataccactatcgcagtatcgatggctaacatattcagggggtcttacctggccggagccggcttagcgttttccatcatgaaaagcgtggggacaggaaagcggggcaccggttcacaaggggagactcttggagaaaaatggaagaagaaactgaatcagctcagtcgaaaggatttcgacctatataaaaagtctggcattacagaggtcgatagaaccgaggctaaagaaggtctgaagcgcggcgagatcacgcatcacgcagtttccagggggagcgccaaattgcagtggtttgtggaacggaacatggtcattcccgagggacgtgtgatcgacctgggctgtgggagaggaggctggtcatactattgcgctggtctcaagaaggtaaccgaagtgagggggtacacaaaaggaggccctggccacgaggagccggttcccatgagtacttatgggtggaatattgtgaagcttatgagcggaaaagatgtcttctacctgccacctgaaaagtgtgacaccttgctgtgcgatatcggtgagtcctctcccagccctacagtggaagagtcccgcactatacgggtcctcaaaatggtggagccatggttaaagaacaatcagttctgtattaaggttctgaacccctacatgcctaccgtaatcgaacatcttgagcgactgcaaagaaaacacggcgggatgctagtgaggaatccactctcacgcaactctacacatgaaatgtattggatcagtaatggaaccggcaacattgtcgcctcggtgaatatggttagccggctgttgctgaacagatttactatgacgcaccgtaggcccacaatagagaaggacgtggatctcggtgcagggacccggcacgtcaacgccgaaccggagactcctaatatggacatcattggagagcgcatcaaacgaattaaggaagagcataactccacctggcactacgacgatgaaaatccatataaaacatgggcttaccatggctcttatgaggtgaaggcgacgggctcagccagctccatgatcaacggggtagtgaagcttctgaccaaaccctgggacgttgtccctatggtgactcagatggcaatgacagataccactccattcggacagcaaagagtgtttaaggaaaaagtcgacacaaggaccccccggagtatgccgggtacacgcagagttatgggcataactgctgagtggttatggaggaccctggggcgaaataagaaacctcggttgtgcacgcgtgaggaattcaccaagaaggtgagaacaaacgccgcaatgggagccgtatttactgaggaaaatcagtgggattctgctaaagccgcggtggaggacgaagatttctggaagctcgtcaacaaagagcgcgagctgcacaagctaggcaaatgtggtagctgcgtgtacaatatgatggggaagagggaaaaaaagcttggagagtttggcaaggcaaaaggctcacgggccatctggtatatgtggctgggggctagatacctcgaattcgaggccctgggatttttgaacgaggaccattggttctcccgcgaaaatagttacagcggtgttgagggcgaagggctgcacaagctcggatatattcttagggatatctctaaaattcccggcggtgcaatgtacgctgacgataccgccgggtgggacacacgaatcactgaggacgatctgcacaacgaagagaagataacccagcagatggacccagagcatcggcaattagctaatgccatttttaaactgacgtatcagaacaaggtggtcaaggtgcagagacctacacccaccggaactgtaatggatatcatctccaggaaagaccagcgcggctcaggccaagttgggacatacggattgaataccttcactaacatggaagcacagctcattcgtcagatggagggtgaaggcgtgctgagcaaggcggatctagagaacccacaccttcccgaaaaaaagataacccagtggctggagacaaaaggggtcgagcggctcaagagaatggccatctcgggagacgattgcgtggtgaagcctattgacgataggtttgctaatgccctgttggcattaaacgacatgggcaaagtccgcaaggatatcccacaatggcagccgtctaaaggttggcatgactggcagcaggttcccttctgtagtcaccacttccatgaactgattatgaaggatgggcgaaaactcgtggtaccttgccggccacaagacgagcttatcggaagagctaggatatcccagggcgccggctggagcctgaaggaaacggcatgtctagggaaggcctatgcgcagatgtggtcactgatgtactttcaccgcagagacctccggttggcttccaatgccatctgctctgcagtgcccgtccattgggtgcctaccagcaggactacatggagtattcacgcccatcaccaatggatgaccactgaggatatgctgacagtttggaaccgtgtgtggatcgaagacaatccatggatggaggataaaacccccgtcacgacatgggagaacgtgccttatcttggaaagcgagaagaccagtggtgtggttccctgattggcctcaccagccgcgctacttgggcccagaatatcccgaccgcaattcagcaagtaagatctttaatagggaacgaggaattcctggattacatgccatcaatgaaacggtttaggaaggaggaggaaagtgagggagctatctggtga

SEQ ID NO: 15335 - RNA, 9873 nt, synthetic construct
  misc_feature 1..9873: note = derived and/or modified CDS sequence (opt3) from DENV-3__KF973476__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatataggggaagatggatgttggtacggcatggagattaggccaatctccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgattgccggggtgttctttacgttcgttctactgctctccggacagatcacttggcgggatatggcacataccctgattatgataggcagtaatgctagcgacagaatgggtatgggggtgacatatcttgccttgatcgcaacctttaaaattcagcccttcctggccttaggatttttcctcaggcgcctgacttctcgagaaaaccttctgctaggcgtcggcctcgctatggcgacaaccctgcaattgccggaggatatcgaacagatggccaatgggattgcactgggattaatggctctcaagctgatcacacagtttgagacttaccagctttggaccgccctgatatccttgacgtgttcaaacacaatcttcaccctcactgtggcctggcggaccgctacactgattctagcaggtgttagtctgcttcctgtgtgccaaagctcgtccatgcgtaaaactgactggctcccaatggccgtcgcggctatgggcgtaccccctctgcccttgtttatcttctctctgaaggataccttaaagagaaggagctggccactcaatgagggggtgatggccgttggactggtgtcaattcttgcaagttccctgttgcgcaacgacgtccctatggccggccccctcgtggctggtgggctgctaatcgcatgttatgtaataacgggaacatctgccgatctgaccgtggaaaaagcggctgacattacttgggaggaagaggccgaacagacaggcgtcagccacaaccttatgatcaccgttgacgatgacggcactatgcggatcaaggatgacgagacagagaatattctcaccgtgctgttgaaaacggcattactgatagtgtccgggatctttccatactcaattccggccactctcctggtctggcatacctggcagaagcagacacaaagaagcggagtgctttgggatgttcctagtcccccagaaacccagaaagctgagctggaagagggtgtatacaggatcaagcagcagggcattttcgggaaaacacaagtgggagtcggcgtgcagaaggagggtgtttttcacactatgtggcacgtgacccgaggggccgtcttgacgtataacggaaagcgcctagaacccaattgggcatctgtgaaaaaggacctgatctcctacggcggcgggtggcggctcagcgctcagtggcaaaaaggagaggaagtacaggtcatagccgtggagcctggtaagaacccaaaaaatttccagacaatgcccggcactttccagaccacaaccggggaaatcggagcgattgccctggattttaagcctggcacttcgggttcaccgatcattaacagagggggaaaggttgtgggcctttatggcaatggggtcgtgaccaaaaacggaggttacgtttctggcatcgcacaaacaaatgctgagccagacgggcccacgcctgagttagaagaggaaatgttcaagaaaaggaacctgactataatggatctccatccaggaagtggcaagacccgtaaatatttgcccgccattgtgcgcgaggctatcacacggagactgaggaccctcatcctggcacctactcgagtcgtggccgccgaaatggaggaggctcttaagggtctgccgattcggtaccagacaaccgcgacgaagtccgaacacactgggcgcgagatcgtagacttgatgtgccatgcaacatttaccatgagactactgagccccgtgagggttccaaattataacctcataattatggatgaagcccacttcaccgaccctgcttctatcgccgcacggggatacattagcactcgagtcggcatgggcgaggccgctgcgatctttatgacagccacccccccagggacagcagatgctttccctcagtccaatgcccccatacaggacgaagagagagacattccagagcgctcatggaacagtggaaatgaatggatcactgattttgcaggtaaaacggtgtggttcgtgccgagcatcaaggccggcaacgacattgctaactgtttaaggaaaaatgggaagaaagtcatccaactgtctcgtaagacctttgatacagagtaccagaagactaaacttaacgactgggatttcgtagtgaccacagacatttccgaaatgggagccaattttaaggcggatcgggttatagaccctagaaggtgcctgaaacccgtgatcctcaccgatggcccagagcgcgtcattttggcaggtcccatgcctgtgactgccgcttcagccgctcagcgaagagggcgggttggcaggaacccacagaaggagaatgaccaatatatcttcacgggacagcccctgaacaatgatgaagaccatgcacactggaccgaggccaaaatgctcctggacaacatcaatacacctgaaggcattataccggctcttttcgagccagaacgcgagaagagtgccgcagtggatggggagtaccgtctaaagggagaaagcagaaaaacttttgtcgagctgatgcggaggggtgacttgcccgtgtggttagcgcacaaggtagcctccgaaggcatcaaatataccgatcgcaagtggtgcttcgacgggcagcgaaacaatcagattctggaggaaaacatggatgtggagatctggacaaaagagggagaaaagaaaaagctcagacctcggtggctggacgctaggacctactctgatccccttgccctgaaggagtttaaagaattcgcagctggccgcaagtcgattgccctcgacttggttactgagatcggtagagtcccaagccatctggcacacaggacacggaatgccctagataacctggtgatgctccatacgtcagaacacgggggccgtgcttatcgccacgcggtggaggagcttcctgaaaccatggagactctgttattgctgggactcatgatactgcttacaggcggggccatgctgtttctcatctccggaaaaggtattggcaagaccagtatcgggttgatttgtgtcatcgcatctagcggaatgctgtggatggctgaaatacccttacaatggattgcctccgccatcgttctagagttctttatgatggtgctgctcattccagagcctgaaaaacagcgaaccccgcaggacaatcaacttgcatacgtagtgatcggcatactgacattggctgccatcattgcggctaacgagatgggtctgctcgaaactacgaagagagatctggggatgtcaaaggagcccggcgtcgtgtctccaaccagctatcttgacgttgatctccatcctgccagtgcatggacactgtacgccgtggctactaccgtcatcacacccatgttgaggcacaccattgaaaattccactgcaaacgtaagcctggccgcgatcgctaaccaggccgtggttttaatgggactagacaaaggctggccaatatctaagatggacctgggggtgcctctccttgcactgggatgctactcacaggtcaatcccttgacgctgacagccgctgtgctcctgcttattacccattatgccatcatcggcccgggtttacaggcaaaagctactcgggaggcccaaaagcgcaccgcggccgggattatgaaaaacccaacagtcgatggaatcatgactatagacctggatcctgtgatttacgactccaagttcgagaagcagctcggccaggttatgttgctggtgctatgtgcagtacagctgctccttatgagaaccagttgggctctgtgcgaagccttgacactggcaacgggtcccatcaccactctctgggagggcagcccagggaaattttggaatacaaccattgctgtgtcgatggccaacatcttcaggggatcttatctggccggcgcggggttagctttttccataatgaagagcgtcggaactggcaaacggggtacagggtcacaaggagaaacccttggcgagaagtggaaacgaaagctgaatcagctcagtagaaaggatttcgacctatacaaaaagtctggtatcacggaagttgatcgcaccgaggcaaaagagggcctgaagaggggggaaattacacaccatgccgtgtcccggggaagcgctaaattgcagtggtttgtcgagcgtaacatggtgatccccgaaggcagagtaattgacctggggtgtggaaggggcggttggtcatattactgcgccgggctcaagaaagtgactgaggttcgcggatataccaagggcggccctgggcacgaagagccggtgcccatgagtacatacggatggaatatcgtcaagcttatgagcggtaaagatgtgttctacctgccacctgagaagtgtgacactttgctgtgcgatattggcgaatcctctcccagccctaccgtcgaggaatcccggacaatccgagtgctcaaaatggttgagccatggttaaagaacaatcagttctgtataaaagtactgaacccctatatgcctaccgtgattgagcaccttgaaagactgcaaaggaagcatgggggaatgctagtccgcaatccactctcacggaactctactcacgagatgtactggatcagtaatggcacgggtaacatcgtggcatcggttaatatggtgagcagactgttgctgaaccgttttacaatgacccataggcggcccactattgaaaaggacgtcgatctcggggccggaacccgccacgtgaacgctgagccggaaacacctaatatggacgtaataggcgagcgaatcaaaagaattaaggaggaacacaactccacgtggcattatgacgatgagaatccatacaaaacctgggcgtatcacggctcttacgaagtgaaggccactgggtcagcaagctccatgatcaacggagttgtcaaacttctgacaaagccctgggacgtggtgcctatggtcacccagatggctatgactgatacaaccccattcggtcagcaaagggtttttaaggagaaagtggacacacggactccccgcagtatgccgggcaccagaagggtaatggggattacggccgaatggttatggcgaaccctgggacggaataagaaacctcgtttgtgcacaagagaggagttcactaagaaagtgcgcaccaacgcagccatgggcgctgtctttacagaagagaatcagtgggattctgccaaggcggcagtggaagacgaggatttctggaagctcgttgacagggaacgggagctgcataaactaggtaagtgtgggagctgcgtgtataacatgatgggaaaaagagagaagaaacttggcgaatttggcaaggccaaagggtcacgcgctatctggtacatgtggctgggagccaggtacctcgagttcgaagcactgggttttttgaatgaggatcactggttctcccgagagaacagttatagcggcgtcgaaggggagggactgcataagctcggctacatacttcgggacatctctaagattcccggtggggctatgtatgccgatgacactgctggatgggacaccagaatcacggaagatgacctgcacaatgaggaaaaaattacacagcagatggatccagagcacaggcaattagccaacgcaatctttaagctgacctaccagaataaagtggtaaaggttcagcgccctactcccacaggcaccgtgatggacataatttcccgtaaagatcagcggggctcagggcaagtcggaacttatggtttgaacaccttcacaaatatggaggcgcagctcatcagacagatggaaggcgagggggtgctgagcaaggccgacctagaaaacccataccttcccgagaagaaaatcacgcagtggctggaaaccaagggagtggagaggctcaaacgcatggctatttcgggcgatgactgcgtcgttaagcctatagatgaccgatttgccaacgcactgttggctttaaatgatatgggtaaagtgcggaaggacatcccacaatggcagccgtctaaggggtggcatgattggcagcaggtacccttctgtagtcaccatttccacgagctgattatgaaagacggaagaaagctcgtggtcccttgcaggccacaagacgaacttatcggccgcgccagaatttcccagggcgcagggtggagcctgaaagagactgcctgtctaggaaaggcgtatgctcagatgtggtcactgatgtactttcaccggagggatctccgtttggcctccaacgcaatctgctctgccgtgcccgttcattgggtgcctacaagccgaaccacttggagtatacacgctcatcaccaatggatgacaaccgaagacatgctgacggtctggaatcgcgtgtggatcgaggataacccatggatggaagacaaaacacccgtaaccacttgggagaatgttccttaccttggtaagagagaggatcagtggtgtggctccctgattgggctcaccagccgggccacatgggcacagaacatcccgactgctattcagcaagtgaggtctttaatcggaaatgaagagttcctggactatatgccatcaatgaagcgctttagaaaagaagaggagagtgaaggcgccatttggtga

SEQ ID NO: 15336 - RNA, 9873 nt, synthetic construct
  misc_feature 1..9873: note = derived and/or modified CDS sequence (opt3) from DENV-3__KF973478__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagcatgaaaatctgaagtatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgcgaaccggtttggacttcaatgagatgatcctactgacaatgaaaaacaaggcgtggatggtccacagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcatacagctctcaccggcgccacagaaattcagaattcagggggaactagtatattcgcaggtcacctgaagtgtcggttaaaaatggacaagctggagctaaaaggcatgagctatgccatgtgcaccaacacgtttgtcctcaagaaagaggtgtctgaaacccagcatgggacaatcctgattaaggtcgagtacaagggagaagatgtgccctgtaaaatccctttctccactgaggacggccaaggtaaggctcacaacgggcgtcttataaccgcgaatccagttgtgacaaaaaaggaggaacccgtaaacattgaggcagaaccgcctttcggcgagtcaaatatcgtcatcggaattggcgataacgccttgaaaatcaattggtacaagaaggggagcagtattggaaaaatgtttgaagctactgcccgcggtgcaagaaggatggccatactgggcgacaccgcttgggatttcgggtctgtgggaggcgttctcaactccctgggtaagatggtgcatcagatctttgggagcgcctatacggcacttttctcgggcgtctcttgggtgatgaaaattggaatcggcgtactgttgacatggatcgggctcaattccaagaacacctcaatgagttttagctgcattgcgataggaatcattactctgtacttaggcgctgtggttcaggccgacatgggttgtgtcatcaattggaaagggaaggagctgaagtgcggatccggcattttcgtgacaaacgaggtgcacacctggactgaacagtataaatttcaagcagattctcccaagcggctagccaccgctatcgccggtgcatgggagaatggcgtctgtgggatacgaagcacaacgcgcatggaaaacctcctgtggaaacagatcgctaatgagcttaactacattttgtgggaaaataacatcaagctgaccgttgtggtgggagacattatcggcgtactcgagcaggggaaaagaactctgacatcacagccaatggagttaaagtatagttggaaaacctggggaaaggccaagatagtcacagcggaaactcaaaactccagcttcattatcgatggccctaatacccccgagtgcccatctgtgtcaagggcctggaacgtttgggaagtggaggactacggttttggggtcttcacgacaaatatttggctgaaacttcgggaagtgtatacccagttgtgtgaccaccgcctcatgagtgctgcagttaaggatgagagagccgtgcatgctgacatgggatactggatcgagagccagaaaaacggctcctggaagctggaaaaagcctctctaatagaggtaaagacttgcacctggcccaagtcgcacacactgtggagcaatggtgtcctcgaatccgatatgatcattcctaaatcactggcaggcccaatcagtcagcataaccacaggccggggtaccacactcaaaccgcgggaccctggcatcttggcaagttggagctggactttaattattgcgaggggacaacggtggtgattaccgaaaactgtggaactcgtggcccttctttacggacaaccactgtcagcggtaaactcatccacgagtggtgctgtcgatcctgcacactgccaccccttagatacatgggggaagatggatgttggtatggcatggagataaggcctatttcagaaaaggaggagaatatggttaaaagcctggtgtctgccggttccggcaaggtagacaacttcaccatgggggtgttgtgcctcgctatcctgtttgaagaggtcatgcgcggaaagttcggcaaaaagcatatgatcgccggggtgttctttacgttcgttctactgctcagtggacagattacttggcgggatatggcacacaccctgatcatgattggcagcaatgcttctgacagaatgggtatgggggtgacataccttgccttgatagcaacctttaaaatccagccattcctggccttaggatttttcctcaggaagctgacttcccgcgaaaaccttctgctaggcgtcggcctcgctatggcgacaaccctgcaattgcccgaggatattgaacagatggccaatgggatcgcactgggattaatggctctcaaactgattacacagtttgagacttatcagctttggaccgccctgatctcattgacgtgtagtaacacaatattcaccctcactgtggcctggcgaaccgctacactgatcctagcaggtgttagcctgcttccggtgtgccaatcgtcctctatgcggaagactgactggctccctatggccgtcgcggctatgggcgtaccacccctgcctttgtttattttcgggctgaaggataccttaaaacgtagaagctggcccctcaatgagggagtgatggccgttggcctggtgtcaatccttgcaagttccctgttgaggaacgacgtcccaatggccggtcctctcgtggctgggggactgctaattgcatgttacgtaatcacgggcacatctgccgatctgaccgtggaaaaggcggctgacataacttgggaggaagaggccgaacagacaggcgtcagccataaccttatgattaccgttgacgatgacgggactatgcgcatcaaagatgacgagacagagaatatcctcaccgtgctgttgaagacggcattactgattgtgtccggaatatttccctattcaatcccagccactctcctggtctggcacacctggcagaaacagacacaacggagcggtgtgctttgggatgttccgagtcctcccgaaacccagaaggctgagctggaagagggcgtatacagaattaaacagcaggggatcttcggaaagacacaagtgggcgtcggtgtgcagaaggagggggtttttcacactatgtggcatgtgaccaggggagccgtcttgacgtacaacggcaaacgactagaaccaaattgggcatctgtgaagaaagacctgatttcctatggcgggggatggcgcctcagcgctcagtggcaaaagggtgaggaagtacaggtcatcgccgtggagcccggcaaaaaccctaagaatttccagacaatgccagggactttccagaccacaaccggagaaataggcgcgatcgccctggattttaagcccggtacttcggggtcacctattatcaaccgggagggaaaagttgtgggcctttacggcaatggggtcgtgaccaagaacggaggttatgtttctggcattgcacaaacaaatgctgagccggacgggccaacgcccgaattagaggaagagatgttcaaaaagagaaacctgactatcatggatctccaccctggaagtggcaaaaccaggaagtacttgccagccatagtgcgtgaagctattaagcgccggctgagaacactcatcctggcacccaccagggtcgtggccgccgagatggaggaagctcttaaaggtctgcctatccgatatcagactacagcgaccaagtccgagcatacggggcgggaaattgtagacttgatgtgccacgcaacttttacaatgcgcctactgagcccggtgagagttcccaattacaacctcatcataatggatgaggcccatttcaccgacccagcttctattgccgcaaggggatatatcagcacccgggtcggcatgggcgaagccgctgcgatttttatgactgccacacctcccgggaccgcagatgctttcccacagtccaatgcccctatccaggacgaggagcgagacatacccgaaagatcatggaacagtggaaatgagtggattacagattttgcaggtaaaactgtgtggttcgtgccaagcatcaaggccggcaacgacatcgctaactgtttacgcaaaaatgggaagaaggtcattcaactgtctaggaaaacgtttgataccgaataccagaagacaaaacttaacgactgggatttcgtagtgactaccgacatctccgagatgggagccaattttaaggcggatcgtgttattgacccgcggagatgcctgaaacctgtgatactcacagatggccccgagagggtcatcttggcaggtccaatgcccgtgaccgccgcttcagccgctcagcgccgagggagagttggccggaaccctcagaaggaaaatgaccaatacattttcactggacagccactgaacaatgatgaggaccacgcacactggacggaagccaagatgctcctggacaacatcaatacccccgagggcatcattcctgctcttttcgaaccggagagggagaaaagtgccgcaatagatggggaatatcgcctaaagggagagagccgtaaaacatttgtggaactgatgagacggggtgacttgccagtctggttagcgcataaggtggcctccgagggcatcaaatacactgataggaagtggtgcttcgacgggcagcgcaacaatcagattctggaagagaacatggatgtagagatctggaccaaagaaggagagaagaagaaactccgacccagatggctggacgctcggacatattctgatcctcttgccctgaaggaatttaaagagttcgcagctggcaggaagtcgattgccctcgacttggtgaccgaaatcggtcgcgttcccagccacctggcacatagaactaggaatgccctagataacctggtcatgctccacacatcagagcacgggggccgggcttaccgtcatgcggtggaggaacttccagagacgatggaaaccctgttattgctgggactcatgatactgcttactggcggggccatgctgtttctcatctccggaaaaggtattggcaagacaagtatcgggttgatttgtgtgatcgcatctagcggaatgctgtggatggctgagatacctttacaatggattgcctccgccatcgtcctagagttctttatgatggttctgctcattcccgaaccagagaagcagcgcacccctcaggacaatcaacttgcatatgtggtaatcggcatactgaccttggctgccatcattgcggctaacgaaatgggtctgctcgagacaactaaacgagatctggggatgtcaaaggaaccgggcgtggtctctcccacgagctaccttgacgtggatctccacccagccagtgcatggaccctgtatgccgttgctacaactgtgatcacccctatgttgagacatacaattgagaattccaccgcaaacgtcagcctggccgcgatcgctaaccaggccgtagtgttaatgggactagacaaaggctggcccatatctaagatggacctgggggttccactccttgcactgggatgctactcacaggtgaatcctttgactctgacggccgctgtcctcctgcttattacacactacgccatcatcggccccggtttacaggcaaaagctaccagggaggcccaaaagcggactgcggccgggattatgaagaacccgaccgtggatggaatcatgacaatagacctggatccagtcatttatgactccaaattcgaaaagcagctcggccaggtgatgttgctggttctatgtgcagtgcagctgctccttatgcgcactagttgggctctgtgcgaggccttgaccctggcaacaggtcctatcacgaccctctgggaaggcagccccgggaaattttggaatactacaattgctgtatcgatggccaacatcttcagaggatcttacctggccggcgcggggttagctttttccataatgaagagcgtgggaaccggcaaaaggggtactgggtcacaaggagagacacttggcgaaaagtggaagaaaaagctgaatcagctcagtcggaaagatttcgacctatataagaaatctggtatcaccgaggtcgatcgaacggaggcaaaggaaggcctgaaaagaggggagattacccatcacgccgtttcccgcggaagcgctaagttgcagtggtttgtggaaaggaacatggtcatcccagagggccgggtgattgacctggggtgtggacgtggcggttggtcatactattgcgccgggctcaagaaagtaacagaagtgagaggatacactaagggcggccccgggcacgaggagcctgttccgatgagtacctatggatggaatatcgtgaaacttatgagcggtaaggatgtcttctacctgcccccagaaaaatgtgacacattgctgtgcgatattggcgagtcctctcctagccccactgtggaagagtccaggaccatccgcgtcctcaagatggtggagccttggttaaagaacaatcagttctgtataaaagttctgaacccatacatgcccacagtaattgaacatcttgagcggctgcaacgaaagcacgggggaatgctagtgagaaatcctctctcaaggaactctacccatgaaatgtattggatcagtaatggcactggtaacatcgtcgcatcggtgaatatggttagccgcctgttgctgaaccggtttacgatgacacacagacgtccaaccattgagaaagacgtggatctcggggccggaactaggcacgtcaacgctgaacccgagaccccgaatatggacgtgataggcgagcggatcaagcgcattaaagaagagcataactccacatggcactacgacgatgaaaatccttataagacgtgggcgtaccatggctcttatgaggtaaaggccaccgggtcagcaagctccatgatcaacggagtggttaaacttctgactaagccatgggacgtcgtgcccatggtgacacagatggctatgaccgatactacacctttcggtcagcaacgagtctttaaagaaaaggttgacaccagaacaccaaggagtatgcccggcactcggcgcgtgatggggattaccgccgagtggttatggagaacgctgggaaggaataaaaagccgcgattgtgcacccgggaggaattcacaaagaaagtacgtactaacgcagccatgggcgctgtgtttaccgaggaaaatcagtgggattctgccaaggcggcagtcgaggacgaagatttctggaaactcgtggacagagagcgcgagctgcacaagctaggtaaatgtgggagctgcgtttacaacatgatgggaaagagggaaaaaaagcttggcgagtttggcaaggccaaagggtcacgggctatctggtatatgtggctgggagccagatacctcgaattcgaggcactgggttttttgaatgaggatcattggttctcccgcgaaaacagttacagcggcgtggagggggaaggactgcacaggctcggctatatacttcgagacatctctaagattcctggtggggctatgtacgccgatgacacagctggatgggacactcggatcaccgaggatgacctgcacaatgaagagaaaattacgcagcagatggatcccgagcatagacaattagccaacgcaatctttaagctgacatatcagaataaagtcgtgaaggtacagaggccaacccctactggcacagttatggacataatttcccgcaaggatcagcgtggctcagggcaagtgggaacctacggtttgaacactttcaccaatatggaagcgcagctcatccggcagatggagggcgaaggggtcctgagcaaagccgacctagagaacccccaccttccagaaaagaaaatcacacagtggctggagacgaagggagtggagagactcaaaaggatggctatttcgggcgatgactgcgtggtcaagcccatagatgaccgctttgccaacgcactgttggctttaaatgatatgggtaaggttcgaaaagacatccctcaatggcagccatctaaggggtggcatgattggcagcaggtgccgttctgtagtcaccacttccatgaactgattatgaaagacggacggaagctcgtagtgccctgcagacctcaagacgagcttatcggcagggcccgcatttcccagggcgcagggtggagcctgaaagaaaccgcctgtctaggaaaggcgtatgctcagatgtggtcactgatgtactttcacagacgggatctcaggttggcctccaacgcaatctgctctgccgtcccagtgcattgggttcccactagccgtacaacctggagtatacacgctcatcaccaatggatgactacagaggacatgctgaccgtgtggaatcgagtctggatcgaagataacccttggatggaggacaagacgccagtgacaacctgggagaatgtaccctatcttggtaaacgcgaagatcagtggtgtggctccctgattgggctcactagcagagccacctgggcacagaacatccctacagctattcagcaagttcggtctttaatcggaaatgaggaattcctggactacatgccgtcaatgaagaggtttcgcaaagaggaggaaagtgagggcgccatttggtga

SEQ ID NO: 15337 - RNA, 9873 nt, synthetic construct
  misc_feature 1..9873: note = derived and/or modified CDS sequence (opt3) from DENV-3__KF973479__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaatctggggggaacttcaatattcgcaggtcatttaaagtgtcggctgaaaatggacaagctagagctcaaaggcatgagttacgccatgtgcaccaacacgtttgtcctgaagaaagaggtgagcgaaacccagcacgggacaatccttattaaggtcgagtacaagggagaagatgctccctgtaaaatccctttctctactgaggacggccaaggtaaggcgcataacgggcgtttgataaccgcaaatccagtggttacaaaaaaggaggaacccgtgaacattgaggccgaaccgcctttcggcgagtccaatatcgtaatcggaattggcgataacgctctgaaaatcaattggtataagaaggggtcaagcattggaaaaatgtttgaagccactgcacgcggtgccagaaggatggctatactcggcgacaccgcctgggatttcgggagtgtcggaggcgtgctgaactctcttggtaagatggttcaccagatctttgggtccgcatacacggcgctgttcagcggcgtgtcgtgggtcatgaaaattggaatcggcgtgttgctcacatggatcgggctgaattctaagaacacctccatgtcatttagttgcattgctataggaatcattactttatatctgggcgccgtagtgcaggcagacatgggttgtgttatcaattggaaagggaaggagctaaagtgcggaagcggcattttcgtcacaaacgaggtgcatacctggactgaacagtacaaatttcaagccgattcccccaagcggctcgctaccgccatcgcaggtgcttgggagaatggcgtgtgtgggatacgatctacaacgcgcatggaaaacctgctttggaaacagatcgccaatgagttgaactatattctgtgggaaaataacatcaagctcaccgtcgttgtgggagacattatcggcgtgctggagcaggggaaaagaactttaacaccacagcctatggagctgaagtacagctggaaaacctggggaaaggcgaagatagtaacagccgaaactcaaaactcaagtttcattatcgatggccccaataccccagagtgcccctccgtcagcagggcttggaacgtgtgggaagttgaggactatggttttggggtgttcacgacaaatatttggcttaaattgcgggaagtctacacccagctctgtgaccaccgcctgatgtctgcagccgtgaaggatgagagagctgttcacgccgacatgggatactggatcgagtcacagaaaaacggcagttggaagctagaaaaagcaagcctgatagaggtgaagacttgcacctggcctaagtcccatacactctggtctaatggtgtactggaatcggatatgatcattccaaaaagccttgcgggcccgatctcccagcacaaccataggcccgggtatcacactcaaaccgccggaccttggcacttgggcaagctggagttagactttaattactgcgaggggacaacggtcgtgattaccgaaaactgtggaactcgtggcccatcactccggacaaccactgtgagtggtaaactgatccatgagtggtgctgtcgatcttgcacacttccccctctgagatatatgggggaagatggatgttggtacggcatggagataaggccaattagcgaaaaggaggagaatatggtcaaatccttggtttcagctggtagcggcaaggtggacaacttcaccatgggggtactctgcctggccatcctatttgaagaggtgatgcgcggaaagttcggcaaaaagcacatgatcgcaggggtcttctttacgttcgtgctgctcctgtctggacagattacttggcgggatatggctcatacccttatcatgattggctccagtgccagcgacagaatgggtatgggggttacatatttggcactgatagccacctttaaaatccagcccttcttagctctcggatttttcctgaggaagcttacttctcgcgaaaatctgctactcggcgtgggcctggcgatggccacaaccttgcaactgccggaggatattgaacagatggcaaacgggatcgctttaggactcatggccctgaaacttattacacagtttgagacttaccagctgtggaccgccttgatctccctcacgtgttcaaatacaatattcaccctgactgtcgcttggcgaaccgcaacactaatcctggccggtgtgagtcttctccctgtttgccaaagctcgtccatgcggaagactgactggctgccaatggcggtggctgccatgggcgtcccccctttgcccctgtttattttcgggttaaaggataccctcaaacgtagatcttggccactgaacgagggagtaatggcagtgggccttgttagcatcctggcctcaagtttgctcaggaatgacgtgcctatggctggtcccctggtcgcagggggactactgattgcctgttatgtgatcacgggcacatccgcggatcttaccgtagaaaaggctgccgacataacttgggaggaagaggcagaacagacaggcgtgtctcacaacctcatgattaccgtcgacgatgacgggactatgcgcatcaaagatgacgagacagagaacatcctgaccgttttgttaaagacggccctgctcattgtgagcggaatatttccatactccatcccggctactctgcttgtgtggcatacctggcagaaacagacacaacggtcaggtgtcctgtgggatgtgcctagccccccagaaacccagaaggccgagttggaagagggcgtttacagaattaaacagcaggggatcttcggaaagacacaagtaggcgtgggtgtccagaaggagggggtgtttcacactatgtggcacgttaccaggggagcagtgctaacgtataatggcaaacgactggaacccaactgggctagtgtcaagaaagacctcatttcttacggcgggggatggcgcctgtccgcccagtggcaaaagggtgaggaagtgcaggtaatcgcggtcgagcctggcaaaaatccaaagaacttccagacaatgcccgggactttccagaccacaaccggagaaataggcgccatcgcacttgattttaagcctggtactagcgggtcgccgattatcaatcgggagggaaaagtggttggcttatatggcaacggggtggtcaccaagaatggaggttacgtgtcaggcattgctcaaacaaacgccgagccagacgggcccacgcctgaactggaggaagagatgttcaaaaagagaaatctcactatcatggatttgcatccaggatctggcaaaaccaggaagtatctgcccgctatagttcgtgaagcaattaagcgccggctcagaacactgatccttgcccctaccagggtggtcgccgctgagatggaggaagcgctgaaaggtttgccgatccgataccagactacagcaaccaagagtgagcacacggggcgggaaattgtggacctaatgtgccatgccacttttacaatgcgcctgctctcccccgtaagagtgccaaactataatttaatcataatggatgaggctcacttcaccgaccctgccagcattgcagccaggggatacatctctacccgggttggcatgggcgaagctgcggccatttttatgactgcaacacccccagggaccgctgatgccttccctcagagcaacgcacccatccaggacgaggagcgagacataccagaaagatcctggaattcaggaaacgagtggattacagattttgccggtaaaactgtctggttcgtgccgagtatcaaggctggcaatgacatcgccaactgtctgcgcaaaaacgggaagaaggtgattcaacttagcaggaaaacgtttgataccgaataccagaagacaaaactgaatgactgggatttcgtcgtaactaccgacatctctgagatgggagcgaactttaaggcagatcgtgtgattgaccctcggagatgcctcaaacccgttatattgacagatggcccagagagggtgatcctggccggtcccatgcctgtcaccgctgcctccgctgcacagcgccgagggagagtgggccggaatccacagaaggaaaacgaccaatatattttcactggacagcccctcaataacgatgaggaccatgcccactggacggaagctaagatgctgcttgacaatatcaacacccctgagggcatcattccggccctattcgaaccagagagggagaaatcagcagcgatagatggggaataccgcctgaagggagagagtcgtaaaacatttgttgaattgatgagacggggtgacttacccgtgtggctggcccacaaggtcgctagcgagggcatcaaatatactgataggaagtggtgcttcgacgggcagcgcaataaccagattctcgaagagaatatggatgtggagatctggaccaaagaaggagagaagaagaaactgcgacctagatggcttgacgcccggacatactccgatcccctggcactcaaggaatttaaagagttcgctgccggcaggaagtctattgcattggacctggtaaccgaaatcggtcgcgtgccatcgcatctagcccacagaactaggaacgctctggataatctcgttatgcttcatacaagcgagcacgggggccgggcgtatcgtcacgccgtcgaggaactgcctgagacgatggaaaccttattgctgctcggactgatgatacttctgactggcggggcaatgctctttttgatctcaggaaaaggtattggcaagacatccatcgggctgatttgtgtgatcgctagttctggaatgttatggatggccgagatacccctacaatggattgccagcgcaatcgtgctggagttctttatgatggtcctccttattccagaacctgagaagcagcgcaccccgcaggacaaccaactggcttacgttgtgatcggcatattgaccctggccgcgatcattgctgccaatgaaatgggtctcctggagacaactaaacgagatcttgggatgtccaaggaacccggcgtagtgtcaccaacgtcttatctcgacgtcgatctgcatcctgcaagcgcctggaccttgtacgctgtggcaacaactgttatcacccccatgctgagacacacaattgagaacagtaccgccaatgtgtccttagcggctatcgccaaccaggcagtcgtactaatgggactggacaaaggctggccaataagcaagatggacctcggggtgcctcttctggccttgggatgctactctcaggttaaccccctgactctcacggctgccgtgctgcttttaattacacattatgcaatcatcggcccgggtctgcaggctaaagccaccagggaggcgcaaaagcggactgccgcagggattatgaagaatccaaccgtcgatggaatcatgacaatagacctcgatcctgtgatttacgactcaaaattcgaaaagcagttgggccaggtcatgctgctagtgctgtgtgctgttcagctccttctgatgcgcacttcctgggccttgtgcgaggcactgaccctcgctacaggtcccatcacgaccctgtgggaaggcagtccagggaaattttggaacactacaattgccgtgagcatggccaatatcttcagaggatcgtatttagcgggcgctgggcttgcattttctataatgaagtccgtaggaaccggcaaaaggggtactgggagccaaggagagacactgggcgaaaagtggaagaaaaagctcaaccagctatcacggaaagatttcgacctgtacaagaaaagtggtatcaccgaggtggatcgaacggaggccaaggaaggcttgaaaagaggggagattacccaccatgctgtctctcgcggatccgccaagctgcagtggtttgttgaaaggaatatggtgatccccgagggccgggtcattgacctcgggtgtggacgtggcggttggagctattactgcgcagggcttaagaaagtgacagaagtaagaggatatactaagggcggccctgggcacgaggagccggtgcccatgtcaacctacggatggaacatcgttaaactgatgagtggtaaggatgtgttctacttgccacctgaaaaatgtgacacactgctctgcgatattggcgagagctccccctctcctactgtcgaagagagcaggaccatccgcgtgttaaagatggtcgagccatggctgaagaataaccagttctgtataaaagtgcttaatccctatatgcctacagttattgaacacctggagcggctacaacgaaagcatgggggaatgctcgtaagaaacccactgtccaggaattcaacccacgaaatgtactggatctctaacggcactggtaatatcgtggccagtgtcaacatggtgtcgcgcttgctgctcaatcggtttacgatgacacatagacgtcccaccattgagaaagacgttgatcttggggctggaactaggcacgtgaacgcggaaccggagacccctaacatggacgtcataggcgagcggatcaagcgcattaaagaagagcacaatagcacatggcattatgacgatgaaaacccatacaagacgtgggcctatcacggctcctacgaggtgaaggcaaccgggtctgcttcaagcatgatcaatggagtagtgaaactgttaactaagccctgggacgttgtccctatggtgacacagatggccatgaccgatactacaccattcggtcagcaacgagtgtttaaagaaaaggtcgacaccagaacacccaggtccatgccgggcactcggcgcgttatggggattaccgcagagtggctgtggagaacgttgggaaggaacaaaaagcctcgactctgcacccgggaggaattcacaaagaaagtgcgtactaatgccgctatgggcgccgtatttaccgaggaaaaccagtgggatagtgcgaaggcagccgtggaggacgaagatttctggaaactggtcgacagagagcgcgagctacataagcttggtaaatgtgggtcttgcgtgtataatatgatgggaaagagggaaaaaaagctgggcgagtttggcaaggctaaagggagccgggccatctggtacatgtggctcggagcaagatacctggaattcgaggctttgggttttctgaacgaggatcactggttctcacgcgaaaattcctatagtggcgttgagggggaaggactccataagcttggctacatactgagggacatcagcaaaattcccggtggggccatgtatgctgatgacacagccggatgggacactcgaatcaccgaggatgacttacacaacgaagagaagattacgcagcagatggatccagagcaccggcaactggcaaatgcgatctttaaattgacataccagaacaaggtggtcaaggtgcagagacctacccccactggcacagtaatggacataatttctaggaaagatcagcgcggctccgggcaagttggaacctatggtctcaatactttcaccaacatggaagcccagctgatccgtcagatggagggcgaaggggtgctatcaaaggctgaccttgagaatccacatctgcccgaaaaaaagatcacacagtggctcgagacgaaaggagtcgagcggctgaagagaatggccattagcggcgatgactgcgtggtgaagcctatagatgacaggtttgcaaacgctttgttagccctgaacgatatgggtaaagtccgcaaggacatcccacaatggcagccgtcgaaagggtggcacgattggcagcaggttcccttctgttctcatcacttccacgaactcattatgaaggacggacgaaaacttgtggtaccttgccggccacaagacgagctgatcggcagagcaaggattagtcagggcgccgggtggtccctaaaggaaaccgcgtgtctgggaaaggcttacgcccagatgtggagcctcatgtattttcatcgcagagatttgcggctggcatcaaatgccatctgctccgctgtgcccgtccactgggtgcctacttctaggacaacctggagcatacatgcccaccatcaatggatgactacagaggacatgcttaccgtttggaaccgtgtgtggatcgaagataatccatggatggaggacaaaacgcccgtcacaacctgggagaacgtgccttacctgggtaagcgagaagatcagtggtgtggcagtctcattgggttaacttcccgcgcaacctgggctcagaatatcccgacagccattcagcaagtaagaagcctgatcggaaacgaggaattcttggactacatgccatctatgaaacggtttaggaaggaggaggaatcagagggcgcgatttggtga

SEQ ID NO: 15338 - RNA, 9873 nt, synthetic construct
  misc_feature 1..9873: note = derived and/or modified CDS sequence (opt3) from DENV-3__KF973480__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcaccttactgatgcttgtcacaccatcgatgaccatgcgctgtgtgggcgtagggaacagagactttgttgaaggattgtcaggtgccacgtgggtggatgtcgtgctggagcacggcgggtgcgtgactacaatggcgaagaataaacccaccctagacatcgagctccagaagactgaagcaacacaactggccacccttaggaaactgtgtattgagggaaagatcacgaacattaccacagatagccggtgccctactcagggcgaagctaccttgccagaggaacaggaccagaattatgtctgtaaacacacatacgttgatcgcggttgggggaacggatgcggcctcttcggcaaggggagtctggtgacttgcgccaagtttcaatgtttagagcccatcgagggaaaagtagtgcagtatgaaaatctgaagtacaccgtcataattacagtgcataccggtgaccagcaccaggttggcaacgagactcaaggggtgacggcagaaatcacacctcaggcttccaccactgaggccattctcccagaatatggaacccttggcctggagtgctctccgcgaacaggtttggacttcaatgagatgatcctactgaccatgaaaaacaaggcgtggatggtccatagacagtggtttttcgatctccccctgccttggactagcggggccacaacggaaaccccaacttggaataggaaagagcttctggtgacatttaagaacgcacacgctaaaaagcaagaagtagttgtgttgggctcccaggagggagccatgcacaccgctctcacaggcgccactgaaatccagaattcagggggaaccagtattttcgcaggtcatctgaagtgtcggttaaaaatggacaagctggagctaaaaggcatgagctacgccatgtgcacgaacacctttgtcctcaagaaagaggtgtctgaaacacagcacgggactatactgatcaaggtcgagtacaagggagaagatgtgccctgtaaaattcctttctccaccgaggacggccaaggtaaggctcataacgggcgtcttatcacagcgaatccagttgtgactaaaaaggaggaacccgtaaacatagaggcagaaccgcctttcggcgagtcaaatattgtcatcggaatcggcgataacgccttgaaaattaattggtataagaaggggagcagtatcggaaaaatttttgaagctaccgcccgcggtgcaagaaggatggccatactgggcgacacggcttgggatttcgggtctgtgggaggcgttctcaactccctgggtaagatggtgcaccagatctttgggagcgcctacacagcacttttctcgggcgtctcttgggtgatgaaaattggaatcggcgtactgttgacctggatcgggctcaattccaagaacacttcaatgagttttagctgcattgcgataggaatcattacactgtatttaggcgctgtggttcaggccgacatgggttgtgtcatcaattggaaagggaaggagctgaagtgcggatccggcattttcgtgaccaacgaggtgcatacttggaccgaacagtacaaatttcaagcagattctcccaagcggctagccacagctatcgccggtgcatgggagaatggcgtctgtgggatacgaagcacgacccgcatggaaaacctcctgtggaaacagatcgctaatgagcttaactatattttgtgggaaaataacatcaagctgactgttgtggtgggagacattatcggcgtactcgagcaggggaaaagaacactgaccccacagcctatggagttaaagtactcatggaaaacatggggaaaggccaagatagtcactgcggaaacccaaaacagttccttcattatcgatggccccaatacgccagagtgccccagcgtgtctagggcctggaacgtttgggaagtggaggactatggttttggggtcttcacaaccaatatttggctgaaacttcgggaagtgtacactcagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacctgcacatggcctaagtctcatactctgtggtcgaatggtgtcctcgaaagcgatatgatcattccaaaatccctggcaggcccgatctcacagcacaaccataggcccgggtatcacacccaaacagcgggaccttggcaccttggcaagttggagctggactttaattactgcgaggggacgaccgtggtgattactgaaaactgtggaacacgtggcccaagtttacggaccactacagtctctggtaaactcatccatgagtggtgctgtcgaagctgcaccctgccccctcttagatatatgggggaagatggatgttggtacggcatggagataaggccaatttccgaaaaggaggagaatatggttaaatcactggtgagcgccggttctggcaaggtagacaacttcacgatgggggtgttgtgcctcgctatcctgtttgaagaggtcatgcgcggaaagttcggcaaaaagcacatgatcgccggggtgttctttactttcgcactactgctctccggacagattacctggcgggatatggctcatacactgatcatgattggcagtaatgccagcgacagaatgggtatgggggttacctatcttgcattgatagccacttttaaaatccagcccttcctggctttaggatttttcctcaggaagctgacatctcgcgaaaaccttctgctaggcgtgggcctcgcgatggccaccacactgcaattgccggaggatattgaacagatggcaaatgggatcgctctgggattaatggccctcaaactgattactcagtttgagacctaccagctttggacggccctgatctccttgacatgttcaaacaccatattcactctcaccgtcgcttggcgaacagcaactctgatcctagccggtgtgagtctgcttcctgtttgccaaagctcgtccatgcggaagaccgactggctcccaatggcggtggctgccatgggcgtcccccctctgcccttgtttattttcgggctgaaggatacgttaaaacgtagatcttggccactcaatgagggagtaatggcagtgggcctggttagcatccttgcctcaagtctgttgaggaacgacgtgcctatggctggtcccctcgtcgcagggggactgctaattgcctgttatgtgatcacaggcacctccgcggatctgactgtagaaaaggctgccgacataacatgggaggaagaggcagaacagaccggcgtgtctcacaaccttatgattactgtcgacgatgacgggacaatgcgcatcaaagatgacgagaccgagaatatcctcacggttctgttgaagactgccttactgattgtgagcggaatatttccatactccatcccggctaccctcctggtgtggcatacatggcagaaacagacccaacggtcaggtgtcctttgggatgtgcctagccccccagaaacacagaaggccgagctggaagagggcgtttacagaattaaacagcaggggatcttcggaaagactcaagtaggcgtgggtgtccagaaggagggggtgtttcacaccatgtggcacgttacgaggggagcagtgttgacatataacggcaaacgactagaacccaattgggctagtgtcaagaaagacctgatttcttacggcgggggatggcgcctctccgcccagtggcaaaagggtgaggaagtgcaggtaatcgcggtcgagcctggcaaaaacccaaagaatttccagactatgcccgggaccttccagacaaccactggagaaataggcgccatcgcactggattttaagcctggtaccagcgggtcgccgattatcaaccgggagggaaaagtggttggcctttatggcaatggggtggtcacaaagaacggaggttacgtgtcaggcattgctcaaacgaatgccgagccagacgggcccactcctgaattagaggaagagatgttcaaaaagagaaacctgaccatcatggatctccatccaggatctggcaaaacaaggaagtatttgcccgctatagttcgtgaagcaattaagcgccggctgagaaccctcatcctggcccctactagggtggtcgccgctgagatggaggaagcgcttaaaggtctgccgatccgataccagacaaccgcaacgaagagtgagcacactgggcgggaaattgtggacttgatgtgccatgccacatttaccatgcgcctactgtcccccgtaagagtgccaaattataacctcatcataatggatgaggctcacttcaccgaccctgccagcattgcagccaggggatacatctctactcgggttggcatgggcgaagctgcggccatttttatgacagcaacccccccagggacagctgatgccttccctcagagcaatgcacccatccaggacgaggagcgagacataccagaaagatcctggaactcaggaaatgagtggattactgattttgccggtaaaacggtctggttcgtgccgagtatcaaggctggcaacgacatcgccaactgtttacgcaaaaatgggaagaaggtgattcaactgagcaggaaaacctttgatacagaataccagaagactaaacttaacgactgggatttcgtcgtaaccacagacatctctgagatgggagcgaattttaaggcagatcgtgtgattgaccctcggagatgcctgaaacccgttatactcaccgatggcccagagagggtgatcttggccggtcccatgcctgtcactgctgcctccgctgcacagcgccgagggagagtgggccggaacccacagaaggaaaatgaccaatatattttcacgggacagcccctgaacaatgatgaggaccatgcccactggaccgaagctaagatgctcctggacaacatcaatacacctgagggcatcattccggcccttttcgaaccagagagggagaaatcagcagcgatagatggggaataccgcctaaagggagagagtcgtaaaacttttgttgaactgatgagacggggtgacttgcccgtgtggttagcccacaaggtcgctagcgagggcatcaaatataccgataggaagtggtgcttcgacgggcagcgcaacaatcagattctggaagagaacatggatgtggagatctggacaaaagaaggagagaagaagaaactccgacctagatggctggacgcccggacctactccgatccccttgcactgaaggaatttaaagagttcgctgccggcaggaagtctattgcactcgacttggtaactgaaatcggtcgcgtgccatcgcatctggcccacagaacaaggaatgctctagataacctggttatgctccatacgagcgagcacgggggccgggcgtatcgtcacgccgtcgaggaacttcctgagaccatggaaactctgttattgctgggactcatgatactgcttacaggcggggcaatgctgtttctcatctcaggaaaaggtattggcaagacctccatcgggttgatttgtgtgatcgctagttctggaatgctgtggatggccgagatacccttacaatggattgccagcgcaatcgtgctagagttctttatgatggtcctgctcattccagaacctgagaagcagcgcaccccgcaggacaatcaacttgcttacgttgtgatcggcatactgacattggccgcgatcattgctgccaacgaaatgggtctgctcgagactacgaaacgagatctggggatgtccaaggaacccggcgtagtgtcaccaacctcttatcttgacgtcgatctccatcctgcaagcgcctggacactgtacgctgtggcaactaccgttatcacacccatgttgagacacaccattgagaatagtactgccaacgtgtccctggcggctatcgccaaccaggcagtcgtattaatgggactagacaaaggctggccaataagcaagatggacctgggggtgcctctccttgccctgggatgctactctcaggttaatcccttgacgctgacagctgccgtgctcctgcttattacccattatgcaatcatcggcccgggtttacaggctaaagccactagggaggcgcaaaagcggaccgccgcagggattatgaagaacccaacagtcgatggaatcatgactatagacctggatcctgtgatttacgactcaaaattcgaaaagcagctcggccaggtcatgttgctggtgctatgtgctgttcagctgctccttatgcgcacctcctgggccctgtgcgaggcattgacactggctacgggtcccatcaccactctctgggaaggcagtccagggaaattttggaatacaaccattgccgtgagcatggccaacatcttcagaggatcgtatctggcgggcgctgggttagcattttctataatgaagtccgtaggaactggcaaaaggggtacagggagccaaggagagacccttggcgaaaagtggaagaaaaagctgaatcagctctcacggaaagatttcgacctatacaagaaaagtggtatcacggaggtggatcgaaccgaggccaaggaaggcctgaaaagaggggagattacacaccatgctgtctctcgcggatccgccaagttgcagtggtttgttgaaaggaacatggtgatccccgagggccgggtcattgacctggggtgtggacgtggcggttggagctattactgcgcagggctcaagaaagtgactgaagtaagaggatataccaagggcggccctgggcacgaggagccggtgcccatgtcaacatacggatggaatatcgttaaacttatgagtggtaaggatgtgttctacctgccacctgaaaaatgtgacactttgctgtgcgatattggcgagagctccccctctcctaccgtcgaagagagcaggacaatccgcgtgctcaagatggtcgagccatggttaaagaacaatcagttctgtataaaagtgctgaacccctatatgcctaccgttattgaacaccttgagcggctgcaacgaaagcatgggggaatgctagtaagaaatccactctccaggaactcaactcacgaaatgtactggatctctaatggcacgggtaacatcgtggccagtgtcaatatggtgtcgcgcctgttgctgaaccggtttacaatgacccatagacgtcccactattgagaaagacgttgatctcggggctggaaccaggcacgtgaacgcggaaccggagacacctaatatggacgtcataggcgagcggatcaagcgcattaaagaagagcacaacagcacgtggcattatgacgatgaaaatccatacaagacctgggcctatcacggctcctacgaggtgaaggcaactgggtctgcttcaagcatgatcaacggagtagtgaaacttctgacaaagccctgggacgttgtccctatggtgacccagatggccatgactgatacaaccccattcggtcagcaacgagtgtttaaagaaaaggtcgacacaagaactcccaggtccatgccgggcacccggcgcgttatggggattacggcagagtggttatggagaaccctgggaaggaataaaaagcctcgattgtgcacacgggaggaattcactaagaaagtgcgtaccaacgccgctatgggcgccgtatttacagaggaaaatcagtgggatagtgcgaaggcagccgtggaggacgaagatttctggaaactcgtcgacagagagcgcgagctgcataagctaggtaaatgtgggtcttgcgtgtataacatgatgggaaagagggaaaaaaagcttggcgagtttggcaaggctaaagggagccgggccatctggtacatgtggctgggagcaagatacctcgaattcgaggctctgggttttttgaatgaggatcactggttctcacgcgaaaactcctatagtggcgttgagggggaaggactgcataagctcggctacatacttagggacatcagcaaaattcccggtggggccatgtatgctgatgacactgccggatgggacacccgaatcacggaggatgacctgcacaatgaagagaagattacacagcagatggatccagagcaccggcaattagcaaacgcgatctttaaactgacctaccagaataaggtggtcaaggtgcagagacctactcccacaggcaccgtaatggacataatttctaggaaagatcagcgcggctccgggcaagttggaacttatggtttgaacaccttcacaaatatggaagcccagctcatccgtcagatggagggcgaaggggtgctgtcaaaggctgacctagagaacccacatcttcccgaaaaaaagatcacgcagtggctggagaccaaaggagtcgagcggctcaagagaatggccattagcggcgatgactgcgtggtgaagcctatagatgacaggtttgcaaacgctctgttggccttaaatgatatgggtaaagtccgcaaggacatcccacaatggcagccgtcgaaagggtggcacgattggcagcaggttcccttctgttctcatcacttccacgaactgattatgaaggacggacgaaaactcgtggtaccttgccggccacaagacgagcttatcggcagagcaaggattagtcagggcgccgggtggtccctgaaggaaactgcgtgtctaggaaaggcttacgcccagatgtggagcctgatgtattttcatcgcagagatctccggttggcatcaaacgccatctgctccgctgtgcccgtccactgggtgcctacatctaggaccacttggagcatacatgcccaccatcaatggatgacaaccgaggacatgctgacggtttggaatcgtgtgtggatcgaagataacccatggatggaggacaaaacacccgtcaccacttgggagaatgtgccttaccttggtaagcgagaagatcagtggtgtggcagtctgattgggctcacctcccgcgcaacatgggctcagaacatcccgactgccattcagcaagtaagaagcttaatcggaaatgaggaattcctggactacatgccatctatgaaacggtttaggaaggaggaggaatcagagggcgcgatttggtga

SEQ ID NO: 15339 - RNA, 9873 nt, synthetic construct
  misc_feature 1..9873: note = derived and/or modified CDS sequence (opt3) from DENV-3__KF973481__SS-prME
  source 1..9873: mol_type = other RNA
accagcctgtgcctcatgatgatccttcccgcagctctggcattccacttgacatccagagacggcgaacctagaatgattgtggggaagaacgaacggggtaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactattatcattaccgtccatacaggtgaccagcaccaggtgggcaacgagacccaaggggttactgcagaaatcacgcctcaggcttccacaaccgaggccatcctcccagaatatggaactcttggcctggagtgctctccgcgaaccggtttggacttcaatgagatgattctactgacaatgaaaaacaaggcgtggatggtgcatagacagtggtttttcgatctccccctgccttggaccagcggggccactacagaaacgccaacctggaataggaaagagcttctggtcacttttaagaacgcacacgctaaaaagcaagaagtggtagttttgggctcccaggagggagccatgcacacagctctcaccggcgccacagaaatacaaaattcagggggaacaagcatcttcgcaggtcatctgaagtgtcggttaaaaatggacaagctggagctaaaaggcatgagctacgccatgtgcaccaacacgtttgtgctcaagaaagaggtctctgaaacccagcacgggacaattctgatcaaggtggagtacaagggagaagatgtcccctgtaaaatacctttctccactgaggacggccaaggtaaggctcataacgggcgtcttattaccgcgaatccagtggttactaagaaggaggaacccgtgaacatcgaggcagaaccgcctttcggcgagtcaaatatcgtaattggaatcggcgataacgccttgaaaattaattggtataagaaggggagcagtataggaaaaatgtttgaagctactgcccgcggtgcaagaaggatggccatcctgggcgacaccgcttgggatttcgggtctgtcggaggcgtgctcaactccctgggtaagatggttcaccagatttttgggagcgcctacacggcacttttctcgggcgtgtcttgggtcatgaaaatcggaatcggcgtgctgttgacatggattgggctcaattccaagaacacctcaatgagttttagctgcatagcgatcggaattatcactctgtatttaggcgctgtagtgcaggccgacatgggttgtgttattaattggaaagggaaggagctgaagtgcggatccggcatcttcgtcacaaacgaggtgcatacctggactgaacagtacaaatttcaagcagattctcccaagcggctagccaccgctatagccggtgcatgggagaatggcgtgtgtgggatccgaagcacaacgcgcatggaaaacctcctgtggaaacagattgctaatgagcttaactatatcttgtgggaaaataacattaagctgaccgtcgttgtgggagacatcataggcgtgctcgagcaggggaaaagaactctgacaccacagcctatggagttaaagtactcatggaaaacctggggaaaggccaagattgtaacagcggaaactcaaaacagttccttcatcattgatggccccaataccccagagtgccccagcgtctctagggcctggaacgtgtgggaagttgaggactatggttttggggtgttcacgacaaatatctggctgaaacttcgggaagtctacacccagttgtgtgaccaccgcctcatgtcagctgcagtgaaggatgagagagccgttcacgctgacatgggatactggatagagagtcagaaaaacggcagctggaagctggaaaaagcctccctaatcgaggtgaagacttgcacctggcctaagtctcatacactgtggtcgaatggtgtactcgaaagcgatatgattatcccaaaatccctggcaggcccgatttcacagcacaaccataggcccgggtatcacactcaaaccgcgggaccttggcaccttggcaagttggagctggactttaattactgcgaggggacaacggtcgtgatcaccgaaaactgtggaactcgtggcccaagtttacggacaaccactgtgtctggtaaactcatacatgagtggtgctgtcgaagctgcacactgccccctcttagatatatgggggaagatggatgttggtacggcatggagattaggccaatctccgaaaaggaggagaatatggtcaaatcactggttagcgccggttctggcaaggtggacaacttcaccgtaggggtgttgtgcctcgctatcctgtttgaagaggtcatgcgcggaaagttcggcaaaaagcacatgattgccggggtgttctttacgttcgttctactgctctccggacagatcacttggcgggatatggcacataccctgattatgataggcagtaatgctagcgacagaatgggtatgggggtgacatatcttgccttgatcgcaacctttaaaattcagcccttcctggccttaggatttttcctcaggaagctgacttctcgcgaaaaccttctgctaggcgtcggcctcgctatggcgacaaccctgcaattgccggaggatatcgaacagatggccaatgggattgcactgggattaatggctctcaaactgatcacacagtttgagacttaccagctttggaccgccctgatatccttgacgtgttcaaacacaatcttcaccctcactgtggcctggcgaaccgctacactgattctagccggtgttagtctgcttcctgtgtgccaaagctcgtccatgcggaagactgactggctcccaatggccgtcgcggctatgggcgtaccccctctgcccttgtttatcttcgggctgaaggataccttaaaacgtagatcttggccactcaatgagggagtgatggccgttggcctggtgagcattcttgcatcaagtctgttgaggaacgacgtccctatggccggtcccctcgtggctgggggactgctaatcgcatgttatgtaataacgggcacatccgccgatctgaccgtggaaaaggcggctgacattacttgggaggaagaggccgaacagacaggcgtctctcacaaccttatgatcaccgttgacgatgacgggactatgcgcatcaaagatgacgagacagagaatattctcaccgtgctgttgaagacggcattactgatagtgagcggaatctttccatactccattccggccactctcctggtctggcatacctggcagaaacagacacaacggtcaggtgtgctttgggatgttcctagtcccccagaaacccagaaggctgagctggaagagggcgtatacagaatcaaacagcaggggattttcggaaagacacaagtgggcgtcggtgtgcagaaggagggggtttttcacactatgtggcacgtgaccaggggagccgtcttgacgtataacggcaaacgactagaacccaattgggcaagtgtgaagaaagacctgatctcttacggcgggggatggcgcctctccgctcagtggcaaaagggtgaggaagtacaggtcatagccgtggagcctggcaaaaacccaaagaatttccagacaatgcccgggactttccagaccacaaccggagaaatcggcgcgattgccctggattttaagcctggtactagcgggtcgccgatcattaaccgggagggaaaagttgtgggcctttatggcaatggggtcgtgaccaagaacggaggttacgtttcaggcatcgcacaaacaaatgctgagccagacgggcccacgcctgaattagaggaagagatgttcaaaaagagaaacctgactataatggatctccatccaggatctggcaaaaccaggaagtatttgcccgccattgtgcgtgaagctatcaagcgccggctgagaacactcatcctggcacctaccagggtcgtggccgccgagatggaggaagctcttaaaggtctgccgattcgataccagactacagcgaccaagagtgagcacacggggcgggaaatcgtagacttgatgtgccatgcaacttttacaatgcgcctactgtcccccgtgagagttccaaattataacctcataattatggatgaggcccacttcaccgaccctgctagcatcgccgcaaggggatacatttctacccgggtcggcatgggcgaagccgctgcgatctttatgactgccacacccccagggaccgcagatgctttccctcagagcaatgcccccatacaggacgaggagcgagacattccagaaagatcctggaactcaggaaatgagtggatcacagattttgcaggtaaaactgtgtggttcgtgccgagtatcaaggccggcaacgacattgctaactgtttacgcaaaaatgggaagaaggtcatccaactgagcaggaaaacgtttgataccgaataccagaagacaaaacttaacgactgggatttcgtagtgactaccgacatttctgagatgggagccaattttaaggcggatcgtgttatagaccctcggagatgcctgaaacccgtgatcctcacagatggcccagagagggtcattttggcaggtcccatgcctgtgaccgccgcttccgccgctcagcgccgagggagagttggccggaacccacagaaggaaaatgaccaatatatcttcactggacagcccctgaacaatgatgaggaccatgcacactggacggaagccaagatgctcctggacaacatcaatacccctgagggcattataccggctcttttcgaaccagagagggagaaatcagccgcaatcgatggggaataccgcctaaagggagagagtcgtaaaacatttgtggaactgatgagacggggtgacttgcccgtctggttagcgcacaaggtggccagcgagggcattaaatatactgataggaagtggtgcttcgacgggcagcgcaacaatcagatcctggaagagaacatggatgtagagatttggaccaaagaaggagagaagaagaaactccgacctagatggctggacgctcggacatactccgatccccttgccctgaaggaatttaaagagttcgcagctggcaggaagtctatcgccctcgacttggtgaccgaaataggtcgcgttccatcgcatctggcacacagaactaggaatgccctagataacctggtcatgctccatacaagcgagcacgggggccgggcttatcgtcacgcggtggaggaacttcctgagacgatggaaaccctgttattgctgggactcatgatcctgcttactggcggggccatgctgtttctcatttcaggaaaaggtatcggcaagacatccattgggttgatctgtgtgatagcaagttctggaatgctgtggatggctgagattcccttacaatggatcgccagcgccattgtcctagagttctttatgatggttctgctcatcccagaacctgagaagcagcgcaccccgcaggacaatcaacttgcatacgtggtaataggcatcctgaccttggctgccattatcgcggctaacgaaatgggtctgctcgagacaactaaacgagatctggggatgtccaaggaacccggcgtggtctcaccaacgtcttatcttgacgtggatctccatcctgccagcgcatggaccctgtacgccgttgctacaactgtgattacccccatgttgagacacacaatcgagaatagtaccgcaaacgtctccctggccgcgatagctaaccaggccgtagtgttaatgggactagacaaaggctggccaattagcaagatggacctgggggttcctctccttgcactgggatgctactctcaggtgaatcccttgactctgacggccgctgtcctcctgcttatcacacattatgccatcattggcccgggtttacaggcaaaagctaccagggaggcccaaaagcggactgcggccgggatcatgaagaacccaaccgtggatggaataatgacaattgacctggatcctgtcatctacgactcaaaattcgaaaagcagctcggccaggtgatgttgctggttctatgtgcagtgcagctgctccttatgcgcacttcctgggctctgtgcgaggccttgaccctggcaacaggtcccattacgaccctctgggaaggcagtccagggaaattttggaatactacaatcgctgtaagcatggccaacatattcagaggatcgtatctggccggcgcggggttagctttttctatcatgaagtccgtgggaaccggcaaaaggggtactgggagccaaggagagacacttggcgaaaagtggaagaaaaagctgaatcagctctcacggaaagatttcgacctatacaagaaaagtggtattaccgaggtcgatcgaacggaggcaaaggaaggcctgaaaagaggggagatcacccaccatgccgtttctcgcggatccgctaagttgcagtggtttgtggaaaggaacatggtcattcccgagggccgggtgatcgacctggggtgtggacgtggcggttggagctattactgcgccgggctcaagaaagtaacagaagtgagaggatatactaagggcggccctgggcacgaggagccggttcccatgtcaacctacggatggaatattgtgaaacttatgagtggtaaggatgtcttctacctgccacctgaaaaatgtgacacattgctgtgcgatatcggcgagagctccccctctcctactgtggaagagagcaggaccatacgcgtcctcaagatggtggagccatggttaaagaacaatcagttctgtattaaagttctgaacccctatatgcctacagtaatcgaacaccttgagcggctgcaacgaaagcatgggggaatgctagtgagaaatccactctccaggaactcaacccacgaaatgtactggatctctaatggcactggtaacattgtcgcaagtgtgaatatggtttcgcgcctgttgctgaaccggtttacgatgacacatagacgtcccaccatagagaaagacgtggatctcggggccggaactaggcacgtcaacgctgaaccggagacccctaatatggacgtgatcggcgagcggattaagcgcatcaaagaagaacacaacagcacatggcattatgacgatgaaaatccatacaagacgtgggcgtatcacggctcctacgaggtaaaggccaccgggtctgcatcaagcatgattaacggagtggttaaacttctgactaagccctgggacgtcgtgcctatggtgacacagatggctatgaccgatactacaccattcggtcagcaacgagtctttaaagaaaaggttgacaccagaacacccaggtccatgccgggcactcggcgcgtgatggggatcaccgccgagtggttatggagaacgctgggaaggaataaaaagcctcgattgtgcacccgggaggagttcacaaagaaagtacgtactaacgcagccatgggcgctgtgtttaccgaggaaaatcagtgggatagtgccaaggcggcagtcgaggacgaagatttctggaaactcgtggacagagagcgcgagctgcataagctaggtaaatgtgggtcttgcgtttataacatgatgggaaagagggagaagaaacttggcgagtttggcaaagccaaagggagccgggctatatggtacatgtggctgggagccagatacctcgagttcgaggcactgggatttttgaatgaggatcactggttctcacgcgaaaactcctatagtggcgtggagggggaaggactgcataagctcggctacatccttagggacattagcaaaatccccggtggggctatgtatgccgatgacacagctggatgggacactcgaattaccgaggatgacctgcacaatgaagagaagatcacgcagcagatggatccagagcaccggcaattagccaacgcaatatttaaactgacataccagaataaggtcgtgaaggtacagagacctacccccactggcacagttatggacattatctctaggaaagatcagcgcggctccgggcaagtgggaacctatggtttgaacactttcaccaatatggaagcgcagctcatccgtcagatggagggcgaaggggtcctgtcaaaggccgacctagagaacccacatcttcccgagaaaaagattacacagtggctggagacgaaaggagtggagcggctcaagagaatggctataagcggcgatgactgcgtggtcaagcctatcgatgacaggtttgccaacgcactgttggctttaaatgatatgggtaaagttcgcaaggacattccacaatggcagccgtcgaaagggtggcacgattggcaacaggtgcccttctgttctcatcacttccacgaactgatcatgaaggacggacgaaaactcgtagtgccttgccggccacaagacgagcttattggcagagccaggatcagtcagggcgcagggtggtccctgaaggaaaccgcctgtctaggaaaggcgtacgctcagatgtggagcctgatgtattttcatcgcagagatctccggttggcctcaaacgcaatatgctccgccgtccccgtgcactgggttcctacttctaggacaacctggagcatccatgctcaccatcaatggatgactacagaggacatgctgaccgtgtggaatcgtgtctggattgaagataacccatggatggaggacaaaacgcccgtgacaacctgggagaatgtaccttaccttggtaagcgagaagatcagtggtgtggcagtctgatcgggctcacttcccgcgccacctgggcacagaacattccgacagctatccagcaagttaggagcttaattggaaatgaggagttcctggactacatgccatctatgaaacggtttaggaaggaggaggaatcagagggcgccatatggtga

SEQ ID NO: 15340 - RNA, 9873 nt, synthetic construct
  misc_feature 1..9873: note = derived and/or modified CDS sequence (opt3) from DENV-3__KF973482__SS-prME
  source 1..9873: mol_type = other RNA
accagcctgtgcctcatgatgatccttcccgcagctctggcattccacttgacatccagagacggcgaacctagaatgattgtggggaagaacgaacggggtaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactattatcattaccgtccatacaggtgaccagcaccaggtgggcaacgagacccaaggggttactgcagaaatcacgcctcaggcttccacaaccgaggccatcctcccagaatatggaactcttggcctggagtgctctccgcgaaccggtttggacttcaatgagatgattctactgacaatgaaaaacaaggcgtggatggtgcatagacagtggtttttcgatctccccctgccttggaccagcggggccactacagaaacgccaacctggaataggaaagagcttctggtcacttttaagaacgcacacgctaaaaagcaagaagtggtagttttgggctcccaggagggagccatgcacacagctctcaccggcgccacagaaatacaaaattcagggggaacaagcatcttcgcaggtcatctgaagtgtcggttaaaaatggacaagctggagctaaaaggcatgagctacgccatgtgcaccaacacgtttgtgctcaagaaagaggtctctgaaacccagcacgggacaattctgatcaaggtggagtacaagggagaagatgtcccctgtaaaatacctttctccactgaggacggccaaggtaaggctcataacgggcgtcttattaccgcgaatccagtggttactaagaaggaggaacccgtgaacatcgaggcagaaccgcctttcggcgagtcaaatatcgtaattggaatcggcgataacgccttgaaaattaattggtataagaaggggagcagtataggaaaaatgtttgaagctactgcccgcggtgcaagaaggatggccatcctgggcgacaccgcttgggatttcgggtctgtcggaggcgtgctcaactccctgggtaagatggttcaccagatttttgggagcgcctacacggcacttttctcgggcgtgtcttgggtcatgaaaatcggaatcggcgtgctgttgacatggattgggctcaattccaagaacacctcaatgagttttagctgcatagcgatcggaattatcactctgtatttaggcgctgtagtgcaggccgacatgggttgtgttattaattggaaagggaaggagctgaagtgcggatccggcatcttcgtcacaaacgaggtgcatacctggactgaacagtacaaatttcaagcagattctcccaagcggctagccaccgctatagccggtgcatgggagaatggcgtgtgtgggatccgaagcacaacgcgcatggaaaacctcctgtggaaacagattgctaatgagcttaactatatcttgtgggaaaataacattaagctgaccgtcgttgtgggagacatcataggcgtgctcgagcaggggaaaagaactctgacaccacagcctatggagttaaagtactcatggaaaacctggggaaaggccaagattgtaacagcggaaactcaaaacagttccttcatcattgatggccccaataccccagagtgccccagcgtctctagggcctggaacgtgtgggaagttgaggactatggttttggggtgttcacgacaaatatctggctgaaacttcgggaagtctacacccagttgtgtgaccaccgcctcatgtcagctgcagtgaaggatgagagagccgttcacgctgacatgggatactggatagagagtcagaaaaacggcagctggaagctggaaaaagcctccctaatcgaggtgaagacttgcacctggcctaagtctcatacactgtggtcgaatggtgtactcgaaagcgatatgattatcccaaaatccctggcaggcccgatttcacagcacaaccataggcccgggtatcacactcaaaccgcgggaccttggcaccttggcaagttggagctggactttaattactgcgaggggacaacggtcgtgatcaccgaaaactgtggaactcgtggcccaagtttacggacaaccactgtgtctggtaaactcatacatgagtggtgctgtcgaagctgcacactgccccctcttagatatatgggggaagatggatgttggtacggcatggagattaggccaatctccgaaaaggaggagaatatggtcaaatcactggttagcgccggttctggcaaggtggacaacttcaccgtaggggtgttgtgcctcgctatcctgtttgaagaggtcatgcgcggaaagttcggcaaaaagcacatgattgccggggtgttctttacgttcgttctactgctctccggacagatcacttggcgggatatggcacataccctgattatgataggcagtaatgctagcgacagaatgggtatgggggtgacatatcttgccttgatcgcaacctttaaaattcagcccttcctggccttaggatttttcctcaggaagctgacttctcgcgaaaaccttctgctaggcgtcggcctcgctatggcgacaaccctgcaattgccggaggatatcgaacagatggccaatgggattgcactgggattaatggctctcaaactgatcacacagtttgagacttaccagctttggaccgccctgatatccttgacgtgttcaaacacaatcttcaccctcactgtggcctggcgaaccgctacactgattctagccggtgttagtctgcttcctgtgtgccaaagctcgtccatgcggaagactgactggctcccaatggccgtcgcggctatgggcgtaccccctctgcccttgtttatcttcgggctgaaggataccttaaaacgtagatcttggccactcaatgagggagtgatggccgttggcctggtgagcattcttgcatcaagtctgttgaggaacgacgtccctatggccggtcccctcgtggctgggggactgctaatcgcatgttatgtaataacgggcacatccgccgatctgaccgtggaaaaggcggctgacattacttgggaggaagaggccgaacagacaggcgtctctcacaaccttatgatcaccgttgacgatgacgggactatgcgcatcaaagatgacgagacagagaatattctcaccgtgctgttgaagacggcattactgatagtgagcggaatctttccatactccattccggccactctcctggtctggcatacctggcagaaacagacacaacggtcaggtgtgctttgggatgttcctagtcccccagaaacccagaaggctgagctggaagagggcgtatacagaatcaaacagcaggggattttcggaaagacacaagtgggcgtcggtgtgcagaaggagggggtttttcacactatgtggcacgtgaccaggggagccgtcttgacgtataacggcaaacgactagaacccaattgggcaagtgtgaagaaagacctgatctcttacggcgggggatggcgcctctccgctcagtggcaaaagggtgaggaagtacaggtcatagccgtggagcctggcaaaaacccaaagaatttccagacaatgcccgggactttccagaccacaaccggagaaatcggcgcgattgccctggattttaagcctggtactagcgggtcgccgatcattaaccgggagggaaaagttgtgggcctttatggcaatggggtcgtgaccaagaacggaggttacgtttcaggcatcgcacaaacaaatgctgagccagacgggcccacgcctgaattagaggaagagatgttcaaaaagagaaacctgactataatggatctccatccaggatctggcaaaaccaggaagtatttgcccgccattgtgcgtgaagctatcaagcgccggctgagaacactcatcctggcacctaccagggtcgtggccgccgagatggaggaagctcttaaaggtctgccgattcgataccagactacagcgaccaagagtgagcacacggggcgggaaatcgtagacttgatgtgccatgcaacttttacaatgcgcctactgtcccccgtgagagttccaaattataacctcataattatggatgaggcccacttcaccgaccctgctagcatcgccgcaaggggatacatttctacccgggtcggcatgggcgaagccgctgcgatctttatgactgccacacccccagggaccgcagatgctttccctcagagcaatgcccccatacaggacgaggagcgagacattccagaaagatcctggaactcaggaaatgagtggatcacagattttgcaggtaaaactgtgtggttcgtgccgagtatcaaggccggcaacgacattgctaactgtttacgcaaaaatgggaagaaggtcatccaactgagcaggaaaacgtttgataccgaataccagaagacaaaacttaacgactgggatttcgtagtgactaccgacatttctgagatgggagccaattttaaggcggatcgtgttatagaccctcggagatgcctgaaacccgtgatcctcacagatggcccagagagggtcattttggcaggtcccatgcctgtgaccgccgcttccgccgctcagcgccgagggagagttggccggaacccacagaaggaaaatgaccaatatatcttcactggacagcccctgaacaatgatgaggaccatgcacactggacggaagccaagatgctcctggacaacatcaatacccctgagggcattataccggctcttttcgaaccagagagggagaaatcagccgcaatcgatggggaataccgcctaaagggagagagtcgtaaaacatttgtggaactgatgagacggggtgacttgcccgtctggttagcgcacaaggtggccagcgagggcattaaatatactgataggaagtggtgcttcgacgggcagcgcaacaatcagatcctggaagagaacatggatgtagagatttggaccaaagaaggagagaagaagaaactccgacctagatggctggacgctcggacatactccgatccccttgccctgaaggaatttaaagagttcgcagctggcaggaagtctatcgccctcgacttggtgaccgaaataggtcgcgttccatcgcatctggcacacagaactaggaatgccctagataacctggtcatgctccatacaagcgagcacgggggccgggcttatcgtcacgcggtggaggaacttcctgagacgatggaaaccctgttattgctgggactcatgatcctgcttactggcggggccatgctgtttctcatttcaggaaaaggtatcggcaagacatccattgggttgatctgtgtgatagcaagttctggaatgctgtggatggctgagattcccttacaatggatcgccagcgccattgtcctagagttctttatgatggttctgctcatcccagaacctgagaagcagcgcaccccgcaggacaatcaacttgcatacgtggtaataggcatcctgaccttggctgccattatcgcggctaacgaaatgggtctgctcgagacaactaaacgagatctggggatgtccaaggaacccggcgtggtctcaccaacgtcttatcttgacgtggatctccatcctgccagcgcatggaccctgtacgccgttgctacaactgtgattacccccatgttgagacacacaatcgagaatagtaccgcaaacgtctccctggccgcgatagctaaccaggccgtagtgttaatgggactagacaaaggctggccaattagcaagatggacctgggggttcctctccttgcactgggatgctactctcaggtgaatcccttgactctgacggccgctgtcctcctgcttatcacacattatgccatcattggcccgggtttacaggcaaaagctaccagggaggcccaaaagcggactgcggccgggatcatgaagaacccaaccgtggatggaataatgacaattgacctggatcctgtcatctacgactcaaaattcgaaaagcagctcggccaggtgatgttgctggttctatgtgcagtgcagctgctccttatgcgcacttcctgggctctgtgcgaggccttgaccctggcaacaggtcccattacgaccctctgggaaggcagtccagggaaattttggaatactacaatcgctgtaagcatggccaacatattcagaggatcgtatctggccggcgcggggttagctttttctatcatgaagtccgtgggaaccggcaaaaggggtactgggagccaaggagagacacttggcgaaaagtggaagaaaaagctgaatcagctctcacggaaagatttcgacctatacaagaaaagtggtattaccgaggtcgatcgaacggaggcaaaggaaggcctgaaaagaggggagatcacccaccatgccgtttctcgcggatccgctaagttgcagtggtttgtggaaaggaacatggtcattcccgagggccgggtgatcgacctggggtgtggacgtggcggttggagctattactgcgccgggctcaagaaagtaacagaagtgagaggatatactaagggcggccctgggcacgaggagccggttcccatgtcaacctacggatggaatattgtgaaacttatgagtggtaaggatgtcttctacctgccacctgaaaaatgtgacacattgctgtgcgatatcggcgagagctccccctctcctactgtggaagagagcaggaccatacgcgtcctcaagatggtggagccatggttaaagaacaatcagttctgtattaaagttctgaacccctatatgcctacagtaatcgaacaccttgagcggctgcaacgaaagcatgggggaatgctagtgagaaatccactctccaggaactcaacccacgaaatgtactggatctctaatggcactggtaacattgtcgcaagtgtgaatatggtttcgcgcctgttgctgaaccggtttacgatgacacatagacgtcccaccatagagaaagacgtggatctcggggccggaactaggcacgtcaacgctgaaccggagacccctaatatggacgtgatcggcgagcggattaagcgcatcaaagaagaacacaacagcacatggcattatgacgatgaaaatccatacaagacgtgggcgtatcacggctcctacgaggtaaaggccaccgggtctgcatcaagcatgactaacggagtggttaaacttctgacaaagccctgggacgtcgtgcctatggtgacccagatggctatgactgatacaaccccattcggtcagcaacgagtctttaaagaaaaggttgacacaagaactcccaggtccatgccgggcacccggcgcgtgatggggattacggccgagtggttatggagaaccctgggaaggaataaaaagcctcgattgtgcacacgggaggagttcactaagaaagtacgtaccaacgcagccatgggcgctgtgtttacagaggaaaatcagtgggatagtgccaaggcggcagtcgaggacgaagatttctggaaactcgtggacagagagcgcgagctgcataagctaggtaaatgtgggtcttgcgtttataacatgatgggaaagagggagaagaaacttggcgagtttggcaaagccaaagggagccgggctatctggtacatgtggctgggagccagatacctcgagttcgaggcactgggatttttgaatgaggatcactggttctcacgcgaaaactcctatagtggcgtggagggggaaggactgcataagctcggctacatacttagggacatcagcaaaattcccggtggggctatgtatgccgatgacactgctggatgggacacccgaatcacggaggatgacctgcacaatgaagagaagattacacagcagatggatccagagcaccggcaattagccaacgcaatctttaaactgacctaccagaataaggtcgtgaaggtacagagacctactcccacaggcaccgttatggacataatttctaggaaagatcagcgcggctccgggcaagtgggaacttatggtttgaacaccttcacaaatatggaagcgcagctcatccgtcagatggagggcgaaggggtcctgtcaaaggccgacctagagaacccacatcttcccgagaaaaagatcacgcagtggctggagaccaaaggagtggagcggctcaagagaatggctattagcggcgatgactgcgtggtcaagcctatagatgacaggtttgccaacgcactgttggctttaaatgatatgggtaaagttcgcaaggacatcccacaatggcagccgtcgaaagggtggcacgattggcaacaggtgcccttctgttctcatcacttccacgaactgattatgaaggacggacgaaaactcgtagtgccttgccggccacaagacgagcttatcggcagagccaggattagtcagggcgcagggtggtccctgaaggaaactgcctgtctaggaaaggcgtacgctcagatgtggagcctgatgtattttcatcgcagagatctccggttggcctcaaacgcaatctgctccgccgtccccgtgcactgggttcctacatctaggaccacttggagcatacatgctcaccatcaatggatgacaaccgaggacatgctgacggtgtggaatcgtgtctggatcgaagataacccatggatggaggacaaaacacccgtgaccacttgggagaatgtaccttaccttggtaagcgagaagatcagtggtgtggcagtctgattgggctcacctcccgcgccacatgggcacagaacatcccgactgctattcagcaagttaggagcttaatcggaaatgaggagttcctggactacatgccatctatgaaacggtttaggaaggaggaggaatcagagggcgccatttggtga

SEQ ID NO: 15341 - RNA, 9873 nt, synthetic construct
  misc_feature 1..9873: note = derived and/or modified CDS sequence (opt3) from DENV-3__KF973483__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcagaattcagggggaactagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgctccctgtaaaatccctttctccactgaggacggccaaggtaaggcgcataacgggcgtcttataaccgcaaatccagtggttacaaaaaaggaggaacccgtgaacattgaggccgaaccgcctttcggcgagtcaaatatcgtaatcggaattggcgataacgctttgaaaatcaattggtataagaaggggagcagtattggaaaaatgtttgaagccactgcacgcggtgccagaaggatggctatactgggcgacaccgcctgggatttcgggtctgtcggaggcgtgctcaactccctgggtaagatggttcaccagatctttgggagcgcatacacggcgcttttctcgggcgtgtcttgggtcatgaaaattggaatcggcgtgctgttgacatggatcgggctcaattcccggaacacctcaatgagttttagctgcattgctataggaatcattactctgtatttaggcgccgtagtgcaggcagacatgggttgtgttatcaattggaaggggaaagagctgaagtgcggatccggcattttcgtcacaaacgaggtgcatacctggactgaacagtacaagtttcaagccgattctcccaaacgactagctaccgccatcgtgggtgcatgggagaatggcgtctgtgggatacgcagcacaacgagaatggaaaacctcctgtggaagcagatcgctaatgagcttaactatattttgtgggaaaataacatcaaactgaccgttgtggtgggagacattatcggcgtactcgagcaggggaagaggactctgacaccacagcctatggagttaaaatactcatggaagacctggggaaaagccaagatagtcacagcggaaactcaaaacagttccttcattatcgatggccccaataccccagagtgccccagcgtgtctcgggcctggaacgtttgggaagtggaggactatggttttggggtcttcacgacaaatatttggctgaagcttcgcgaaacctacactcagttgtgtgaccacagactcatgtcagctgcagtgaaagatgagagggccgttcacgctgacatgggatactggatcgagagtcagaagaacggcagctggaaactggaaaaggcctccctaatagaggtgaaaacctgcacatggcctaagtctcatactatctggtcgaatggtgtactggaaagcgatatgattatcccaaagtccctcgcaggcccgatttcacagcacaaccatcgtcccgggtatcacacccaaacagcgggaccttggcacctgggcaaacttgagttggactttaattactgcgaggggacgaccgtcgtgatcactgaaaactgtggaacacggggcccaagtctgcgaaccactacagtgtctggtaagttaatacatgagtggtgctgtagaagctgcaccctcccccctctgaggtatatgggggaagatggatgttggtacggcatggagattcgcccaatctccgaaaaagaggagaatatggtcaagtcacttgttagcgccggttctggcaaagtggacaacttcacgatgggggtactgtgcttggctatcctctttgaagaggtgatgcggggaaagttcggcaagaaacacatgattgccggggtcttcctgacttttgtgctactgctctccggacagatcacctggagagatatggcacatacactgattatgataggcagtaatgctagcgacaggatgggtatgggggttacctatcttgccttgatcgcaactttcaagattcagccctttctggccttaggattctttctccgcaaactgacatctcgagaaaaccttctgctaggcgtgggcctcgctatggcgaccacactgcaattgccggaggatatcgaacagatggccaatgggattgcactgggattaatggctctcaagctgatcactcagttcgagacctaccagctttggacggccctgatatccttgacatgttcaaacaccatctttactctcaccgtcgcctggcggacagctactctgattctagcaggtgtgagtctgcttcctgtttgccaaagctcgtccatgcgtaaaaccgactggctcccaatggccgtggcggctatgggcgtcccccctctgcccttgttcatcttttctctgaaggatacgttaaagagaaggagctggccactcaatgagggggtaatggccgtgggactggtttcaattcttgcaagttccctgttgcgcaacgacgtgcctatggccggccccctcgtcgctggtgggctgctaatcgcatgttatgtgataacaggaacctctgccgatctgactgtagaaaaagcggctgacattacatgggaggaagaggccgaacagaccggcgtgagccacaaccttatgatcactgtcgacgatgacggcacaatgcggatcaaggatgacgagaccgagaatattctcacggttctgttgaaaactgcattactgatagtgtccgggatcttcccatactcaattccggccaccctcctggtgtggcatacatggcagaagcagacccaaagaagcggagtcctttgggatgtgcctagtcccccagaaacacagaaagctgagctggaagagggtgtttacaggatcaagcagcagggcatttttgggaaaactcaagtaggagtgggcgtccagaaggagggtgtgttccacaccatgtggcacgttacgcgaggggccgtgttgacatataacggaaagcgcctagaacccaattgggcatctgtcaaaaaggacctgatctcctacggcggcgggtggcggctcagcgctcagtggcaaaaaggagaggaagtgcaggtaatagccgtcgagcctggtaagaacccaaaaaattttcagactatgcccggcaccttccagacaaccactggggaaatcggagcgattgccctggatttcaagcctggcacctcgggttcaccgatcattaacagagaggggaaggtggttggactttatggcaatggcgtggtcacaaaaaacgggggatacgtgtctggtatcgcacaaacgaatgctgagccagacggccccactcctgaattagaggaagagatgtttaagaaaaggaacctgaccataatggatctccatccagggagtggaaagacacgtaaatatttgcccgccattgttcgcgaagctatcaagcggagactgaggaccctcatcctggcacctactcgagtggtcgccgccgagatggaggaagctcttaagggcctgccgattcggtaccagacaaccgcgacgaaatccgagcacactggtcgcgaaatcgtggacttgatgtgccatgcaacattcaccatgagactactgagccccgtaagggtgccaaattataacctcataattatggatgaggcccactttaccgaccctgcttctatcgccgcacgggggtacattagcactcgagttggaatgggcgaagccgctgcgatcttcatgacagccacccccccaggcacagcagatgcttttcctcagtccaatgcccccatacaggacgaggagagagacattccagaacgctcatggaacagtgggaatgagtggatcactgatttcgcaggaaagacggtctggtttgtgccgagcatcaaagccggtaacgacattgctaactgtttaaggaagaatggcaaaaaggtgatccaactgtctcgtaagaccttcgatacagaataccagaaaactaagcttaacgactgggattttgtcgtaaccacagacatttccgagatgggggccaatttcaaagcggatcgggtgatagaccctagaaggtgcctgaagcccgttatcctcaccgatggaccagagcgcgtgattttggcaggccccatgcctgtcactgccgcttcagccgctcagcgaagaggtcgggtggggaggaacccacagaaagaaaatgaccaatatatctttacgggccagcccctgaacaatgatgaggaccatgcacactggaccgaagccaagatgctcctggacaacatcaatacacctgagggaattataccggctcttttcgaaccagagcgcgagaagagtgccgcaatcgatggcgaataccgtctaaaaggggagagcagaaagactttcgttgaactgatgcggaggggagacttgcccgtgtggttagcgcacaaagtcgcctccgagggtattaagtataccgatcgcaaatggtgctttgacggccagcgaaacaatcagatcctggaagagaacatggatgtggagatttggacaaaggaaggggagaaaaagaagctcagacctcggtggctggacgctaggacctactctgatccccttgccctgaaagaattcaaggagtttgcagctggacgcaaatcgatcgccctcgacttggtaactgaaataggcagagtgccaagccatctggcacacaggacacggaatgccctagataacctggttatgctccatacgtcagagcacggtgggcgtgcttatcgccacgcggtcgaggaacttcctgagaccatggaaactctgttattgctgggcctcatgatcctgcttacaggaggcgccatgctgttcctcatttccgggaagggaatcggtaaaaccagtattggcttgatctgtgtgatagcatctagcgggatgctgtggatggctgagattcccttacaatggatcgcctccgccattgtgctagagtttttcatgatggtcctgctcatcccagaacctgagaagcagcgaaccccgcaggacaatcaacttgcatacgttgtgataggaatcctgacattggctgccattatcgcggctaacgaaatgggcctgctcgagactacgaagagagatctgggtatgtcaaaagaacccggggtagtgtctccaaccagctatcttgacgtcgatctccatcctgccagtgcatggacactgtacgccgtggctactaccgttattacacccatgttgaggcacaccatcgagaattccactgcaaacgtgagcctggccgcgatagctaaccaggccgtcgtattaatgggcctagacaagggatggccaatttctaaaatggacctgggcgtgcctctccttgcactggggtgctactcacaggttaatcccttgacgctgacagccgctgtgctcctgcttatcacccattatgccatcattggaccgggcttacaggcaaaggctactcgggaggcccaaaaacgcaccgcggccggtatcatgaagaacccaacagtcgatgggataatgactattgacctggatcctgtgatctacgactccaagtttgaaaaacagctcggacaggtcatgttgctggtgctatgtgcagttcagctgctccttatgagaaccagttgggctctgtgcgaggccttgacactggcaacgggccccattaccactctctgggaaggtagcccaggcaagttctggaatacaaccatcgctgtgtcgatggccaacatatttagggggtcttatctggccggagcgggcttagctttctccatcatgaaaagcgtagggactggaaagcggggcacaggttcacaaggggagacccttggagaaaaatggaagaagaaactgaatcagctcagtcgaaaggattttgacctatacaaaaagtctggcattacggaggtggatagaaccgaggcaaaagaaggtctgaagcgcggcgagatcacacaccatgccgtctccagggggagcgctaaattgcagtggttcgttgaacggaacatggtgattcccgagggacgtgtcatcgacctgggctgtgggagaggaggctggtcatattactgcgccggtctcaagaaggtgactgaagtaagggggtataccaaaggaggccctggccacgaggagccggtgcccatgagtacatacgggtggaatattgttaagcttatgagcggaaaagatgtgttttacctgccacctgaaaagtgtgacactttgctgtgcgatatcggtgagtcctctcccagccctaccgtcgaagagtcccgcacaatacgggtgctcaaaatggtcgagccatggttaaagaacaatcagttctgtattaaggtgctgaacccctatatgcctaccgttatcgaacaccttgagcgactgcaaagaaaacatggcgggatgctagtaaggaatccactctcacgcaactctactcacgaaatgtactggatcagtaatggaacgggcaacattgtggcatcggtcaatatggtgagccggctgttgctgaacagattcacaatgacccatcgtaggcccactatagagaaggacgttgatctcggtgccgggacccggcacgtgaacgctgaaccggagacacctaatatggacgtcatcggagagcgcattaaacgaatcaaggaagagcacaactccacgtggcattatgacgatgaaaatccatacaaaacctgggcgtatcacggctcttacgaggtgaaggccactggctcagcaagctccatgattaacggggtagtgaagcttctgacaaaaccctgggacgttgtccctatggtgacccagatggctatgactgatacaaccccatttggacagcaaagagtgttcaaggaaaaagtcgacacaaggactccccggagtatgccgggtacccgcagagttatgggcatcacggccgagtggttatggaggaccctggggcgaaataagaaacctcggttgtgcacacgtgaggaatttactaagaaggtgagaaccaacgcagccatgggagctgtattcacagaggaaaatcagtgggattctgccaaagcggcagtggaggacgaagatttttggaagctcgtcgaccgcgagagggagctgcataaactaggcaagtgtggtagctgcgtgtataacatgatggggaaacgggaaaagaaacttggagagttcggcaaggccaagggctcaagagctatatggtacatgtggctgggggcccgctacctcgaatttgaggcactgggattcttgaatgaggatcactggttttccagggaaaacagttatagcggtgttgagggcgaagggctgcataaactcggatacatccttcgagacatttctaagatccccggcggtgctatgtatgccgatgacactgctgggtgggacacccggattacggaggatgacctgcacaatgaagagaaaatcacacagcagatggatccagagcacagacaattagccaacgcaatattcaagctgacctaccagaataaagtggtcaaggtgcagaggcctactcccacaggaaccgtaatggacattatctcccgcaaggatcagcgtggctcaggccaagttgggacttatggattgaacacctttacaaatatggaagcgcagctcatccggcagatggagggtgaaggcgtgctgagcaaagccgacctagagaacccacatcttcccgaaaagaaaattacgcagtggctggagaccaagggggtcgagagactcaaaaggatggctatatcgggagatgactgcgtggtgaagcctatcgatgaccgcttcgccaacgcactgttggctttaaatgatatgggcaaggtccgaaaagacattccacaatggcagccgtctaagggttggcacgattggcagcaggttcccttttgtagtcatcacttccacgaactgatcatgaaagacgggcggaagctcgtggtaccttgcagaccacaagacgagcttattggaagggcccgcatctcccagggcgcaggctggagcctgaaagaaactgcctgtctagggaaggcgtacgctcagatgtggtcactgatgtatttccatagacgggatctcaggttggcctccaacgcaatatgctctgccgtgcccgtccactgggtgcctacaagccgtaccacttggagtatccatgctcaccatcaatggatgacaaccgaggacatgctgacggtttggaatcgagtgtggattgaagataacccatggatggaggacaagacacccgtcaccacttgggagaatgtgccttaccttggaaaacgcgaagatcagtggtgtggttccctgatcggcctcaccagcagagccacatgggcacagaacattccgactgctatccagcaagtacggtctttaattgggaatgaggaatttctggactacatgccatcaatgaagaggttccgcaaagaggaggaaagtgagggagccatatggtga

SEQ ID NO: 15342 - RNA, 9873 nt, synthetic construct
  misc_feature 1..9873: note = derived and/or modified CDS sequence (opt3) from DENV-3__KF973485__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataaaaaggagcttctggtgacttttaaaaacgcacacgctaagaagcaagaagtagttgtgttgggctcccaggagggagccatgcacacagctctcaccggcgccacagaaattcagaattcagggggaactagtatattcgcaggtcatctgaaatgtaggttaaagatggacaaactggagctaaagggcatgagctacgccatgtgcaccaacacgtttgtcctcaaaaaggaggtgtctgaaacccagcacgggacaatcctgattaaggtcgagtacaaaggagaagatgtgccctgtaagatccctttctccactgaggacggccaaggtaaagctcataacgggcggcttataaccgcgaatccagttgtgacaaagaaagaggaacccgtaaacattgaggcagaaccgcctttcggcgagtcaaatatcgtcatcggaattggcgataacgccttgaagatcaattggtataagaaagggagcagtattggaaagatgtttgaagctactgcccgtggtgcacgcagaatggccatactgggcgacaccgcttgggatttcgggtctgtgggaggcgttctcaactccctgggtaaaatggtgcaccagatctttgggagcgcctacacggcacttttctcgggcgtctcttgggtgatgaagattggaatcggcgtactgttgacatggatcgggctcaattccaaaaacacctcaatgagttttagctgcattgcgataggaatcattactctgtatttaggcgctgtggttcaggccgacatgggttgtgtcatcaattggaaggggaaggagctgaaatgcggatccggcattttcgtgacaaacgaggtgcatacctggactgaacagtacaagtttcaagcagattctcccaaaaggctagccaccgctatcgccggtgcatgggagaatggcgtctgtgggatacggagcacaacgcgaatggaaaacctcctgtggaagcagatcgctaatgagcttaactatattttgtgggaaaataacatcaaactgaccgttgtggtgggagacattatcggcgtactcgagcaggggaagcgcactctgacaccacagcctatggagttaaaatactcatggaagacctggggaaaggccaaaatagtcacagcggaaactcaaaacagttccttcattatcgatggccccaataccccagagtgccccagcgtgtctagagcctggaacgtttgggaagtggaggactatggttttggggtcttcacgacaaatatttggctgaagcttagggaagtgcacacccagttgtgtgaccaccggctcatgtcagctgcagttaaagatgagcgcgccgtgcatgctgacatgggatactggatcgagagtcagaagaacggcagctggaaactggaaaaggcctccctaatagaggtaaagacttgcacctggcctaaatctcacacactgtggtcgaatggtgtcctcgaaagcgatatgatcattccaaagtccctggcaggcccgatctcacagcataaccacagacccgggtaccacactcaaaccgcgggaccttggcatcttggcaaattggagctggactttaattattgcgaggggacaacggtggtgattaccgaaaactgtggaactaggggcccaagtttacgtacaaccactgtctctggtaagctcatccacgagtggtgctgtcggagctgcacactgccccctcttcgatacatgggggaagatggatgttggtatggcatggagataagaccaatttccgaaaaagaggagaatatggttaagtcactggtgagcgccggttctggcaaggtagacaacttcaccatgggggtgttgtgcctcgctatcctgtttgaagaggtcatgaggggaaaattcggcaagaaacatatgatcgccggggtgttctttacgttcgttctactgctctccggacagattacttggcgcgatatggcacacaccctgatcatgattggcagtaatgctagcgaccggatgggtatgggggtgacataccttgccttgatagcaacctttaagatccagcccttcctggccttaggatttttcctcagaaaactgacttctagggaaaaccttctgctaggcgtcggcctcgctatggcgacaaccctgcaattgccggaggatattgaacagatggccaatgggatcgcactgggattaatggctctcaagctgattacacagtttgagacttatcagctttggaccgccctgatctccttgacgtgttcaaacacaatattcaccctcactgtggcctggcgcaccgctacactgatcctagcaggtgttagtctgcttcctgtgtgccaaagctcgtccatgcgaaagactgactggctcccaatggccgtcgcggctatgggcgtaccccctctgcccttgtttattttcgggctgaaagataccttaaagcggcgttcttggccactcaatgagggagtgatggccgttggcctggtgagcatccttgcatcaagtctgttgagaaacgacgtccctatggccggtcccctcgtggctgggggactgctaattgcatgttacgtaatcacgggcacatccgccgatctgaccgtggaaaaagcggctgacataacttgggaggaagaggccgaacagacaggcgtctctcataaccttatgattaccgttgacgatgacgggactatgaggatcaaggatgacgagacagagaatatcctcaccgtgctgttgaaaacggcattactgattgtgagcggaatatttccatattccatcccggccactctcctggtctggcacacctggcagaagcagacacaacgctcaggtgtgctttgggatgttcctagccccccagaaacccagaaagctgagctggaagagggcgtataccggattaagcagcaggggatcttcggaaagacacaagtgggcgtcggtgtgcagaaagagggggtttttcacactatgtggcatgtgaccagaggagccgtcttgacgtacaacggcaagaggctagaacccaattgggcaagtgtgaaaaaggacctgatttcttatggcgggggatggcgactctccgctcagtggaaaaagggtgaggaagtacaagtcatcgccgtggagcctggcaagaacccaaaaaatttccagacaatgcccgggactttccagaccacaaccggagaaataggcgcgatcgccctggattttaagcctggtactagcgggtcgccgattatcaaccgcgagggaaaagttgtgggcctttacggcaatggggtcgtgaccaagaacggaggttatgtttcaggcattgcacagacaaatgctgagccagacgggcccacgcctgaattagaggaagagatgttcaaaaagcggaacctgactatcatggatctccacccaggatctggcaagaccagaaaatacttgcccgccatagtgagggaagctattaagcgtcgcctgcggacactcatcctggcacctaccagagtcgtggccgccgagatggaggaagctcttaaaggtctgccgatcaggtatcaaactacagcgaccaagagtgagcatacggggcgagaaattgtagacttgatgtgccacgcaacttttacaatgcggctactgtcccccgtgcgcgttccaaattacaacctcatcataatggatgaggcccatttcaccgaccctgctagcattgccgcaagaggatatatctctaccagggtcggcatgggcgaagccgctgcgatttttatgactgccacacccccagggaccgcagatgctttccctcagagcaatgcccccatccaggacgaggagcgggacataccagaacgatcctggaactcaggaaatgagtggattacagattttgcaggtaaaactgtgtggttcgtgccgagtatcaaggccggcaacgacatcgctaactgtttaagaaagaatgggaaaaaggtcattcagctgagccgcaaaacgtttgataccgaataccaaaagacaaaacttaacgactgggatttcgtagtgactaccgacatctctgagatgggagccaattttaaggcggatagggttattgaccctcgtcggtgcctgaagcccgtgatactcacagatggcccagagagagtcatcttggcaggtcccatgcctgtgaccgttgcctccgctgcccagaggcgcgggcgagtgggcagaaacccacagaaagaaaatgaccagtacattttcactggacaacccctgaacaatgatgaggaccacgctcactggacggaagcaaagatgctcctggacaacatcaatacccctgagggcatcattccggcccttttcgaaccagagcgggagaaatcagctgccatagatggggaatataggctaaagggagagagtcgcaaaacatttgtcgaactgatgcgtagaggtgacttgcccgtgtggttagcacataaggtagcgagcgagggcatcaaatacactgatcggaagtggtgcttcgacgggcagaggaacaatcagattctggaagagaacatggatgtggagatctggaccaaggaaggagagaaaaagaaactccgccctcgatggctggacgccagaacatattccgatccccttgctctgaaggaatttaaagagttcgccgcaggccggaagtctattgctctcgacttggttaccgaaatcggtagggtcccatcgcacctggcccatcgcactagaaatgcactagataacctggtgatgctccacacaagcgagcacgggggcagggcctaccggcatgctgtggaggaacttcctgagacgatggaaaccctgttattgctgggactcatgatactgcttactggcggggcgatgctgtttctcatctcaggaaagggtattggcaaaacatccatcgggttgatttgtgtcatcgccagttctggaatgctgtggatggcagagatacccttacagtggattgctagcgccatcgttctagagttctttatgatggtgctgctcattccagaacctgagaagcaacgtaccccgcaggacaatcagcttgcctatgtagtgatcggcatactgaccttggcagctatcattgccgcgaacgaaatgggtctgctcgagacaactaaacgcgatctggggatgtccaaggaacccggcgtcgtgtcaccaacgtcttaccttgacgttgatctccaccctgctagcgcctggaccctgtatgcagtggccacaactgtcatcacccccatgttgcgacatacaattgagaatagtaccgctaacgtatccctggcagccatcgcgaaccaagctgtggttttaatgggactagacaaaggctggccaataagcaagatggacctgggggtgcctctccttgccctgggatgctactctcaggtcaatcccttgactctgacggcagccgtgctcctgcttattacacactacgctatcatcggcccgggtttacaggccaaggcaaccagagaggctcagaaaaggactgccgcggggattatgaagaacccaaccgtcgatggaatcatgacaatagacctggatcctgtgatttatgactcaaaattcgaaaagcaactcggccaggttatgttgctggtgctatgtgtagtgcagctgctccttatgcggacttcctgggccctgtgcgaggcattgaccctggctacaggtcccatcacgaccctctgggaaggcagtccagggaaattttggaatactacaattgccgtcagcatggcaaacatcttccgcggatcgtacctggctggcgccgggttagccttttctataatgaagtccgttggaaccggcaagagaggtactgggagccagggagagacacttggcgaaaaatggaagaaaaagctgaatcaactctcaaggaaagatttcgacctatataagaaaagtggtatcaccgaggtggatcggacggaggcgaaggaaggcctgaagcgaggggagattacccatcacgctgtctctagaggatccgcaaaattgcagtggtttgtggaacgcaacatggtaatccccgagggcagggtgattgacctggggtgtggacggggcggttggagctactattgcgccgggctcaagaaagttacagaagtgcgtggatacactaagggcggccctgggcacgaggagccggtccccatgtcaacctatggatggaatatcgtgaaacttatgagtggtaaggatgtcttctacctgccacctgaaaagtgtgacacattgctgtgcgatattggcgagagctccccctctcctactgtggaagagagcagaaccatcagggttctcaaaatggtagagccatggttaaagaacaatcagttctgtataaaagtgctgaacccctacatgcctacagtcattgaacatcttgagcgcctgcagcggaagcacgggggaatgctagtgcgaaatccactctccagaaactcaacccatgaaatgtattggatctctaatggcactggtaacatcgttgctagtgtgaatatggtctcgaggctgttgctgaaccgctttacgatgacacaccggagacccaccattgagaaagacgtggatctcggggccggaactcgtcacgtaaacgcagaaccggagacccctaatatggaggtgataggcgaaaggatcaagcggattaaggaggaacataacagcacatggcactacgacgacgagaatccatataaaacgtgggcctaccatggctcctatgaagttaaggctaccgggtctgcgtcaagcatgatcaacggagtcgtgaaacttctgactaagccctgggatatggtgcctatggtcacacaaatggccatgaccgacactacaccattcggtcagcagcgcgtttttaaagagaaggtggatacccgaacacccagatccatgccgggcactaggcgggtaatggggattaccgcagagtggttatggcgcacgctgggaagaaataagaaacctaggttgtgcacccgagaagagttcacaaagaaagtgcggactaacgctgccatgggcgcagtctttaccgaagagaatcaatgggacagtgccaaggctgccgtggaagatgaggacttctggaaactcgttgatcgtgagagagaactgcacaagctaggtaaatgtgggtcttgcgtgtacaacatgatgggaaagcgcgagaagaaacttggcgaatttggcaaggcgaaagggagcagggcaatctggtatatgtggctgggagcccggtacctcgagttcgaggctctgggttttttgaatgaagaccattggttctcaagagagaactcctacagtggcgtcgaaggggagggactgcacaagctcggctatatacttcgcgatatcagcaaaattcccggtggggccatgtacgcagacgatacagctggatgggacactaggatcaccgaagacgatctgcacaatgaggagaagattacgcagcagatggacccagaacatcgacagttagccgatgctatctttaagctgacatatcaaaacaaagtggtaaaggttcagcggcctacccccactggcacagtgatggacataatttctagaaaagatcagaggggctccgggcaggtcggaacctacggtttgaatactttcaccaacatggaggcccaactcatccgccagatggaaggcgagggggtgctgtcaaaggcagacctagaaaatccacaccttcccgagaaaaagatcacacagtggctggagacgaagggagtggaacgtctcaaacggatggcgattagcggcgatgactgcgtcgttaagcctatagatgacagatttgccaacgctctgttggccttaaacgatatgggtaaagtgaggaaggacatcccacagtggcaaccgtcgaaagggtggcatgattggcagcaggtacccttctgttctcaccacttccatgagctgattatgaaggacggacgcaagctcgtggtcccttgccgaccacaggacgaacttatcggccgggcaagaattagtcaaggcgctgggtggtccctgaaagagaccgcctgtctaggaaaggcatatgcccagatgtggagcctgatgtactttcacaggcgcgatctcagattggcgtcaaatgctatctgctccgccgtgcccgttcattgggtgcctacttctcggacaacctggagcatacacgcacatcaccagtggatgactacagaagacatgctgaccgtctggaacagggtgtggatcgaggataatccatggatggaggacaaaacgcccgtaacaacctgggaaaacgttccttatcttggtaagcgtgaggatcaatggtgtggcagtctgattgggctcacttcccgagccacctgggctcagaatatcccgacagccattcagcaggtgcgcagcttaatcggaaacgaagagttcctggactacatgccatctatgaaaagatttcggaaggaggaagagtcagaaggcgcaatttggtga

SEQ ID NO: 15343 - RNA, 9873 nt, synthetic construct
  misc_feature 1..9873: note = derived and/or modified CDS sequence (opt3) from DENV-3__KF973486__SS-prME
  source 1..9873: mol_type = other RNA
accagcctgtgcctcatgatgatccttcccgcagctctggcattccacttgacatccagagacggcgaacctagaatgattgtggggaagaacgaacggggtaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagcatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccaaggtaaggctcataacgggcgtcttataaccgcgaatccagttgtgactaagaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgccggttctggcaaggtagacaacttcaccatgggggtgttgtgcctcgctatcctgtttgaagaggtcatgcgcggaaagttcggcaaaaagcacatgatcgccggggtgttctttacgttcgttctactgctctccggacagattacttggcgggatatggcacataccctgatcatgattggcagtaatgctagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagccggtgttagtctgcttcctgtgtgccaaagctcgtccatgcggaagactgactggctcccaatggccgtcgcggctatgggcgtaccccctctgcccttgtttattttcgggctgaaggataccttaaaacgtagatcttggccactcaatgagggagtgatggccgttggcctggtgagcatccttgcatcaagtctgttgaggaacgacgtccctatggccggtcccctcgtggctgggggactgctaattgcatgttatgtaatcacgggcacatccgccgatctgaccgtggaaaaggcggctgacataacttgggaggaagaggccgaacagacaggcgtctctcacaaccttatgattaccgttgacgatgacgggactatgcgcatcaaagatgacgagacagagaatatcctcaccgtgctgttgaagacggcattactgattgtgagcggaatatttccatactccatcccggccactctcctggtctggcatacctggcagaaacagacacaacggtcaggtgtgctttgggatgttcctagtcccccagaaacccagaaggctgagctggaagagggcgtatacagaattaaacagcaggggatcttcggaaagacacaagtgggcgtcggtgtgcagaaggagggggtttttcacactatgtggcacgtgaccaggggagccgtcttgacgtataacggcaaacgactagaacccaattgggcaagtgtgaagaaagacctgatttcttacggcgggggatggcgcctctccgctcagtggcaaaagggtgaggaagtacaggtcatcgccgtggagcctggcaaaaacccaaagaatttccagacaatgcccgggactttccagaccacaaccggagaaataggcgcgatcgccctggattttaagcctggtactagcgggtcgccgattatcaaccgggagggaaaagttgtgggcctttatggcaatggggtcgtgaccaagaacggaggttacgtttcaggcattgcacaaacaaatgctgagccagacgggcccacgcctgaattagaggaagagatgttcaaaaagagaaacctgactatcatggatctccatccaggatctggcaaaaccaggaagtatttgcccgccatagtgcgtgaagctattaagcgccggctgagaacactcatcctggcacctaccagggtcgtggccgccgagatggaggaagctcttaaaggtctgccgatccgataccagactacagcgaccaagagtgagcacacggggcgggaaattgtagacttgatgtgccatgcaacttttacaatgcgcctactgtcccccgtgagagttccaaattataacctcatcataatggatgaggcccacttcaccgaccctgctagcattgccgcaaggggatacatctctacccgggtcggcatgggcgaagccgctgcgatttttatgactgccacacccccagggaccgcagatgctttccctcagagcaatgcccccatccaggacgaggagcgagacataccagaaagatcctggaactcaggaaatgagtggattacagattttgcaggtaaaactgtgtggttcgtgccgagtatcaaggccggcaacgacatcgctaactgtttacgcaaaaatgggaagaaggtcattcaactgagcaggaaaacgtttgataccgaataccagaagacaaaacttaacgactgggatttcgtagtgactaccgacatctctgagatgggagccaattttaaggcggatcgtgttattgaccctcggagatgcctgaaacccgtgatactcacagatggcccagagagggtcatcttggcaggtcccatgcctgtgaccgccgcttccgccgctcagcgccgagggagagttggccggaacccacagaaggaaaatgaccaatatattttcactggacagcccctgaacaatgatgaggaccatgcacactggacggaagccaagatgctcctggacaacatcaatacccctgagggcatcattccggctcttttcgaaccagagagggagaaatcagccgcaatagatggggaataccgcctaaagggagagagtcgtaaaacatttgtggaactgatgagacggggtgacttgcccgtctggttagcgcacaaggtggccagcgagggcatcaaatatactgataggaagtggtgcttcgacgggcagcgcaacaatcagattctggaagagaacatggatgtagagatctggaccaaagaaggagagaagaagaaactccgacctagatggctggacgctcggacatactccgatccccttgccctgaaggaatttaaagagttcgcagctggcaggaagtctattgccctcgacttggtgaccgaaatcggtcgcgttccatcgcatctggcacacagaactaggaatgccctagataacctggtcatgctccatacaagcgagcacgggggccgggcttatcgtcacgcggtggaggaacttcctgagacgatggaaaccctgttattgctgggactcatgatactgcttactggcggggccatgctgtttctcatctcaggaaaaggtattggcaagacatccatcgggttgatttgtgtgatcgcaagttctggaatgctgtggatggctgagatacccttacaatggattgccagcgccatcgtcctagagttctttatgatggttctgctcattccagaacctgagaagcagcgcaccccgcaggacaatcaacttgcatacgtggtaatcggcatactgaccttggctgccatcattgcggctaacgaaatgggtctgctcgagacaactaaacgagatctggggatgtccaaggaacccggcgtggtctcaccaacgtcttatcttgacgtggatctccatcctgccagcgcatggaccctgtacgccgttgctacaactgtgatcacccccatgttgagacacacaattgagaatagtaccgcaaacgtctccctggccgcgatcgctaaccaggccgtagtgttaatgggactagacaaaggctggccaataagcaagatggacctgggggcacctctccttgccctgggatgctactctcaggttaatcccttgactctgacggctgccgtgctcctgcttattacacattatgcaatcatcggcccgggtttacaggctaaagccaccagggaggcgcaaaagcggactgccgcagggattatgaagaacccaaccgtcgatggaatcatgacaatagacctggatcctgtgatttacgactcaaaattcgaaaagcagctcggccaggtcatgttgctggtgctatgtgctgttcagctgctccttatgcgcacttcctgggccctgtgcgaggcattgaccctggctacaggtcccatcacgaccctctgggaaggcagtccagggaaattttggaatactacaattgccgtgagcatggccaacatcttcagaggatcgtatctggcgggcgctgggttagcattttctataatgaagtccgtaggaaccggcaaaaggggtactgggagccaaggagagacacttggcgaaaagtggaagaaaaagctgaatcagctctcacggaaagatttcgacctatacaagaaaagtggtatcaccgaggtggatcgaacggaggccaaggaaggcctgaaaagaggggagattacccaccatgctgtctctcgcggatccgccaagttgcagtggtttgttgaaaggaacatggtgatccccgagggccgggtcattgacctggggtgtggacgtggcggttggagctattactgcgcagggctcaagaaagtgacagaagtaagaggatatactaagggcggccctgggcacgaggagccggtgcccatgtcaacctacggatggaatatcgttaaacttatgagtggtaaggatgtgttctacctgccacctgaaaaatgtgacacattgctgtgcgatattggcgagagctccccctctcctactgtcgaagagagcaggaccatccgcgtgctcaagatggtcgagccatggttaaagaacaatcagttctgtataaaagtgctgaacccctatatgcctacagttattgaacaccttgagcggctgcaacgaaagcatgggggaatgctagtaagaaatccactctccaggaactcaacccacgaaatgtactggatctctaatggcactggtaacatcgtggccagtgtcaatatggtgtcgcgcctgttgctgaaccggtttacgatgacacatagacgtcccaccattgagaaagacgttgatctcggggctggaactaggcacgtgaacgcggaaccggagacccctaatatggacgtcataggcgagcggatcaagcgcattaaagaagaacacaacagcacatggcattatgacgatgaaaatccatacaagacgtgggcctatcacggctcctacgaggtgaaggcaaccgggtctgcttcaagcatgatcaacggagtagtgaaacttctgactaagccctgggacgttgtccctatggtgacacagatggccatgaccgatactacaccattcggtcagcaacgagtgtttaaagaaaaggtcgacaccagaacacccaggtccatgccgggcactcggcgcgttatggggattaccgcagagtggttatggagaacgctgggaaggaataaaaagcctcgattgtgcacccgggaggagttcacaaagaaagtgcgtactaacgccgctatgggcgccgtatttaccgaggaaaatcagtgggatagtgcgaaggcagccgtggaggacgaagatttctggaaactcgtcgacagagagcgcgagctgcataagctaggtaaatgtgggtcttgcgtgtataacatgatgggaaagagggagaagaaacttggcgagtttggcaaagctaaagggagccgggccatctggtacatgtggctgggagcaagatacctcgagttcgaggctctgggatttttgaatgaggatcactggttctcacgcgaaaactcctatagtggcgttgagggggaaggactgcataagctcggctacatacttagggacatcagcaaaattcccggtggggccatgtatgctgatgacacagccggatgggacactcgaatcaccgaggatgacctgcacaatgaagagaagattacgcagcagatggatccagagcaccggcaattagcaaacgcgatctttaaactgacataccagaataaggtggtcaaggtgcagagacctacccccactggcacagtaatggacataatttctaggaaagatcagcgcggctccgggcaagttggaacctatggtttgaacactttcaccaatatggaagcccagctcatccgtcagatggagggcgaaggggtgctgtcaaaggctgacctagagaacccacatcttcccgagaaaaagatcacacagtggctggagacgaaaggagtcgagcggctcaagagaatggccattagcggcgatgactgcgtggtgaagcctatagatgacaggtttgcaaacgctctgttggccttaaatgatatgggtaaagtccgcaaggacatcccacaatggcagccgtcgaaagggtggcacgattggcagcaggttcccttctgttctcatcacttccacgaactgattatgaaggacggacgaaaactcgtggtaccttgccggccacaagacgagcttatcggcagagcaaggattagtcagggcgccgggtggtccctgaaggaaaccgcgtgtctaggaaaggcttacgcccagatgtggagcctgatgtattttcatcgcagagatctccggttggcatcaaacgccatctgctccgctgtgcccgtccactgggtgcctacttctaggacaacctggagcatacatgcccaccatcaatggatgactacagaggacatgctgaccgtttggaatcgtgtgtggatcgaagataacccatggatggaggacaaaacgcccgtcacaacctgggagaatgtgccttaccttggtaagcgagaagatcagtggtgtggcagtctgattgggctcacttcccgcgcaacctgggctcagaacatcccgacagccattcagcaagtaaggagcttaatcggaaatgaggagttcctggactacatgccatctatgaaacggtttaggaaggaggaggaatcagagggcgcgatttggtga

SEQ ID NO: 15344 - RNA, 9873 nt, synthetic construct
  misc_feature 1..9873: note = derived and/or modified CDS sequence (opt3) from DENV-3__FJ898458__SS-prME
  source 1..9873: mol_type = other RNA
accagcctgtgcctcatgatgatccttcccgccgctctggcattccacttgacatccagagacggcgagcctaggatgattgtggggaagaacgaacggggaaaaactttactgtttaagacggcctctggtataaatatgtgtaccctaatcgcgatggatctcggcgagatgtgcgacgatacagtcacttacaaatgtccacatattaccgaagttgagccggaagacatcgattgctggtgtaacctgacatcaacctgggtgacttatgggacatgcaatcaggctggagagcaccgccgagacaagcgtagtgtagcccttgcaccccatgtgggcatgggtctggataccagaacgcaaacttggatgagcgccgagggggcttggaggcaggtcgaaaaagtggagacctgggcattgcggcaccctggattcacaattctcgccctgtttctggctcattacatcggcacttccctcacccagaaggttgtgatattcatcttactgatgcttgtcacaccatctatgaccatgcgctgtgtgggcgtagggaacagagactttgttgaaggattgtcgggtgccacgtgggtggatgtcgtgctggagcacggcgggtgcgtgactacaatggcgaagaataaacccaccctagacattgagctccagaagactgaagcaacacaactggccacccttaggaaactgtgtatcgagggaaagattacgaacatcaccacagattcacggtgccctactcagggcgaagctgtcttgccagaggaacaggaccagaattatgtttgtaaacacacctacgtggatcgcggttgggggaacggatgcggcctcttcggcaaggggagcctggtaacatgcgccaagtttcaatgtttagagcccatagagggaaaagtggtccagtatgaaaatctgaagtacactgtgattatcaccgttcatacaggtgaccagcaccaggtgggcaacgagacccaaggggtcactgcagaaattacgcctcaggctagtacaaccgaggccatcctcccagaatatggaactcttggcctggagtgctccccgcgaaccggtttggacttcaatgagatgatcctactgacaatgaaaaacaaggcgtggatggtgcatagacagtggtttttcgatctccccctgccttggacctctggggccactacagaaacgccaacctggaataggaaagagcttctggtaacttttaagaacgcacacgctaaaaagcaagaagttgtggtcttgggcagccaggagggagccatgcacacagctctcaccggcgccacagaaattcagaattccgggggaacttcaatattcgcaggtcatctgaagtgtcggttaaaaatggacaagctggagctaaaaggcatgagttacgccatgtgcaccaacacgtttgtgctcaagaaagaggtcagcgaaacccagcacgggacaatcctgattaaggtggagtacaagggagaagatgttccctgtaaaatccctttctctactgaggacggccatggtaaggctcacaacgggcgtcttataaccgcgaatccagtggtaacaaaaaaggaggaacccgtcaacattgaggcagaaccgcctttcggcgagtccaatatcgtgatcggaattggcgataacgccttgaaaatcaattggtataagaaggggtcaagcattggaaaaatgtttgaagctactgcccgcggtgcaagaaggatggccatactgggcgacaccgcttgggatttcgggagtgttggaggcgtgctcaactctctgggtaagatggtccatcaaatctttgggtccgcctacacggcacttttcagcggcgtgtcgtgggtaatgaaaattggaatcggcgtgctgttgacatggatcgggctcaattctaagaacacctccatgtcatttagttgcattgcgataggaatcattactctgtatttaggcgctgttgtccaggccgacatgggttgtgtgatcaattggaaagggaaggagctgaagtgcggaagcggcattttcgtgacaaacgaggtccacacctggactgaacagtacaaatttcaggcagattcccccaagcggctagccaccgctatcgccggtgcatgggagaatggcgtttgtgggatacgatctacaacgcgcatggaaaacctcctgtggaaacaaatcgctaatgagcttaactatattttgtgggaaaataacatcaagctgaccgtggtggtaggagacattatcggcgtcctcgagcaggggaaaagaactctgacaccacagcctatggagttaaagtacagctggaaaacctggggaaaggccaagatagtgacagcggaaactcagaactcaagtttcattatcgatggccccaataccccagagtgcccctccgccagcagggcttggaacgtttgggaagtggaggactatggttttggggtcttcacgacaaatatttggctgaaacttcgggaagtgtacacccaattgtgtgaccaccgcctcatgtctgcagccgttaaggatgagagagctgtgcatgccgacatgggatactggatcgagtcacagaaaaacggcagttggaagctggaaaaagcaagcctaatagaggtaaagacttgcacctggcctaagtcccacacactgtggtctaatggtgtcctcgaatcggatatgatcattccaaaaagcctggcgggcccgatctcccagcataaccacaggcccgggtatcacactcagaccgccggaccttggcatcttggcaagttggagctggactttaattactgcgaggggacaacggtggtgattaccgaaaactgtggaactcgtggcccatcattacggacaaccactgtcagtggtaaactcatccacgagtggtgctgtcgatcttgcacactgccccctcttagatatatgggggaagatggatgttggtacggcatggagataaggccaattagcgaaaaggaggagaatatggttaaatccctggtgtcagctggtagcggcaaggtagacaacttcaccatgggggtgttgtgcctcgccatcctgtttgaagaggtcatgcgcggaaagttcggcaaaaagcatatgatcgcaggggtgttctttacgttcgttctactgctctctggacaaattacttggcgggatatggctcacaccctgatcatgattggctccaatgccagtgacagaatgggtatgggggtgacatatcttgcattgatagccacctttaaaatccagcccttcctggctttaggatttttcctcaggaagctgactagccgcgaaaaccttctgctaggcgtcggcctcgcgatggccacaaccctgcagttgccggaggatattgaacaaatggcaaatgggatcgctctgggattaatggccctcaaactgattacacagtttgagacttaccagctttggaccgccctgatctctttgacgtgttccaacacaatattcaccctcactgtggcttggcgaaccgcaacactgatcctagccggtgtttcactgcttcctgtgtgccagagtagctcgatgcggaagactgactggctcccaatgaccgtcgcggctatgggcgtaccccctctgcccttgtttattttctccctgaaggatacgttaaaacgtagatcttggccactcaatgagggggtgatggccgttggactggtgagcatccttgcatcaagtctgttgaggaacgacgtccctatggccggccccctcgtggctggtgggctgctaattgcatgttatgtaatcacaggaacctccgccgatctgactgtggaaaaggcggctgacataacatgggaggaagaggccgaacaaaccggcgtctctcataaccttatgattactgttgacgatgacggcacaatgcgcatcaaagatgacgagaccgagaatatcctcacggtgctgttgaagactgcattactgattgtgagcgggatatttccatactccatcccggccaccctcctggtctggcacacatggcagaaacagacccagcggtcaggagtgctttgggatgttcctagccccccagaaacacaaaaggctgagctggaagagggtgtatacagaattaaacagcagggcatcttcgggaagactcaggtgggagtcggcgtgcaaaaggagggtgtttttcacaccatgtggcatgtgacgaggggggccgtcttgacatataacggaaaacgactagaacccaattgggcaagtgtgaagaaagacctgatttcttacggcggcgggtggcgcctctccgctcagtggaagaaaggagaggaagtacaggtcatcgccgtggagcctggtaagaacccaaagaatttccaaactatgcccggcaccttccagacaaccactggggaaataggagcgatcgccctggattttaaacctggcaccagcggttcgccgattatcaaccgggaggggaaggttgtgggactttatggcaatggcgtcgtgacaaaaaacgggggatacgtttcaggtattgcacagacgaatgctgagccagacggccccactcctgaattagaggaagagatgttcaagaaaagaaacctgaccatcatggatctccacccagggtctggaaagacaaggaagtatttgcccgccatagtgcgtgaagctattaaacgccggctgagaaccctcatcctggcacctactagggtcgtggccgccgagatggaggaagctcttaagggcctgccgatccgataccagacaaccgcgacgaaaagtgagcatactggtcgggaaattgtagacttgatgtgccacgcaacatttaccatgcgcctactgtcccccgtgagagttccaaattataacctcatcataatggatgaggcccatttcaccgaccctgctagcattgccgcaagggggtacatctctactcgggtcggaatgggcgaagccgctgcgatttttatgacagccacccccccaggcacagcagatgctttccctcaaagcaatgcccccatccaggacgaggagcgagacataccagaaagatcctggaactcagggaatgagtggattactgattttgcaggaaagacggtgtggttcgtgccgagtatcaaagccggtaacgacatcgctaactgtttacgcaagaatggcaagaaagtcattcagctgagcaggaagacctttgatacagaataccagaaaactaagcttaacgactgggatttcgtagtgaccacagacatctctgagatgggggccaattttaaagcggatcgtgttattgaccctcggagatgcctgaagcccgtgatactcaccgatggaccagagagggtcatcttggcaggccccatgcctgtgactgccgcttccgccgctcaacgccgaggtagagttgggcggaacccacagaaggaaaatgaccagtatattttcacgggccagcccctgaacaatgatgaggaccacgcacactggaccgaagccaaaatgctcctggacaacatcaatacacctgagggaatcattccggctcttttcgaaccagagagggagaagtcagccgcaatagatggcgaataccgcctaaaaggggagagtcgtaagacttttgtggaactgatgagacggggagacttgcccgtctggttagcgcataaagtggccagcgagggtatcaagtataccgataggaaatggtgcttcgacggccaacgcaacaatcagattctggaagagaacatggatgtagagatctggacaaaggaaggggagaagaaaaagctccgacctagatggctggacgctcggacctactccgatccccttgccctgaaagaatttaaggacttcgcagctggaaggaaatctattgccctcgatttggtgactgagatcggccgcgttccatcgcacctggcacatagaacaaggaatgccctagacaacctggtcatgctccacacgagcgaacacggtgggcgggcttatcgtcatgcggtggaggagcttcctgaaaccatggagactctgttattgctgggcctcatgatactgcttacaggaggcgccatgctgtttctcatctcagggaagggaattggtaagacctccatcggcttgatttgtgtgatcgcaagttctgggatgctgtggatggctgaaatacccttacagtggattgccagcgccatcgtcctagagttctttatgatggttctgctcattccagagcctgaaaaacagcgcaccccgcaagataatcagcttgcatacgtggtaatcggaatactgacattggctgccatcattgcggctaacgagatgggcctgctcgaaactacgaagcgagacctgggtatgtccaaagagcccggggtggtctcaccaacctcttatcttgatgtggacctccaccctgccagcgcatggacactgtacgccgttgctactaccgtgatcacacccatgttgagacataccattgaaaatagtactgcaaacgtctccctggccgcgatcgctaaccaggccgtagtgttaatgggcctagacaagggatggccaataagcaaaatggatctgggcgttcctctccttgcactggggtgctactctcaagtgaatcccttgacgctgacagccgctgtcctcctgcttattacccactatgccatcatcggaccgggcttacaggcaaaggctactagggaggcccagaagcggaccgcggccggtattatgaaaaacccaacagtggacgggatcatgactatagatctggaccctgtcatttacgattcaaagttcgagaaacagctcggacaagtgatgttgctggttctatgtgcagtgcagctgctccttatgcgcacctcctgggctctgtgcgaagccttgacactggcaacgggccccatcaccactctctgggagggtagtccaggcaagttttggaatacaaccattgctgtaagcatggccaacatcttcagagggtcgtatctggccggagcgggcttagctttttctataatgaaatccgtggggactggaaagaggggcacaggtagccagggggaaacccttggagagaagtggaaaaagaaactgaatcagctctcacggaaggaattcgacctatacaaaaagagtggcatcacggaggtcgatcgaaccgaggcaaaagaaggtctgaagagaggcgagattacacatcacgccgtttctcgcgggtccgctaagttgcaatggtttgtggaaaggaacatggtcatccccgagggacgggtgattgacctgggctgtgggcgtggaggctggagctattactgcgccggtctcaaaaaggtaactgaagtgagagggtataccaaaggaggccctggccacgaggagccggttcccatgtcaacatacgggtggaatatcgtgaagcttatgagtggaaaagatgtcttctacctgccacctgaaaagtgtgacactttgctgtgcgatattggtgagagctccccctctcctaccgtggaagagagcaggacaatccgcgtcctcaagatggtggagccatggttaaaaaacaatcagttctgtataaaggttctgaacccctatatgcctaccgtaattgaacatcttgagcggctgcagcgaaaacacggcgggatgctagtgagaaatccactctccaggaactcaactcatgaaatgtactggatctctaatggaacgggcaacatcgtcgcaagtgtgaatatggtttcgcgcctgttgctgaaccggtttacaatgacccacagacgtcccactattgagaaggacgtggatctcggtgccgggaccaggcacgtcaacgctgaaccggagacacctaatatggacgtgataggagagcggatcaaacgcattaaggaagagcataacagcacgtggcactatgacgatgaaaatccatacaagacctgggcgtatcatggctcctacgaggtaaaagccactggctctgcatcaagcatgatcaacggggtggttaagcttctgacaaaaccctgggacgtcgtgcctatggtgacccagatggctatgactgatacaaccccattcggacaacagcgagtctttaaggaaaaagttgacacaagaactcccaggtccatgccgggtacccggcgcgtgatgggcattacggccgagtggttatggagaaccctggggaggaataagaagcctcgattgtgcacacgggaggaattcactaaaaaggtacgtaccaacgcagccatgggagctgtgtttacagaggaaaatcagtgggatagtgccaaagcggcagtcgaggacgaagatttctggaagctcgtggacagagagcgcgagctgcacaaactaggcaagtgtggttcttgcgtttataacatgatggggaaaagggaaaagaagcttggagagtttggcaaagccaagggcagccgggctatctggtacatgtggctgggggccagatacctcgaattcgaggcactgggatttttgaatgaggatcattggttctcacgcgaaaactcctatagtggtgtggagggcgaagggctgcacaaactcggatacatacttagggacatcagcaagattcccggcggtgctatgtatgccgatgacactgctgggtgggacacccgaatcacggaggatgacctgcacaatgaagagaaaattacacaacagatggatccagagcatcggcagttagccaacgcaatctttaagctgacctaccagaataaggtcgtgaaagtacaaagacctactcccacaggaaccgttatggacataatttctaggaaggatcagcgcggctccggccaggtggggacttatggattgaacaccttcacaaatatggaagcgcagctcatccgtcaaatggagggtgaaggcgtcctgtcaaaagccgacctagagaacccacaccttcccgaaaagaaaatcacgcagtggctggagaccaagggggtggagcggctcaagagaatggctattagcggagatgactgcgtggtcaaacctatagatgacaggtttgccaacgcactgttggctttaaatgatatgggcaaggttcgcaaagacatcccacagtggcagccgtcgaagggttggcatgattggcaacaggtgcccttctgttctcaccacttccatgaactgattatgaaagacgggcgaaagctcgtagtgccttgccggccacaggacgagcttatcggaagagccaggattagtcagggcgcaggctggtccctgcgcgaaactgcctgtctagggaaggcgtacgctcaaatgtggagcctgatgtattttcacagacgggatctcaggttggcctcaaacgcaatctgctccgccgtccccgtgcattgggttcctacatctcgtaccacttggagcatacacgctcatcaccagtggatgacaaccgaggacatgctgacggtgtggaatcgagtctggatcgaagataacccatggatggaggacaaaacacccgtgaccacttgggagaatgtaccttaccttggaaagcgcgaagatcagtggtgtggtagtctgattggcctcacctccagagccacatgggcacaaaacatcccgactgctattcagcaggttcggagcttaatcgggaatgaggaattcctggactacatgccatctatgaaaaggtttcgcaaggaggaggaatcagagggagccatttggtga

SEQ ID NO: 15345 - RNA, 9873 nt, synthetic construct
  misc_feature 1..9873: note = derived and/or modified CDS sequence (opt3) from DENV-3__KJ189256__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccatggtaaggctcacaacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccatcaaatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccacacatggaccgaacagtacaaatttcaggcagattctcccaagcggctagccactgctatcgccggtgcatgggagaatggcgtttgtgggatacgaagcaccacacgcatggaaaacctcctgtggaaacaaatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacagaacagttccttcattatcgatggccccaatactccagagtgccccagcgcctctagggcttggaacgtttgggaagtggaggactatggttttggggtcttcaccacgaatatttggctgaaacttcgggaagtgtacacacaattgtgtgaccaccgcctcatgtcagcagccgttaaggatgagagagctgtgcatgccgacatgggatactggatcgagagtcagaaaaacggcagctggaagctggaaaaagcatccctaatagaggtaaagacctgcacttggcctaagtctcacaccctgtggtcgaatggtgtcctcgaaagcgatatgatcattccaaaatccctggcgggcccgatctcacagcataaccacaggcccgggtatcacacacagactgccggaccttggcatcttggcaagttggagctggactttaattactgcgaggggaccacagtggtgattacggaaaactgtggaacccgtggcccaagtttacggactacaaccgtctctggtaaactcatccacgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcatatgatcgcaggggtgttctttaccttcgttctactgctctccggacaaattacgtggcgggatatggctcacactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcagttgccggaggatattgaacaaatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccagagctcgtccatgcggaagacagactggctcccaatggcggtcgctgccatgggcgtaccccctctgcccttgtttattttctctctgaaggatactttaaaacgtagaagctggccactcaatgagggggtgatggcagttggactggtgtcaatccttgccagttccctgttgaggaacgacgtccctatggctggccccctcgtggcaggtgggctgctaattgcctgttatgtaatcaccggaacgtctgcggatctgacagtggaaaaggctgccgacataacctgggaggaagaggcagaacaaactggcgtcagccataaccttatgattacagttgacgatgacggcaccatgcgcatcaaagatgacgagactgagaatatcctcacagtgctgttgaagaccgccttactgattgtgtccgggatatttccatactcaatcccggctacgctcctggtctggcacacttggcagaaacagacccagcggagcggagtgctttgggatgttcctagtcccccagaaacacaaaaggccgagctggaagagggtgtatacagaattaaacagcagggcatcttcgggaagacccaggtgggagtcggcgtgcaaaaggagggtgtttttcacacaatgtggcatgtgactaggggggcagtcttgacctataacggaaaacgactagaacccaattgggcttctgtgaagaaagacctgatttcctacggcggcgggtggcgcctcagcgcccagtggcagaagggagaggaagtacaagtcatcgcggtggagcctggtaaaaacccaaagaatttccagacgatgcccggcacattccagactaccacaggggaaataggagccatcgcactggattttaagcctggcacctcgggttcaccgattatcaaccgggaggggaaagttgtgggactttatggcaatggcgtcgtgactaagaacgggggatacgtttctggtattgctcagaccaatgccgagccagacggccccacacctgaattagaggaagagatgttcaaaaagagaaacctgacgatcatggatctccacccagggagtggaaaaactaggaagtatttgcccgctatagtgcgtgaagcaattaagcgccggctgagaaccctcatcctggcccctacaagggtcgtggccgctgagatggaggaagcgcttaaaggcctgccgatccgataccaaaccactgcaacaaagtccgagcataccggtcgggaaattgtagacttgatgtgccacgccacgtttactatgcgcctactgagccccgtgagagttccaaattataacctcatcataatggatgaggctcatttcacagaccctgcctctattgcagccagggggtacatcagcacccgggtcggaatgggcgaagctgcggccatttttatgaccgcaactcccccaggcacagctgatgccttccctcagtccaatgcacccatccaggacgaggagcgagacataccagaaagatcatggaacagtgggaatgagtggattaccgattttgccggaaaaacagtgtggttcgtgccgagcatcaaggctggtaacgacatcgccaactgtttacgcaaaaatggcaagaaggtcattcagctgtctaggaaaacttttgatacggaataccaaaagaccaaacttaacgactgggatttcgtagtgacaactgacatctccgagatgggggcgaattttaaggcagatcgtgttattgaccctcggagatgcctgaaacccgtgatactcaccgatggaccagagagggtcatcttggccggccccatgcctgtgacagctgcctcagctgcacagcgccgaggtagagttgggcggaacccacagaaggaaaatgaccagtatattttcaccggccaacccctgaacaatgatgaggaccacgcccactggactgaagctaagatgctcctggacaacatcaatacgcctgagggaatcattccggcccttttcgaaccagagagggagaaaagtgcagcgatagatggcgaataccgcctaaagggggagagccgtaaaacctttgtggaactgatgagacggggagacttgcccgtctggttagcccataaggtggcttccgagggtatcaaatatacagataggaagtggtgcttcgacggccagcgcaacaatcagattctggaagagaacatggatgtagagatctggactaaagaaggggagaagaagaaactccgacctagatggctggacgcccggacctactctgatccccttgcactgaaggaatttaaagacttcgctgccggaaggaagtcgattgcactcgatttggtgacagagatcggccgcgttccaagccacctggcccatagaaccaggaatgctctagacaacctggtcatgctccacacttcagaacacggtgggcgggcgtatcgtcatgccgtggaggagcttcctgaaacaatggagacgctgttattgctgggcctcatgatactgcttaccggaggcgcaatgctgtttctcatctccgggaaaggaattggtaagactagtatcggcttgatttgtgtgatcgcttctagcgggatgctgtggatggccgaaatacccttacagtggattgcctccgcaatcgtcctagagttctttatgatggttctgctcattccagagcctgaaaagcaacgcacaccgcaggataatcagcttgcttacgtggtaatcggaatactgaccttggccgcgatcattgctgccaacgagatgggcctgctcgaaaccacaaaacgagacctgggtatgtcaaaggagcccggggtggtctctccaactagctatcttgatgtggacctccaccctgcaagtgcctggacgctgtacgctgttgcaaccacagtgatcactcccatgttgagacataccattgaaaattccacagccaacgtcagcctggcggctatcgccaaccaagcagtagtgttaatgggcctagacaaaggatggccaatatctaagatggatctgggcgttcctctccttgccctggggtgctactcacaggtgaatcccttgaccctgactgctgccgtcctcctgcttattacgcactatgcaatcatcggaccgggcttacaggctaaagccacaagggaggcgcagaagcggaccgccgcaggtattatgaagaacccaactgtggacgggatcatgaccatagatctggaccctgtcatttacgattccaaattcgagaagcaactcggacaggtgatgttgctggttctatgtgctgtgcagctgctccttatgcgcacaagttgggccctgtgcgaagcattgactctggctaccggccccatcacaacgctctgggagggtagcccaggcaaattttggaataccactattgccgtatcgatggccaacatcttcagagggtcttatctggcgggagctggcttagcattttccataatgaagagcgtggggacaggaaaaaggggcaccggttcacagggggaaactcttggagagaagtggaagaaaaagctgaatcaactcagtcggaaagaattcgacctatacaagaaatctggcatcacagaggtcgatcgaaccgaggccaaggaaggtctgaaaagaggcgagattacgcatcacgctgtttcccgcgggagcgccaagttgcagtggtttgtggaaaggaacatggtcatccccgagggacgggtgattgacctgggctgtgggcgtggaggctggtcatattactgcgcaggtctcaagaaagtaaccgaagtgagagggtatacaaagggaggccctggccacgaggagccggttcccatgagtacttacgggtggaatatcgtgaaacttatgagcggaaaggatgtcttctacctgccacctgaaaaatgtgacaccttgctgtgcgatattggtgagtcctctcccagccctacagtggaagagtccaggactatccgcgtcctcaagatggtggagccatggttaaagaacaatcagttctgtataaaagttctgaacccctatatgcctaccgtaattgaacatcttgagcggctgcagcgaaagcacggcgggatgctagtgagaaatccactctcaaggaactctacacatgaaatgtactggatcagtaatggaaccggcaacatcgtcgcctcggtgaatatggttagccgcctgttgctgaaccggtttactatgacgcacagacgtcccacaattgagaaagacgtggatctcggtgctgggaccaggcacgtcaacgcggaaccggagactcctaatatggacgtgataggagagcggatcaagcgcattaaagaagagcataactccacctggcactatgacgatgaaaatccatacaagacatgggcctatcatggctcttacgaggtaaaggcaacgggctcagctagctccatgatcaacggggtggttaaacttctgaccaagccctgggacgtcgtgcctatggtgactcaaatggccatgacagataccactccattcggacagcagcgagtctttaaagaaaaggttgacacaagaacccccaggagtatgccgggtacacggcgcgtgatgggcattactgcagagtggttatggagaaccctggggaggaataaaaagcctcgattgtgcacgcgggaggaattcaccaagaaagtacgtacaaacgccgctatgggagccgtgtttactgaggaaaatcaatgggattctgcgaaggcagccgtcgaggacgaagatttctggaaactcgtggacagagagcgcgagctgcacaagctaggcaaatgtggtagctgcgtttataacatgatggggaagagggaaaaaaagcttggagagtttggcaaggctaaaggctcacgggccatctggtacatgtggctgggggcaagatacctcgaattcgaggctctgggatttttgaatgaggatcattggttctcccgcgaaaacagttatagcggtgtggagggcgaagggctgcacaagctcggatacatacttagggacatctctaaaattcccggcggtgccatgtatgctgatgacaccgccgggtgggacacacgaatcactgaggatgacctgcacaatgaagagaagattacccagcagatggatccagagcatcggcagttagcaaacgcgatctttaaactgacgtaccaaaataaggtcgtgaaggtacagagacctacacccaccggaactgttatggacataatttccaggaaagatcagcgcggctcaggccaggtggggacatatggattgaacaccttcactaatatggaagcccaactcatccgtcagatggagggtgaaggcgtcctgagcaaggctgacctagagaacccacaccttcccgaaaaaaagatcacccagtggctggagacaaaaggggtggagcggctcaagagaatggccatttcgggagatgactgcgtggtcaagcctatagatgacaggtttgcaaacgctctgttggccttaaatgatatgggcaaagttcgcaaggacatcccacagtggcaaccgtctaaaggttggcatgattggcagcaggtgcccttctgtagtcaccacttccatgaactgattatgaaggacgggcgaaaactcgtagtgccttgccggccacaggacgagcttatcggaagagcaaggatttcccaaggcgccggctggagcctgcgcgaaacggcgtgtctagggaaggcttacgcccagatgtggtcactgatgtattttcacagacgggatctcaggttggcatccaacgccatctgctctgctgtccccgtgcattgggttcctaccagccgtactacatggagtatacacgcccatcaccagtggatgaccactgaggacatgctgacagtgtggaatcgagtctggatcgaagataacccatggatggaggacaagacccccgtgacgacatgggagaatgtaccttaccttggaaaacgcgaagatcaatggtgtggttccctgattggcctcaccagcagagcaacttgggctcagaacatcccgaccgccattcagcaggttcggtctttaatcgggaatgaggaattcctggactacatgccatcaatgaagaggtttcgcaaagaggaggaaagtgagggagcgatttggtga

SEQ ID NO: 15346 - RNA, 9873 nt, synthetic construct
  misc_feature 1..9873: note = derived and/or modified CDS sequence (opt3) from DENV-3__KJ189257__SS-prME
  source 1..9873: mol_type = other RNA
accagcctgtgcctcatgatgatccttcccgccgctctggcattccacttgacttccagagacggcgaacctaggatgattgtggggaagaacgaacggggaaaatctttactgtttaagactgcctcaggtataaatatgtgtacgctaatcgcgatggatctcggcgaaatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccatggtaaggctcacaacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccatcaaatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccacacatggaccgaacagtacaaatttcaggcagattctcccaagcggctagccactgctatcgccggtgcatgggagaatggcgtttgtgggatacgaagcaccacacgcatggaaaacctcctgtggaaacaaatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacagaacagttccttcattatcgatggccccaatactccagagtgccccagcgcctctagggcttggaacgtttgggaagtggaggactatggttttggggtcttcaccacgaatatttggctgaaacttcgggaagtgtacacacaattgtgtgaccaccgcctcatgtcagcagccgttaaggatgagagagctgtgcatgccgacatgggatactggatcgagagtcagaaaaacggcagctggaagctggaaaaagcatccctaatagaggtaaagacctgcacttggcctaagtctcacaccctgtggtcgaatggtgtcctcgaaagcgatatgatcattccaaaatccctggcgggcccgatctcacagcataaccacaggcccgggtatcacacacagactgccggaccttggcatcttggcaagttggagctggactttaattactgcgaggggaccacagtggtgattacggaaaactgtggaacccgtggcccaagtttacggactacaaccgtctctggtaaactcatccacgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcatatgatcgcaggggtgttctttaccttcgttctactgctctccggacaaattacgtggcgggatatggctcacactctgatcatgattggcagtaataccagcgacagaatgggtatgggggtgacatatcttgccttgatagcaacctttaaaatccagcccttcctggccttaggatttttcctcaggaagctgacttctcgcgaaaaccttctgctaggcgtcggcctcgctatggcgacaaccctgcagttgccggaggatattgaacaaatggccaatgggatcgcactgggattaatggctctcaaactgattacacagtttgagacttaccagctttggaccgccctgatctccttgacgtgttcaaacacaatattcaccctcactgtggcctggcgaaccgctacactgatcctagccggtgttagtctgcttcctgtgtgccagagctcgtccatgcggaagactgactggctcccaatggccgtcgcggctatgggcgtaccccctctgcccttgtttattttctctctgaaggataccttaaaacgtagaagctggccactcaatgagggggtgatggccgttggactggtgtcaatccttgcaagttccctgttgaggaacgacgtccctatggccggccccctcgtggctggtgggctgctaattgcatgttatgtaatcacgggaacatctgccgatctgaccgtggaaaaggcggctgacataacttgggaggaagaggccgaacaaacaggcgtcagccataaccttatgattaccgttgacgatgacggcactatgcgcatcaaagatgacgagacagagaatatcctcaccgtgctgttgaagacggcattactgattgtgtccgggatatttccatactcaatcccggccactctcctggtctggcacacctggcagaaacagacacagcggagcggagtgctttgggatgttcctagtcccccagaaacccaaaaggctgagctggaagagggtgtatacagaattaaacagcagggcatcttcgggaagacacaggtgggagtcggcgtgcaaaaggagggtgtttttcacactatgtggcatgtgaccagaggggcagtcttgacgtataacggaaaacgactagaacccaattgggcatctgtgaagaaagacctgatttcctacggcggcgggtggcgcctcagcgctcagtggcagaagggagaggaagtacaagtcatcgccgtggagcctggtaaaaacccaaagaatttccagacaatgcccggcactttccagaccacaaccggggaaataggagcgatcgccctggattttaagcctggcacttcgggttcaccgattatcaaccgggaggggaaagttgtgggactttatggcaatggcgtcgtgaccaagaacgggggatacgtttctggtattgcacagacaaatgctgagccagacggccccacgcctgaattagaggaagagatgttcaaaaagagaaacctgactatcatggatctccacccagggagtggaaaaaccaggaagtatttgcccgccatagtgcgtgaagctattaagcgccggctgagaacactcatcctggcacctaccagggtcgtggccgccgagatggaggaagctcttaaaggcctgccgatccgataccaaactacagcgaccaagtccgagcatacgggtcgggaaattgtagacttgatgtgccacgcaacttttacaatgcgcctactgagccccgtgagagttccaaattataacctcatcataatggatgaggcccatttcaccgaccctgcttctattgccgcaagggggtacatcagcacccgggtcggaatgggcgaagccgctgcgatttttatgactgccacacccccaggcaccgcagatgctttccctcagtccaatgcccccatccaggacgaggagcgagacataccagaaagatcatggaacagtgggaatgagtggattacagattttgcaggaaaaactgtgtggttcgtgccgagcatcaaggccggtaacgacatcgctaactgtttacgcaaaaatggcaagaaggtcattcagctgtctaggaaaacgtttgataccgaataccaaaagacaaaacttaacgactgggatttcgtagtgactaccgacatctccgagatgggggccaattttaaggcggatcgtgttattgaccctcggagatgcctgaaacccgtgatactcacagatggaccagagagggtcatcttggcaggccccatgcctgtgaccgccgcttcagccgctcagcgccgaggtagagttgggcggaacccacagaaggaaaatgaccagtatattttcactggccaacccctgaacaatgatgaggaccacgcacactggacggaagccaagatgctcctggacaacatcaatacccctgagggaatcattccggctcttttcgaaccagagagggagaaaagtgccgcaatagatggcgaataccgcctaaagggggagagccgtaaaacatttgtggaactgatgagacggggagacttgcccgtctggttagcgcataaggtggcctccgagggtatcaaatatactgataggaagtggtgcttcgacggccagcgcaacaatcagattctggaagagaacatggatgtagagatctggaccaaagaaggggagaagaagaaactccgacctagatggctggacgctcggacatactctgatccccttgccctgaaggaatttaaagacttcgcagctggaaggaagtcgattgccctcgatttggtgaccgagatcggccgcgttccaagccacctggcacatagaactaggaatgccctagacaacctggtcatgctccacacatcagaacacggtgggcgggcttatcgtcatgcggtggaggagcttcctgaaacgatggagaccctgttattgctgggcctcatgatactgcttactggaggcgccatgctgtttctcatctccgggaaaggaattggtaagacaagtatcggcttgatttgtgtgatcgcatctagcgggatgctgtggatggctgaaatacccttacagtggattgcctccgccatcgtcctagagttctttatgatggttctgctcattccagagcctgaaaagcaacgcaccccgcaggataatcagcttgcatacgtggtaatcggaatactgaccttggctgccatcattgcggctaacgagatgggcctgctcgaaacaactaaacgagacctgggtatgtcaaaggagcccggggtggtctctccaacgagctatcttgatgtggacctccaccctgccagtgcatggaccctgtacgccgttgctacaactgtgatcacccccatgttgagacatacaattgaaaattccaccgcaaacgtcagcctggccgcgatcgctaaccaagccgtagtgttaatgggcctagacaaaggatggccaatatctaagatggatctgggcgttcctctccttgcactggggtgctactcacaggtgaatcccttgactctgacggccgctgtcttcctcctgattacacactatgccatcatcggaccgggccttcaggcaaaagctaccagggaggcccagaagcggactgcggccggtattatgaagaacccaaccgtggacgggatcatgacaatagatttagaccctgtcatttacgattccaaatttgagaagcaactgggacaggtgatgctcttggttctgtgtgcagtgcagctactgctcatgcgcacaagttgggctctttgcgaagccctgaccttggcaacaggccccatcacgaccctgtgggagggtagcccaggcaaattctggaatactacaattgctgtatcgatggccaacatctttagagggtcttatctcgccggagcgggcctggctttctccataatgaaaagcgtggggaccggaaaaaggggcactggttcacagggggaaacattaggagagaagtggaagaagaaacttaatcaactgagtcggaaagaatttgacctctacaagaaatctggcatcaccgaggtcgatcgaacggaggcaaaagaaggtctaaaaagaggcgagattacccatcacgccgtttcccgcgggagcgctaagctgcagtggttcgtggaaaggaacatggtcatccccgagggacgggtgattgacttgggctgtgggcgtggaggctggtcatattactgcgccggtctgaagaaagtaacagaagtgagagggtatactaagggaggccctggccacgaggagccggttcccatgagtacctacgggtggaatatcgtgaaactcatgagcggaaaggatgtcttctaccttccacctgaaaaatgtgacacactgttgtgcgatattggtgagtcctctcccagccctactgtggaagagtccaggaccatccgcgtcctgaagatggtggagccatggctcaagaacaatcagttttgtataaaagttttaaacccctatatgcctacagtaattgaacatctggagcggcttcagcgaaagcacggcgggatgctggtgagaaatccactatcaaggaactctacccatgaaatgtactggatcagtaatggaactggcaacatcgtcgcatcggtgaatatggttagccgcctcctgttgaaccggttcacgatgacacacagacgtcccaccattgagaaagacgtggatctgggtgccgggactaggcacgtcaacgctgaaccggagacccctaatatggacgtgataggagagcggatcaagcgcattaaagaggaacataactccacatggcactatgacgatgaaaatccatacaagacgtgggcgtatcatggctcttacgaggtaaaggccaccggctcagcaagctccatgatcaacggggtggttaaactccttactaagccctgggacgtcgtgcctatggtgacacaaatggctatgaccgatactacaccatttggacagcagcgagtcttcaaagaaaaggttgacaccagaacacccaggagtatgccgggtactcggcgcgtgatgggcattaccgccgagtggctgtggagaacgttagggaggaataaaaagcctcgactgtgcacccgggaggaatttacaaagaaagtacgtactaacgcagccatgggagctgtgttcaccgaggaaaatcaatgggattctgccaaggcggcagtcgaggacgaagatttttggaaattggtggacagagagcgcgagctccacaagctgggcaaatgtggtagctgcgtttataacatgatggggaagagggagaagaagctaggagagttcggcaaggccaaaggctcacgggctatctggtacatgtggcttggggccagatacctggaatttgaggcactcggattcctgaatgaggatcattggttttcccgcgaaaacagttatagcggtgtggagggcgaagggttgcacaagctgggatacatactcagggacatctctaaaattcccggcggtgctatgtatgccgatgacacagctgggtgggacactcgaatcaccgaggatgaccttcacaatgaagagaagattacgcagcagatggatccagagcatcggcagctggccaacgcaatcttcaaattaacataccaaaataaggtcgtgaaggtacagagacctacccccactggaacagttatggacataatttccaggaaagatcagcgcggctcaggccaggtggggacctatggactgaacacttttaccaatatggaagcgcaattgatccgtcagatggagggtgaaggcgtcctcagcaaggccgacctggagaacccacacctacccgagaagaagatcacacagtggcttgagacgaaaggggtggagcggctgaagagaatggctatttcgggagatgactgcgtggtcaagcctatagatgacaggttcgccaacgcactcctggctttgaatgatatgggcaaagttcgcaaggacatcccacagtggcaaccgtctaaaggttggcatgattggcaacaggtgcccttctgtagtcaccactttcatgaattaattatgaaggacgggcgaaaactggtagtgccttgccggccacaggacgagctcatcggaagggccaggatttcccaaggcgcaggctggagccttcgcgaaaccgcctgtctggggaaggcgtacgctcagatgtggtcactaatgtatttccacagacgggatctgaggctcgcctccaacgcaatctgctctgccgtccccgtgcattgggttcctactagccgtacaacctggagtatacacgctcatcaccagtggatgactacagaggacatgttgaccgtgtggaatcgagtctggatcgaagataacccatggatggaggacaagacgcccgtgacaacctgggagaatgtaccttacctgggaaaacgcgaagatcaatggtgtggttcccttattggcctgactagcagagccacctgggcacagaacatcccgacagctattcagcaggttcggtctctcatcgggaatgaggaatttttagactacatgccatcaatgaagaggttccgcaaagaggaggaaagtgagggagccatttggtga

SEQ ID NO: 15347 - RNA, 9873 nt, synthetic construct
  misc_feature 1..9873: note = derived and/or modified CDS sequence (opt3) from DENV-3__KJ189262__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccatggtaaggctcacaacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccatcaaatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccacacatggaccgaacagtacaaatttcaggcagattctcccaagcggctagccactgctatcgccggtgcatgggagaatggcgtttgtgggatacgaagcaccacacgcatggaaaacctcctgtggaaacaaatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacagaacagttccttcattatcgatggccccaatactccagagtgccccagcgcctctagggcttggaacgtttgggaagtggaggactatggttttggggtcttcaccacgaatatttggctgaaacttcgggaagtgtacacacaattgtgtgaccaccgcctcatgtcagcagccgttaaggatgagagagctgtgcatgccgacatgggatactggatcgagagtcagaaaaacggcagctggaagctggaaaaagcatccctaatagaggtaaagacctgcacttggcctaagtctcacaccctgtggtcgaatggtgtcctcgaaagcgatatgatcattccaaaatccctggcgggcccgatctcacagcataaccacaggcccgggtatcacacacagactgccggaccttggcatcttggcaagttggagctggactttaattactgcgaggggaccacagtggtgattacggaaaactgtggaacccgtggcccaagtttacggactacaaccgtctctggtaaactcatccacgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcatatgatcgcaggggtgttctttaccttcgttctactgctctccggacaaattacgtggcgggatatggctcacactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcagttgccggaggatattgaacaaatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccagagctcgtccatgcggaagacagactggctcccaatggcggtcgctgccatgggcgtaccccctctgcccttgtttattttctctctgaaggatactttaaaacgtagaagctggccactcaatgagggggtgatggcagttggactggtgtcaatccttgccagttccctgttgaggaacgacgtccctatggctggccccctcgtggcaggtgggctgctaattgcctgttatgtaatcaccggaacgtctgcggatctgacagtggaaaaggctgccgacataacctgggaggaagaggcagaacaaactggcgtcagccataaccttatgattacagttgacgatgacggcaccatgcgcatcaaagatgacgagactgagaatatcctcacagtgctgttgaagaccgccttactgattgtgtccgggatatttccatactcaatcccggctacgctcctggtctggcacacttggcagaaacagacccagcggagcggagtgctttgggatgttcctagtcccccagaaacacaaaaggccgagctggaagagggtgtatacagaattaaacagcagggcatcttcgggaagacccaggtgggagtcggcgtgcaaaaggagggtgtttttcacacaatgtggcatgtgactaggggggcagtcttgacctataacggaaaacgactagaacccaattgggcttctgtgaagaaagacctgatttcctacggcggcgggtggcgcctcagcgcccagtggcagaagggagaggaagtacaagtcatcgcgatagagcctggtaaaaacccaaagaatttccagacgatgcccggcacattccagactaccacaggggaaatcggagccattgcactggattttaagcctggcacctcgggttcaccgatcattaaccgggaggggaaagtggttggactttatggcaatggcgtggtcactaagaacgggggatacgtgtctggtatcgctcagaccaatgccgagccagacggccccacacctgaattagaggaagagatgttcaaaaagagaaacctgacgataatggatctccacccagggagtggaaaaactaggaagtatttgcccgctattgttcgtgaagcaatcaagcgccggctgagaaccctcatcctggcccctacaagggtggtcgccgctgagatggaggaagcgcttaaaggcctgccgattcgataccaaaccactgcaacaaagtccgagcataccggtcgggaaatcgtggacttgatgtgccacgccacgtttactatgcgcctactgagccccgtaagagtgccaaattataacctcataattatggatgaggctcatttcacagaccctgcctctatcgcagccagggggtacattagcacccgggttggaatgggcgaagctgcggccatctttatgaccgcaactcccccaggcacagctgatgccttccctcagtccaatgcacccatacaggacgaggagcgagacattccagaaagatcatggaacagtgggaatgagtggatcaccgattttgccggaaaaacagtctggttcgtgccgagcatcaaggctggtaacgacattgccaactgtttacgcaaaaatggcaagaaggtgatccagctgtctaggaaaacttttgatacggaataccaaaagaccaaacttaacgactgggatttcgtcgtaacaactgacatttccgagatgggggcgaattttaaggcagatcgtgtgatagaccctcggagatgcctgaaacccgttatcctcaccgatggaccagagagggtgattttggccggccccatgcctgtcacagctgcctcagctgcacagcgccgaggtagagtggggcggaacccacagaaggaaaatgaccagtatatcttcaccggccaacccctgaacaatgatgaggaccacgcccactggactgaagctaagatgctcctggacaacatcaatacgcctgagggaattataccggcccttttcgaaccagagagggagaaaagtgcagcgatcgatggcgaataccgcctaaagggggagagccgtaaaacctttgttgaactgatgagacggggagacttgcccgtgtggttagcccataaggtcgcttccgagggtattaaatatacagataggaagtggtgcttcgacggccagcgcaacaatcagatcctggaagagaacatggatgtggagatttggactaaagaaggggagaagaagaaactccgacctagatggctggacgcccggacctactctgatccccttgcactgaaggaatttaaagacttcgctgccggaaggaagtcgatcgcactcgatttggtaacagagataggccgcgtgccaagccacctggcccatagaaccaggaatgctctagacaacctggttatgctccacacttcagaacacggtgggcgggcgtatcgtcatgccgtcgaggagcttcctgaaacaatggagacgctgttattgctgggcctcatgatcctgcttaccggaggcgcaatgctgtttctcatttccgggaaaggaatcggtaagactagtattggcttgatctgtgtgatagcttctagcgggatgctgtggatggccgaaattcccttacagtggatcgcctccgcaattgtgctagagttctttatgatggtcctgctcatcccagagcctgaaaagcaacgcacaccgcaggataatcagcttgcttacgttgtgataggaatcctgaccttggccgcgattatcgctgccaacgagatgggcctgctcgaaaccacaaaacgagacctgggtatgtcaaaggagcccggggtagtgtctccaactagctatcttgatgtcgacctccaccctgcaagtgcctggacgctgtacgctgtggcaaccacagttattactcccatgttgagacataccatcgaaaattccacagccaacgtgagcctggcggctatagccaaccaagcagtcgtattaatgggcctagacaaaggatggccaatttctaagatggatctgggcgtgcctctccttgccctggggtgctactcacaggttaatcccttgaccctgactgctgccgtgctcctgcttatcacgcactatgcaatcattggaccgggcttacaggctaaagccacaagggaggcgcagaagcggaccgccgcaggtatcatgaagaacccaactgtcgacgggataatgaccattgatctggaccctgtgatctacgattccaaattcgagaagcaactcggacaggtcatgttgctggtgctatgtgctgttcagctgctccttatgcgcacaagttgggccctgtgcgaagcattgactctggctaccggccccattacaacgctctgggagggtagcccaggcaaattttggaataccactatcgccgtgtcgatggccaacatattcagagggtcttatctggcgggagctggcttagcattttccatcatgaagagcgtagggacaggaaaaaggggcaccggttcacagggggaaactcttggagagaagtggaagaaaaagctgaatcaactcagtcggaaagaattcgacctatacaagaaatctggcattacagaggtggatcgaaccgaggccaaggaaggtctgaaaagaggcgagatcacgcatcacgctgtctcccgcgggagcgccaagttgcagtggtttgttgaaaggaacatggtgattcccgagggacgggtcatcgacctgggctgtgggcgtggaggctggtcatattactgcgcaggtctcaagaaagtgaccgaagtaagagggtatacaaagggaggccctggccacgaggagccggtgcccatgagtacttacgggtggaatattgttaaacttatgagcggaaaggatgtgttctacctgccacctgaaaaatgtgacaccttgctgtgcgatatcggtgagtcctctcccagccctacagtcgaagagtccaggactatacgcgtgctcaagatggtcgagccatggttaaagaacaatcagttctgtattaaagtgctgaacccctatatgcctaccgttatcgaacatcttgagcggctgcagcgaaagcacggcgggatgctagtaagaaatccactctcaaggaactctacacatgaaatgtactggatcagtaatggaaccggcaacattgtggcctcggtcaatatggtgagccgcctgttgctgaaccggtttactatgacgcacagacgtcccacaatagagaaagacgttgatctcggtgctgggaccaggcacgtgaacgcggaaccggagactcctaatatggacgtcatcggagagcggattaagcgcatcaaagaagagcataactccacctggcactatgacgatgaaaatccatacaagacatgggcctatcatggctcttacgaggtgaaggcaacgggctcagctagctccatgattaacggggtagtgaaacttctgaccaagccctgggacgttgtccctatggtgactcaaatggccatgacagataccactccattcggacagcagcgagtgtttaaagaaaaggtcgacacaagaacccccaggagtatgccgggtacacggcgcgttatgggcatcactgcagagtggttatggagaaccctggggaggaataaaaagcctcgattgtgcacgcgggaggaattcaccaagaaagtgcgtacaaacgccgctatgggagccgtatttactgaggaaaatcaatgggattctgcgaaggcagccgtggaggacgaagatttctggaaactcgtcgacagagagcgcgagctgcacaagctaggcaaatgtggtagctgcgtgtataacatgatggggaagagggaaaaaaagcttggagagtttggcaaggctaaaggctcacgggccatatggtacatgtggctgggggcaagatacctcgaattcgaggctctgggatttttgaatgaggatcattggttctcccgcgaaaacagttatagcggtgttgagggcgaagggctgcacaagctcggatacatccttagggacatttctaaaatccccggcggtgccatgtatgctgatgacaccgccgggtgggacacacgaattactgaggatgacctgcacaatgaagagaagatcacccagcagatggatccagagcatcggcagttagcaaacgcgatatttaaactgacgtaccaaaataaggtggtcaaggtgcagagacctacacccaccggaactgtaatggacattatctccaggaaagatcagcgcggctcaggccaggttgggacatatggattgaacaccttcactaatatggaagcccaactcatccgtcagatggagggtgaaggcgtgctgagcaaggctgacctagagaacccacaccttcccgaaaaaaagattacccagtggctggagacaaaaggggtcgagcggctcaagagaatggccatatcgggagatgactgcgtggtgaagcctatcgatgacaggtttgcaaacgctctgttggccttaaatgatatgggcaaagtccgcaaggacattccacagtggcaaccgtctaaaggttggcatgattggcagcaggttcccttctgtagtcaccacttccatgaactgatcatgaaggacgggcgaaaactcgtggtaccttgccggccacaggacgagcttattggaagagcaaggatctcccaaggcgccggctggagcctgcgcgaaacggcgtgtctagggaaggcttacgcccagatgtggtcactgatgtattttcacagacgggatctcaggttggcatccaacgccatatgctctgctgtgcccgtccattgggtgcctaccagccgtactacatggagtatccacgcccatcaccagtggatgaccactgaggacatgctgacagtttggaatcgagtgtggattgaagataacccatggatggaggacaagacccccgtcacgacatgggagaatgtgccttaccttggaaaacgcgaagatcaatggtgtggttccctgatcggcctcaccagcagagcaacttgggctcagaacattccgaccgccatccagcaggtacggtctttaattgggaatgaggaattcctggactacatgccatcaatgaagaggtttcgcaaagaggaggaaagtgagggagcgatatggtga

SEQ ID NO: 15348 - RNA, 9873 nt, synthetic construct
  misc_feature 1..9873: note = derived and/or modified CDS sequence (opt3) from DENV-3__KJ189263__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacagtgctgataaaggttgagtacaagggagaagatgtgccctgtaaaatccctttctccactgaggacggccatggtaaggctcacaacgggcgtcttattaccgcgaatccagtagtcacaaaaaaggaggaacccgtgaacatcgaggcagaaccgcctttcggcgagtcaaatatagttattggaatcggcgataacgccttgaaaatcaattggtataagaaggggagcagtattggaaaaatgtttgaagctactgcccgcggtgcaagaaggatggccatcctgggcgacaccgcttgggatttcgggtctgtgggaggcgtcctcaactccctgggtaagatggtgcatcaaatttttgggagcgcctacacggcacttttctcgggcgtatcttgggtgatgaaaataggaatcggcgttctgttgacatggattgggctcaattccaagaacacctcaatgagttttagctgcatcgcgatcggaattataactctgtatttaggcgctgtcgtgcaggccgacatgggttgtgtgatcaattggaaagggaaggagctgaagtgcggatccggcattttcgtcacaaacgaggttcacacctggactgaacagtacaaatttcaggcagattctcccaagcggctagccaccgctatcgccggtgcatgggagaatggcgtgtgtgggattcgaagcacaacgcgcatggaaaacctcctgtggaaacaaatcgctaatgagcttaactatatattgtgggaaaataacatcaagctgaccgtggtagtcggagacattatcggcgtgctcgagcaggggaaaagaactctgacaccacagcctatggagttaaagtactcatggaaaacctggggaaaggccaagattgttacagcggaaactcagaacagttccttcatcatagatggccccaataccccagagtgccccagcgcctctagggcttggaacgtgtgggaagtcgaggactatggttttggggtgttcacgacaaatatttggctgcggcttcgcgaagtttacacccaattgtgtgaccacagactcatgtcagcagccgtgaaagatgagagggctgtacatgccgacatgggatactggatcgagagtcagaagaacggcagctggaaactggaaaaggcatccctaattgaggtcaaaacttgcacctggcctaagtctcacacactgtggtcgaatggtgtgctcgaaagcgatatgatcataccaaagtccctggcgggcccgatctcacagcataaccaccgtcccgggtatcacactcagaccgccggaccttggcatcttggcaaattggagctggactttaattactgcgaggggacaacggtggtcattaccgaaaactgtggaactcggggcccaagtttacgaacaaccactgtttctggtaagctcatccacgagtggtgctgtagaagctgcacactgccccctcttaggtatatgggggaagatggatgttggtacggcatggagattcgcccaatctccgaaaaagaggagaatatggtgaagtcactggtaagcgctggttctggcaaagtggacaacttcaccatgggggtcttgtgcctcgccatactgtttgaagaggtgatgcggggaaagttcggcaagaaacatatgattgcaggggttttctttacgttcgtgctactgctctccggacaaatcacttggagagatatggctcacaccctgatcatgattggcagtaatgccagcgacaggatgggtatgggggtcacatatcttgcattgatcgccacctttaagattcagcccttcctggctttaggatttttcctccgcaaactgacttctcgagaaaaccttctgctaggcgtgggcctcgcgatggccacaaccctgcagttgccggaggatatagaacaaatggcaaatgggatcgctctgggattaatggccctcaagctgattacacagtttgagatctaccagctttggactgccctgatttccttgacctgttcaaacacgatcttcacactcaccgttgcttggcggactgcaaccctgatactagccggtgtgagtctgcttcctgtctgccagagctcgtccatgcgtaaaacagactggctcccaatggcggtagctgccatgggcgtgccccctctgcccttgtttatcttctctctgaaggatactttaaagagaaggagctggccactcaatgagggggttatggcagtgggactggtctcaattcttgccagttccctgttgcgcaacgacgtgcctatggctggccccctcgtagcaggtgggctgctaatcgcctgttatgtgattaccggaacgtctgcggatctgacagtcgaaaaagctgccgacatcacctgggaggaagaggcagaacaaactggcgttagccataaccttatgataacagtggacgatgacggcaccatgcggattaaggatgacgagactgagaatatcctcacagtgctgttgaaaaccgccttactgatcgtctccgggatttttccatactcaataccggctacgctcctggtgtggcacacttggcagaagcagacccagagaagcggagttctttgggatgtacctagtcccccagaaacacaaaaagccgagctggaagagggtgtgtacaggatcaagcagcagggcattttcgggaaaacccaggtcggagtgggcgttcaaaaggagggtgtgtttcacacaatgtggcatgtcactcgaggggcagtgttgacctataacggaaagcgcctagaacccaattgggcttctgtaaaaaaggacctgatctcctacggcggcgggtggcggctcagcacgcagtggcagaaaggagaggaagtccaagtgattgccgttgagcctggtaagaacccaaaaaatttccagacaatgcccggcactttccagaccacaaccggggaaatcggagcgatagccctggattttaagcctggcacttcgggttcaccgatcattaacagagaggggaaggtggtcggactttatggcaatggcgtggttaccaaaaacgggggatacgtgtctggtatcgcacagacaaatgctgagccagacggccccacgcctgaattagaggaagagatgttcaagaaaaggaacctgactattatggatctccacccagggagtggaaagacccgtaaatatttgcccgccatcgtccgcgaagctataaagcggagactgaggacactcattctggcacctacccgagtggtagccgccgagatggaggaagctcttaagggcctgccgatccggtaccaaactacagcgaccaaatccgagcatacgggtcgcgaaatcgtggacttgatgtgccacgcaacttttacaatgagactactgagccccgttagggtcccaaattataacctcattatcatggatgaggcccatttcaccgaccctgcttctatagccgcacgggggtacattagcacccgagtgggaatgggcgaagccgctgcgatctttatgactgccacacccccaggcaccgcagatgctttccctcagtccaatgcccccattcaggacgaggagagagacatcccagaacgctcatggaacagtgggaatgagtggataacagattttgcaggaaagactgtgtggttcgtcccgagcattaaagccggtaacgacatcgctaactgtttaaggaagaatggcaaaaaggtaatccagctgtctcgtaagacgtttgataccgaataccaaaaaacaaagcttaacgactgggatttcgtggttactaccgacatttccgagatgggggccaattttaaagcggatcgggtgatcgaccctagaaggtgcctgaagcccgtcattctcacagatggaccagagcgcgtgatattggcaggccccatgcctgttaccgccgcttcagccgctcagcgaagaggtcgggtggggaggaacccacagaaagaaaatgaccagtatatcttcactggccaacccctgaacaatgatgaggaccacgcacactggacggaagccaagatgctcctggacaacattaatacccctgagggaatcatcccggctcttttcgaaccagagcgcgagaagagtgccgcaattgatggcgaataccgtctaaaaggggagagcagaaagacatttgtcgaactgatgcggaggggagacttgcccgtgtggttagcgcataaagtagcctccgagggtataaagtatactgatcgcaaatggtgcttcgacggccagcgaaacaatcagatcctggaagagaacatggatgtggagatttggaccaaggaaggggagaaaaagaagctcagacctcggtggctggacgctaggacatactctgatccccttgccctgaaagaatttaaggacttcgcagctggacgcaaatcgatcgccctcgatttggttaccgagattggcagagtcccaagccacctggcacataggactcggaatgccctagacaacctggtgatgctccacacatcagaacacggtgggcgtgcttatcgccatgcggtggaggagcttcctgaaacgatggagaccctgttattgctgggcctcatgatcctgcttactggaggcgccatgctgtttctcatatccgggaagggaatcggtaaaacaagtattggcttgatctgtgtcattgcatctagcgggatgctgtggatggctgaaatccccttacagtggatagcctccgccattgttctagagttctttatgatggtgctgctcatcccagagcctgaaaagcaacgaaccccgcaggataatcagcttgcatacgtagtgattggaatcctgaccttggctgccataatcgcggctaacgagatgggcctgctcgaaacaactaagagagacctgggtatgtcaaaagagcccggggtcgtgtctccaacgagctatcttgatgttgacctccaccctgccagtgcatggaccctgtacgccgtggctacaactgtcattacccccatgttgaggcatacaatcgaaaattccaccgcaaacgtaagcctggccgcgattgctaaccaagccgtggttttaatgggcctagacaagggatggccaatctctaaaatggatctgggcgtgcctctccttgcactggggtgctactcacaggtcaatcccttgactctgacggccgctgtgctcctgcttataacacactatgccattatcggaccgggcttacaggcaaaggctacccgggaggcccagaaacgcactgcggccggtatcatgaagaacccaaccgtcgacgggattatgacaatcgatctggaccctgtgatatacgattccaagttcgagaaacaactcggacaggttatgttgctggtgctatgtgcagtacagctgctccttatgagaactagttgggctctgtgcgaagccttgaccctggcaacaggccccattacgaccctctgggagggtagcccaggcaagttttggaatactacaatcgctgtgtcgatggccaacattttcagggggtcttatctggccggagcgggcttagctttttccatcatgaaaagcgtcgggaccggaaagcggggcactggttcacagggggaaacacttggagagaaatggaagaagaaactgaatcaactcagtcgaaaggaattcgacctatacaaaaagtctggcataaccgaggttgatagaacggaggcaaaagaaggtctgaagcgcggcgagatcacccatcacgccgtgtccagggggagcgctaaattgcagtggtttgtcgaacggaacatggtgattcccgagggacgtgtaatcgacctgggctgtgggagaggaggctggtcatattactgcgccggtctcaagaaggtgacagaagttagggggtatactaaaggaggccctggccacgaggagccggtgcccatgagtacctacgggtggaatattgtcaagcttatgagcggaaaagatgtgttctacctgccacctgaaaagtgtgacacattgctgtgcgatatcggtgagtcctctcccagccctactgtcgaagagtcccgcaccattcgggtgctcaaaatggttgagccatggttaaagaacaatcagttctgtatcaaggtactgaacccctatatgcctacagtgatagaacatcttgagcgactgcagagaaaacacggcgggatgctagtcaggaatccactctcacgcaactctacccatgaaatgtactggattagtaatggaactggcaacatcgtggcatcggttaatatggtgagccggctgttgctgaacagatttacgatgacacaccgtaggcccaccatcgagaaggacgtcgatctcggtgccgggactcggcacgtgaacgctgaaccggagacccctaatatggacgtaattggagagcgcataaaacgaatcaaggaagagcataactccacatggcactatgacgatgaaaatccatacaaaacgtgggcgtatcatggctcttacgaggtgaaggccaccggctcagcaagctccatgattaacggggttgtcaagcttctgactaaaccctgggacgtggtgcctatggtcacacaaatggctatgaccgatactacaccattcggacagcagagagtttttaaggaaaaagtggacaccaggacaccccggagtatgccgggtactcgcagagtaatgggcatcaccgccgagtggttatggaggacgctggggcgaaataagaaacctcggttgtgcacccgtgaggaattcacaaagaaggtgagaactaacgcagccatgggagctgtctttaccgaggaaaatcaatgggattctgccaaagcggcagtggaggacgaagatttctggaagctcgttgaccgcgagagggagctgcacaaactaggcaagtgtggtagctgcgtgtataacatgatggggaaacgggaaaagaaacttggagagtttggcaaggccaagggctcaagagctatttggtacatgtggctgggggcccgctacctcgaattcgaggcactgggatttttgaatgaggatcattggttctccagggaaaacagttatagcggtgtcgagggcgaagggctgcacaaactcggatacatccttcgagacatatctaagatccccggcggtgctatgtatgccgatgacacagctgggtgggacactcggattaccgaggatgacctgcacaatgaagagaaaatcacgcagcagatggatccagagcatagacagttagccaacgcaatttttaagctgacataccaaaataaagtggtaaaggttcagaggcctacccccactggaacagtgatggacatcatatcccgcaaggatcagcgtggctcaggccaggtcgggacctatggattgaacactttcaccaatatggaagcgcaactcattcggcagatggagggtgaaggcgtgctgagcaaagccgacctagagaacccacaccttcccgaaaagaaaatcacacagtggctggagacgaagggggtggagagactcaaaaggatggctatctcgggagatgactgcgtcgttaagcctattgatgaccgctttgccaacgcactgttggctttaaatgatatgggcaaggtgcgaaaagacataccacagtggcaaccgtctaagggttggcatgattggcagcaggtacccttctgtagtcaccacttccatgaactgatcatgaaagacgggcggaagctcgtggtcccttgcagaccacaggacgagcttattggaagggcccgcatctcccaaggcgcaggctggagcctgagagaaaccgcctgtctagggaaagcgtacgctcagatgtggtcactgatgtattttcaccggagggatctccgtttggcctccaacgcaatttgctctgccgtgcccgttcattgggtgcctactagccgaacaacctggagtatccacgctcatcaccagtggatgactacagaggacatgctgaccgtctggaatcgcgtgtggatagaagataacccatggatggaggacaagacgcccgtaacaacctgggagaatgttccttaccttggaaagagagaagatcaatggtgtggttccctgatcggcctcactagccgggccacctgggcacagaacattccgacagctatccagcaggtgaggtctttaattgggaatgaggaattcctggactacatgccatcaatgaaacgctttagaaaggaggaggaaagtgagggagccatctggtga

SEQ ID NO: 15349 - RNA, 9873 nt, synthetic construct
  misc_feature 1..9873: note = derived and/or modified CDS sequence (opt3) from DENV-3__KJ189265__SS-prME
  source 1..9873: mol_type = other RNA
accagcctgtgcctcatgatgatccttcccgccgctctggcattccacttgacttccagggacggcgaacctaggatgattgtggggaagaacgaacggggaaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaagctggagaacaccgccgagacaagcgtagcgtagcccttgcaccccatgtgggcatgggtctggatacaagaacccaaacgtggatgtccgccgaaggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccatggtaaggctcacaacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccatcagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccacacatggaccgaacagtacaaatttcaggcagattctcccaagcggctagccactgctatcgccggtgcatgggagaatggcgtttgtgggatacgaagcaccacacgcatggaaaacctcctgtggaaacaaatcgctaatgagcttaactatattttgtgggaaaataacatcaagctgacggtggtggtaggagacattatcggcgtcctcgagcacgggaaaagaaccctgactccacagcctatggagttaaagtactcatggaaaacatggggaaaggccaagatagtgaccgcggaaacacagaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccatcgcctcatgtcagcagccgttaaggatgagagagctgtgcacgccgacatgggatactggatcgagagtcagaagaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaaccacaggcccgggtatcatacacagactgccggaccttggcaccttggcaagttggagctggactttaattactgcgaggggaccacagtggtgattacggaaaactgtggaacccgtggcccaagtttacggactacaaccgtctctggtaaactcatccatgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcacatgatcgcaggggtgttctttaccttcgttctactgctctccggacagattacgtggcgggatatggctcatactctgatcatgattggcagtaataccagcgacagaatgggtatgggggtgacatatcttgccttgatagcaacctttaaaatccaacccttcctggccttaggatttttcctcaggaagctgacttctcgcgaaaaccttctgctaggcgtcggcctcgctatggcgacaaccctgcagttgccggaggatattgaacagatggccaatgggatcgcactgggattaatggctctcaaactgattacacaatttgagacttaccagctttggaccgccctgatctccttgacgtgttcaaacacaatattcaccctcactgtggcctggcgaaccgctacactgatcctagccggtgttagtctgcttcctgtgtgccagagctcgtccatgcggaagactgactggctcccaatggccgtcgcggctatgggcgtaccccctctgcccttgtttattttctctctgaaggataccttaaaacgtagaagctggccactcaatgagggggtgatggccgttggactggtgtcaatccttgcaagttccctgttgaggaacgacgtccctatggccggccccctcgtggctggtgggctgctaattgcatgttatgtaatcacgggaacatctgccgatctgaccgtggaaaaggcggctaacataacttgggaggaagaggccgaacagacaggcgtcagccacaatcttatgattaccgttgacgacgatggcactatgcgcatcaaagacgatgagacagagaacatcctcaccgtgctgttgaagacggcattactgattgtgtccgggatatttccatactcaatcccggccactctcctggtctggcacacctggcaaaaacagacacagcggagcggagtgctttgggacgttcctagtcccccagaaacccagaaggctgagctggaagagggtgtatacagaattaaacaacagggcatcttcgggaagacacaggtgggagtcggcgtgcagaaggagggtgtttttcatactatgtggcacgtgaccagaggggcagtcttgacgtataatggaaaacgactagaacccaactgggcatctgtgaagaaagatctgatttcctacggcggcgggtggcgcctcagcgctcaatggcagaagggagaggaagtacaggtcatcgccgtggagcctggtaaaaatccaaagaacttccaaacaatgcccggcactttccagaccacaaccggggaaataggagcgatcgccctggactttaagcctggcacttcgggttcaccgattatcaatcgggaggggaaagttgtgggactttatggcaacggcgtcgtgaccaagaatgggggatacgtttctggtattgcacagacaaacgctgagccagatggccccacgcctgaattagaggaagagatgttcaaaaagagaaatctgactatcatggacctccatccagggagtggaaaaaccaggaagtatttgcccgccatagtgcgtgaagctattaagcgccggctgagaacactcatcctggcacctaccagggtcgtggccgccgagatggaggaagctcttaaaggcctgccgatccgataccagactacagcgaccaagtccgagcacacgggtcgggaaattgtagatttgatgtgccatgcaacttttacaatgcgcctactgagccccgtgagagttccaaactataatctcatcataatggacgaggcccacttcaccgatcctgcttctattgccgcaagggggtacatcagcacccgggtcggaatgggcgaagccgctgcgatttttatgactgccacacccccaggcaccgcagacgctttccctcaatccaacgcccccatccaggatgaggagcgagacataccagaaagatcatggaatagtgggaacgagtggattacagactttgcaggaaaaactgtgtggttcgtgccgagcatcaaggccggtaacgatatcgctaattgtttacgcaaaaacggcaagaaggtcattcagctgtctaggaaaacgtttgacaccgaataccagaagacaaaacttaatgattgggacttcgtagtgactaccgatatctccgagatgggggccaactttaaggcggaccgtgttattgatcctcggagatgcctgaaacccgtgatactcacagacggaccagagagggtcatcttggcaggccccatgcctgtgaccgccgcttcagccgctcaacgccgaggtagagttgggcggaatccacagaaggaaaacgatcagtatattttcactggccagcccctgaataacgacgaggatcacgcacattggacggaagccaagatgctcctggacaatatcaacacccctgagggaatcattccggctcttttcgaaccagagagggagaaaagtgccgcaatagacggcgaataccgcctaaagggggagagccgtaaaacatttgtggaactgatgagacggggagatttgcccgtctggttagcgcacaaggtggcctccgagggtatcaaatatactgacaggaagtggtgcttcgatggccaacgcaataaccagattctggaagagaatatggacgtagagatctggaccaaagaaggggagaagaagaaactccgacctagatggctggatgctcggacatactctgacccccttgccctgaaggaatttaaagatttcgcagctggaaggaagtcgattgccctcgacttggtgaccgagatcggccgcgttccaagccatctggcacacagaactaggaacgccctagataatctggtcatgctccacacatcagaacatggtgggcgggcttatcgtcacgcggtggaggagcttcctgaaacgatggagaccctgttattgctgggcctcatgatactgcttactggaggcgccatgctgtttctcatctccgggaaaggaattggtaagacaagtatcggcttgatttgtgtgatcgcatctagcgggatgctgtggatggctgaaatacccttacagtggattgcctccgccatcgtcctagagttctttatgatggttctgctcattccagagcctgaaaagcagcgcaccccgcaagacaaccagcttgcatacgtggtaatcggaatactgaccttggctgccatcattgcggctaatgagatgggcctgctcgaaacaactaaacgagatctgggtatgtcaaaggagcccggggtggtctctccaacgagctatcttgacgtggatctccatcctgccagtgcatggaccctgtacgccgttgctacaactgtgatcacccccatgttgagacacacaattgaaaactccaccgcaaacgtcagcctggccgcgatcgctaatcaggccgtagtgttaatgggcctagacaaaggatggccaatatctaagatggacctgggcgttcctctccttgcactggggtgctactcacaagtgaaccccttgactctgacggccgctgtcctcctgcttattacacattatgccatcatcggaccgggcttacaggcaaaagctaccagggaggcccagaagcggactgcggccggtattatgaagaatccaaccgtggatgggatcatgacaatagacctggatcctgtcatttacgactccaaattcgagaagcagctcggacaagtgatgttgctggttctatgtgcagtgcagctgctccttatgcgcacaagttgggctctgtgcgaagccttgaccctggcaacaggccccatcacgaccctctgggagggtagcccaggcaaattttggaacactacaattgctgtatcgatggccaatatcttcagagggtcttatctggccggagcgggcttagctttttccataatgaaaagcgtggggaccggaaaaaggggcactggttcacagggggaaacacttggagagaagtggaagaaaaagctgaaccagctcagtcggaaagagttcgatctatacaagaaatctggcatcaccgaggtcgaccgaacggaggcaaaggaaggtctgaaaagaggcgagattacccaccacgccgtttcccgcgggagcgctaagttgcaatggtttgtggaaaggaatatggtcatccccgagggacgggtgattgatctgggctgtgggcgtggaggctggtcatattactgcgccggtctcaagaaagtaacagaagtgagagggtatactaagggaggccctggccatgaggagccggttcccatgagtacctacgggtggaacatcgtgaaacttatgagcggaaaggacgtcttctacctgccacctgaaaaatgtgatacattgctgtgcgacattggtgagtcctctcccagccctactgtggaagagtccaggaccatccgcgtcctcaagatggtggagccatggttaaagaataaccagttctgtataaaagttctgaatccctatatgcctacagtaattgaacaccttgagcggctgcagcgaaagcatggcgggatgctagtgagaaacccactctcaagaaattctacccacgaaatgtactggatcagtaacggaactggcaatatcgtcgcatcggtgaacatggttagccgcctgttgctgaaccggtttacgatgacacacagacgtcccaccattgagaaagatgtggacctcggtgccgggactaggcatgtcaatgctgaaccggagacccctaacatggatgtgataggagagcggatcaagcgcattaaagaagaacacaattccacatggcattatgacgacgaaaacccatacaagacgtgggcgtatcacggctcttacgaggtaaaggccaccggctcagcaagctccatgatcaatggggtggttaaacttctgactaagccctgggatgtcgtgcctatggtgacacagatggctatgaccgacactacaccattcggacaacagcgagtctttaaagaaaaggttgataccagaacacccaggagtatgccgggtactcggcgcgtgatgggcattaccgccgagtggttatggagaacgctggggaggaacaaaaagcctcgattgtgcacccgggaggagttcacaaagaaagtacgtactaatgcagccatgggagctgtgtttaccgaggaaaaccagtgggactctgccaaggcggcagtcgaggatgaagacttctggaaactcgtggatagagagcgcgagctgcataagctaggcaaatgtggtagctgcgtttataatatgatggggaagagggagaagaaacttggagagtttggcaaggccaaaggctcacgggctatctggtacatgtggctgggggccagatacctcgagttcgaggcactgggatttttgaacgaggaccactggttctcccgcgaaaatagttatagcggtgtggagggcgaagggctgcacaagctcggatacatacttagggatatctctaaaattcccggcggtgctatgtatgccgacgatacagctgggtgggacactcgaatcaccgaggacgatctgcataacgaagagaagattacgcaacagatggacccagagcaccggcagttagccaatgcaatctttaaactgacataccagaacaaggtcgtgaaggtacaaagacctacccccactggaacagttatggatataatttccaggaaagaccagcgcggctcaggccaggtggggacctatggattgaatactttcaccaacatggaagcgcagctcatccgtcaaatggagggtgaaggcgtcctgagcaaggccgatctagagaacccacatcttcccgagaaaaagatcacacagtggctggagacgaaaggggtggagcggctcaagagaatggctatttcgggagacgattgcgtggtcaagcctatagacgataggtttgccaatgcactgttggctttaaacgacatgggcaaagttcgcaaggatatcccacagtggcagccgtctaaaggttggcacgactggcaacaggtgcccttctgtagtcaccatttccacgaactgattatgaaggatgggcgaaaactcgtagtgccttgccggccacaggacgagcttatcggaagggccaggatttcccagggcgcaggctggagcctgcgcgaaaccgcctgtctagggaaggcgtacgctcaaatgtggtcactgatgtattttcatagacgggacctcaggttggcctccaatgcaatctgctctgccgtccccgtgcactgggttcctactagccgtacaacctggagtatacatgctcaccaccagtggatgactacagaggatatgctgaccgtgtggaaccgagtctggatcgaagacaatccatggatggaggataagacgcccgtgacaacctgggagaacgtaccttaccttggaaaacgcgaagaccagtggtgtggttccctgattggcctcactagcagagccacctgggcacaaaatatcccgacagctattcagcaggttcggtctttaatcgggaacgaggagttcctggattacatgccatcaatgaagaggtttcgcaaagaggaggaaagtgagggagccatttggtga

SEQ ID NO: 15350 - RNA, 9873 nt, synthetic construct
  misc_feature 1..9873: note = derived and/or modified CDS sequence (opt3) from DENV-3__KJ189266__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccatggtaaggctcacaacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccatcaaatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccacacatggaccgaacagtacaaatttcaggcagattctcccaagcggctagccactgctatcgccggtgcatgggagaatggcgtttgtgggatacgaagcaccacacgcatggaaaacctcctgtggaaacaaatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacagaacagttccttcattatcgatggccccaatactccagagtgccccagcgcctctagggcttggaacgtttgggaagtggaggactatggttttggggtcttcaccacgaatatttggctgaaacttcgggaagtgtacacacaattgtgtgaccaccgcctcatgtcagcagccgttaaggatgagagagctgtgcatgccgacatgggatactggatcgagagtcagaaaaacggcagctggaagctggaaaaagcatccctaatagaggtaaagacctgcacttggcctaagtctcacaccctgtggtcgaatggtgtcctcgaaagcgatatgatcattccaaaatccctggcgggcccgatctcacagcataaccacaggcccgggtatcacacacagactgccggaccttggcatcttggcaagttggagctggactttaattactgcgaggggaccacagtggtgattacggaaaactgtggaacccgtggcccaagtttacggactacaaccgtctctggtaaactcatccacgagtggtgctgtcgaagctgcactctgccccctcttagatatatgggggaagatggatgttggtacggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcatatgatcgcaggggtgttctttaccttcgttctactgctctccggacaaattacgtggcgggatatggctcacactctgatcatgattggcagtaatgccagcgacagaatgggtatgggggtgacctatcttgcattgatagccacatttaaaatccagcccttcctggctttaggatttttcctcaggaagctgacctctcgcgaaaaccttctgctaggcgtcggcctcgcgatggccactacactgcagttgccggaggatattgaacaaatggcaaatgggatcgctctgggattaatggccctcaaactgattacccagtttgagacataccagctttggactgccctgatctccttgacctgttcaaacacgatattcacactcaccgtggcttggcgaactgcaaccctgatcctagccggtgttagtctgcttcctgtgtgccagagctcgtccatgcggaagacagactggctcccaatggcggtcgctgccatgggcgtaccccctctgcccttgtttattttctctctgaaggatactttaaaacgtagaagctggccactcaatgagggggtgatggcagttggactggtgtcaatccttgccagttccctgttgaggaacgacgtccctatggctggccccctcgtggcaggtgggctgctaattgcctgttatgtaatcaccggaacgtctgcggatctgacagtggaaaaggctgccgacataacctgggaggaagaggcagaacaaactggcgtcagccataaccttatgattacagttgacgatgacggcaccatgcgcatcaaagatgacgagactgagaatatcctcacagtgctgttgaagaccgccttactgattgtgtccgggatatttccatactcaatcccggctacgctcctggtctggcacacttggcagaaacagacccagcggagcggagtgctttgggatgttcctagtcccccagaaacacaaaaggccgagctggaagagggtgtatacagaattaaacagcagggcatcttcgggaagacccaggtgggagtcggcgtgcaaaaggagggtgtttttcacacaatgtggcatgtgactaggggggcagtcttgacctataacggaaaacgactagaacccaattgggcttctgtgaagaaagacctgatttcctacggcggcgggtggcgcctcagcgcccagtggcagaagggagaggaagtacaagtcatcgcgatagagcctggtaaaaacccaaagaatttccaggccatgcccggcacgttccagacaactaccggggaaatcggagcaattgctctggattttaagcctggcacatcgggttcaccgatcattaaccgggaggggaaagtggttggactttatggcaatggcgtggtcaccaagaacgggggatacgtgtctggtatcgcccagactaatgctgagccagacggccccacccctgaattagaggaagagatgttcaaaaagagaaacctgacaataatggatctccacccagggagtggaaaaacgaggaagtatttgcccgcaattgttcgtgaagccatcaagcgccggctgagaactctcatcctggcccctaccagggtggtcgctgcggagatggaggaagcacttaaaggcctgccgattcgataccaaacaaccgccactaagtccgagcatacaggtcgggaaatcgtggacttgatgtgccacgctacctttacgatgcgcctactgagccccgtaagagtgccaaattataacctcataattatggatgaggcccatttcactgaccctgcatctatcgccgctagggggtacattagcacacgggttggaatgggcgaagcggccgcaatctttatgaccgctacccccccaggcactgccgatgcattccctcagtccaatgcccccatacaggacgaggagcgagacattccagaaagatcatggaacagtgggaatgagtggatcacagattttgctggaaaaaccgtctggttcgtgccgagcatcaaggccggtaacgacattgcgaactgtttacgcaaaaatggcaagaaggtgatccagctgtctaggaaaacatttgatactgaataccaaaagacgaaacttaacgactgggatttcgtcgtaaccacagacatttccgagatgggggcaaattttaaggccgatcgtgtgatagaccctcggagatgcctgaaacccgttatcctcactgatggaccagagagggtgattttggctggccccatgcctgtcaccgccgcttcagcagcccagcgccgaggtagagtggggcggaacccacagaaggaaaatgaccagtatatcttcacaggccaacccctgaacaatgatgaggaccacgctcactggaccgaagccaagatgctcctggacaacatcaatactcctgagggaattataccggcacttttcgaaccagagagggagaaaagtgcggccatcgatggcgaataccgcctaaagggggagagccgtaaaacgtttgttgaactgatgagacggggagacttgcccgtgtggttagctcataaggtcgcctccgagggtattaaatataccgataggaagtggtgcttcgacggccagcgcaacaatcagatcctggaagagaacatggatgtggagatttggacaaaagaaggggagaagaagaaactccgacctagatggctggacgcacggacttactctgatccccttgctctgaaggaatttaaagacttcgccgcaggaaggaagtcgatcgccctcgatttggtaaccgagataggccgcgtgccaagccacctggctcatagaacaaggaatgcgctagacaacctggttatgctccacacctcagaacacggtgggcgggcctatcgtcatgcagtcgaggagcttcctgaaactatggagacactgttattgctgggcctcatgatcctgcttacgggaggcgctatgctgtttctcatttccgggaaaggaatcggtaagaccagtattggcttgatctgtgtgatagcctctagcgggatgctgtggatggccgaaattcccttacagtggatcgcatccgctattgtgctagagttctttatgatggtcctgctcatcccagagcctgaaaagcaacgcactccgcaggataatcagcttgcctacgttgtgataggaatcctgacattggcggctattatcgccgcaaacgagatgggcctgctcgaaaccaccaaacgagacctgggtatgtcaaaggagcccggggtagtgtctccaacaagctatcttgatgtcgacctccaccctgccagtgcttggactctgtacgcagtggccacgaccgttattacacccatgttgagacatactatcgaaaattccaccgcgaacgtgagcctggctgccatagcaaaccaagccgtcgtattaatgggcctagacaaaggatggccaatttctaagatggatctgggcgtgcctctccttgctctggggtgctactcacaggttaatcccttgacactgaccgccgcagtgctcctgcttatcactcactatgctatcattggaccgggcttacaggccaaagcgacgagggaggcccagaagcggacagcagctggtatcatgaagaacccaaccgtcgacgggataatgactattgatctggaccctgtgatctacgattccaaattcgagaagcaactcggacaggtcatgttgctggtgctatgtgccgttcagctgctccttatgcgcaccagttgggcactgtgcgaagctttgacactggccactggccccattaccacactctgggagggtagcccaggcaaattttggaatacgaccatcgccgtgtcgatggcgaacatattcagagggtcttatctggctggagcaggcttagccttttccatcatgaagagcgtagggactggaaaaaggggcacaggttcacagggggaaacccttggagagaagtggaagaaaaagctgaatcaactcagtcggaaagaattcgacctatacaagaaatctggcattactgaggtggatcgaacagaggctaaggaaggtctgaaaagaggcgagatcacccatcacgccgtctcccgcgggagcgcaaagttgcagtggtttgttgaaaggaacatggtgattcccgagggacgggtcatcgacctgggctgtgggcgtggaggctggtcatattactgcgccggtctcaagaaagtgacggaagtaagagggtataccaagggaggccctggccacgaggagccggtgcccatgagtacatacgggtggaatattgttaaacttatgagcggaaaggatgtgttctacctgccacctgaaaaatgtgacactttgctgtgcgatatcggtgagtcctctcccagccctaccgtcgaagagtccaggacaatacgcgtgctcaagatggtcgagccatggttaaagaacaatcagttctgtattaaagtgctgaacccctatatgcctactgttatcgaacatcttgagcggctgcagcgaaagcacggcgggatgctagtaagaaatccactctcaaggaactctacccatgaaatgtactggatcagtaatggaacaggcaacattgtggcttcggtcaatatggtgagccgcctgttgctgaaccggtttaccatgactcacagacgtcccacgatagagaaagacgttgatctcggtgcggggacaaggcacgtgaacgccgaaccggagacccctaatatggacgtcatcggagagcggattaagcgcatcaaagaagagcataactccacttggcactatgacgatgaaaatccatacaagacctgggcatatcatggctcttacgaggtgaaggctacaggctcagccagctccatgattaacggggtagtgaaacttctgacgaagccctgggacgttgtccctatggtgacccaaatggcaatgactgatacaaccccattcggacagcagcgagtgtttaaagaaaaggtcgacactagaacacccaggagtatgccgggtacccggcgcgttatgggcatcacagccgagtggttatggagaactctggggaggaataaaaagcctcgattgtgcacccgggaggaattcacgaagaaagtgcgtaccaacgctgccatgggagcggtatttacagaggaaaatcaatgggattctgcaaaggccgctgtggaggacgaagatttctggaaactcgtcgacagagagcgcgagctgcacaagctaggcaaatgtggtagctgcgtgtataacatgatggggaagagggaaaaaaagcttggagagtttggcaaggccaaaggctcacgggcaatatggtacatgtggctgggggctagatacctcgaattcgaggccctgggatttttgaatgaggatcattggttctcccgcgaaaacagttatagcggtgttgagggcgaagggctgcacaagctcggatacatccttagggacatttctaaaatccccggcggtgctatgtatgccgatgacactgcagggtgggacacccgaattacagaggatgacctgcacaatgaagagaagatcactcagcagatggatccagagcatcggcagttagcgaacgccatatttaaactgacctaccaaaataaggtggtcaaggtgcagagacctacgcccacaggaaccgtaatggacattatctccaggaaagatcagcgcggctcaggccaggttgggacttatggattgaacacattcaccaatatggaagctcaactcatccgtcagatggagggtgaaggcgtgctgagcaaggccgacctagagaacccacaccttcccgaaaaaaagattactcagtggctggagaccaaaggggtcgagcggctcaagagaatggcaatatcgggagatgactgcgtggtgaagcctatcgatgacaggtttgctaacgccctgttggcattaaatgatatgggcaaagtccgcaaggacattccacagtggcaaccgtctaaaggttggcatgattggcagcaggttcccttctgtagtcaccacttccatgaactgatcatgaaggacgggcgaaaactcgtggtaccttgccggccacaggacgagcttattggaagagccaggatctcccaaggcgcgggctggagcctgcgcgaaacagcttgtctagggaaggcctacgcacagatgtggtcactgatgtattttcacagacgggatctcaggttggcctccaacgctatatgctctgccgtgcccgtccattgggtgcctacgagccgtaccacttggagtatccacgcacatcaccagtggatgacaaccgaggacatgctgactgtttggaatcgagtgtggattgaagataacccatggatggaggacaagacacccgtcaccacgtgggagaatgtgccttaccttggaaaacgcgaagatcaatggtgtggttccctgatcggcctcacaagcagagctacctgggcccagaacattccgactgcgatccagcaggtacggtctttaattgggaatgaggaattcctggactacatgccatcaatgaagaggtttcgcaaagaggaggaaagtgagggagctatatggtga

SEQ ID NO: 15351 - RNA, 9873 nt, synthetic construct
  misc_feature 1..9873: note = derived and/or modified CDS sequence (opt3) from DENV-3__KJ189268__SS-prME
  source 1..9873: mol_type = other RNA
accagcctgtgcctcatgatgatccttcccgcagctctggcattccacttgacctccagagacggagaacctaggatgattgtggggaagaacgaacggggaaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccaaacgtggatgtccgccgaaggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccaaaattcagggggaacaagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgactaagaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgccggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcgtactcgagcaggggaaaagaactctgacaccacagcctatggagttaaagtactcatggaaaacctggggaaaggcgaagatcgtcacagccgaaactcagaacagttccttcataattgatggccccaataccccagagtgccccagcgcttctagggcatggaacgtgtgggaagttgaggactatggttttggggtgttcacgacaaatatctggctgcggcttcgcgaagtctacacccaattgtgtgaccacagactcatgtcagccgctgtgaaagatgagagggccgttcatgcagacatgggatactggattgagagtcagaagaacggcagctggaaactggaaaaggcgtccctaatcgaggtgaaaacttgcacctggcctaagtctcacacactgtggtcgaatggtgtactcgaaagcgatatgataatcccaaagtccctggccggcccgatttcacagcataaccaccgtcccgggtatcacactcagaccgctggaccttggcatcttggcaaattggagctggactttaattactgcgaggggacaacggtcgtgatcaccgaaaactgtggaactcggggcccaagtttacgaacaaccactgtgtctggtaagctcattcacgagtggtgctgtagaagctgcacactgccccctcttaggtatatgggggaagatggatgttggtacggcatggagatccgcccaatatccgaaaaagaggagaatatggtcaagtcactggttagcgccggttctggcaaagtggacaacttcaccatgggggtattgtgcctcgcaattctgtttgaagaggtgatgcggggaaagttcggcaagaaacatatgatcgctggggtcttctttacgttcgtgctactgctctccggacaaatcacttggagagatatggcccacaccctgattatgatcggcagtaatgcaagcgacaggatgggtatgggggttacatatcttgccttgattgctacctttaagatacagcccttcctggcgttaggatttttcctccgcaaactgacttctcgagaaaaccttctgctaggcgtgggcctcgccatggcaacaaccctgcagttgccggaggatatcgaacaaatggctaatgggattgccctgggattaatggccctcaagctgatcacacagtttgagacttaccagctttggaccgctctgatttccttgacgtgttcaaacacaatcttcaccctcactgtcgcatggcggaccgccacactgatactagcgggtgtgagtctgcttcctgtttgccagagctcgtccatgcgtaaaactgactggctcccaatggctgtggccgcaatgggcgtcccacctctgcccttgtttatcttctctctgaaggataccttaaagagaaggagctggccactcaatgagggggtaatggccgtgggactggtttcaattcttgctagttccctgttgcgcaacgacgtgcctatggcaggccccctcgtcgccggtgggctgctaatcgcgtgttatgtgattacgggaacatctgctgatctgaccgtagaaaaagccgcagacatcacttgggaggaagaggccgaacaaacaggcgtgagccataaccttatgataaccgtcgacgatgacggcactatgcggattaaggatgacgagacagagaatatcctcaccgttctgttgaaaacggctttactgatcgtgtccgggatttttccatactcaataccggccactctcctggtgtggcacacctggcagaagcagacacagagaagcggagtcctttgggatgtgcctagtcccccagaaacccaaaaagcagagctggaagagggtgtttacaggatcaagcagcagggcattttcgggaaaacacaggtaggagtgggcgtccaaaaggagggtgtgtttcacactatgtggcatgttacccgaggggctgtgttgacgtataacggaaagcgcctagaacccaattgggcctctgtcaaaaaggacctgatctcctacggcggcgggtggcggctcagcacacagtggcagaaaggagaggaagtgcaagtaattgcggtcgagcctggtaagaaccccaagaatttccagactatgcccggcaccttccagacaaccactggggaaatcggagccatagcactggattttaagcctggcacctcgggttcaccgatcattaacagagaggggaaggtggttggactttatggcaatggcgtggtcaccaagaacgggggatacgtgtctggtatcgctcagacgaatgccgagccagacggccccactcctgaattagaggaagagatgttcaagaaaaggaacctgaccattatggatctccacccagggagtggaaagacacgtaaatatttgcccgctatcgttcgcgaagcaataaagcggagactgaggaccctcattctggcccctactcgagtggtcgccgctgagatggaggaagcgcttaagggcctgccgatccggtaccaaacaaccgcaacgaaatccgagcatactggtcgcgaaatcgtggacttgatgtgccacgccacatttaccatgagactactgagccccgtaagggtgccaaattataacctcattatcatggatgaggctcatttcaccgaccctgcctctatagcagcccgggggtacattagcactcgagttggaatgggcgaagctgcggccatctttatgacagcaacacccccaggcacagctgatgccttccctcagtccaatgcacccattcaggacgaggagagagacatcccagaacgctcatggaacagtgggaatgagtggataactgattttgccggaaagacggtctggttcgtgccgagcattaaagctggtaacgacatcgccaactgtttaaggaagaatggcaaaaaggtgatccagctgtctcgtaagacctttgatacagaataccagaaaactaaacttaacgactgggatttcgtcgtaaccacagacatttccgagatgggggcgaattttaaagcagatcgggtgatcgaccctagaaggtgcctgaagcccgttattctcaccgatggaccagagcgcgtgatattggccggccccatgcctgtcactgctgcctcagctgcacagcgaagaggtcgggtggggaggaacccacagaaagaaaatgaccagtatatcttcacgggccaacccctgaacaatgatgaggaccacgcccactggaccgaagctaagatgctcctggacaacattaatacacctgagggaatcatcccggcccttttcgaaccagagcgcgagaagagtgcagcgattgatggcgaataccgtctaaaaggggagagcagaaagacttttgttgaactgatgcggaggggagacttgcccgtgtggttagcccataaagtcgcttccgagggtataaagtataccgatcgcaaatggtgcttcgacggccagcgaaacaatcagatcctggaagagaacatggatgtggagatttggacaaaggaaggggagaaaaagaagctcagacctcggtggctggacgccaggacctactctgatccccttgcactgaaagaatttaaggacttcgctgccggacgcaaatcgatcgcactcgatttggtaactgagattggcagagtgccaagccacctggcccataggacaaagaatgctctagacaacctggttatgctccacacgtcagaacacggtgggcgggcgtatcgtcatgccgtcgaggagcttcctgaaaccatggagactctgttattgctgggcctcatgatcctgcttacaggaggcgcaatgctgtttctcatatccgggaaaggaatcggtaagaccagtattggcttgatctgtgtgattgcttctagcgggatgctgtggatggccgaaatccccttacagtggatagcctccgcaattgtgctagagttctttatgatggtcctgctcatcccagagcctgaaaagcaacgcaccccgcaggataatcagcttgcttacgttgtgattggaatcctgacattggccgcgactatagctgccaacgagatgggcctgctcgaaacgaccaaacgagacctgggtatgtcaaaggagcccggggtagtgtctccaacaagctatcttgatgtcgacctccaccctgcaagtgcctggactctgtacgctgtggcaaccacagttatcacccccatgttgagacatactattgaaaattccacggccaacgtgagcctggcggctatcgccaaccaagcagtcgtattaatgggcctagacaaaggatggccaatttctaagatggatctgggcgtgcctctccttgccctggggtgctactcacaggttaatcccttgacactgaccgctgccgtgctcctgcttatcactcactatgcaataattggaccgggcttacaggctaaagccaccagggaggcgcagaagcggacagccgcaggtatcatgaagaacccaactgtcgacgggatcatgaccattgatctggaccctgtgatctacgattccaaattcgagaagcaactcggacaggtcatgttgctggtgctatgtgctgttcagctgctccttatgcgcacaagttgggccctgtgcgaagcattgacgctggctaccggccccataactacactctgggagggtagcccaggcaaattttggaataccactattgccgtgtcgatggccaacatcttcagagggtcttatctggcgggagctggcttagcattttccattatgaaaagcgtagggacaggaaaaaggggcaccggttcacagggggaaacgcttggagagaagtggaagaaaaagctgaatcaactcagtcggaaagagttcgacctatacaagaaatctggcatcaccgaggtggatcgaacagaggccaaggaaggtctgaaaagaggcgagataactcatcacgctgtctcccgcgggagcgccaagttgcagtggtttgttgaaaggaacatggtgatccccgagggacgggtcattgacctgggctgtgggcgtggaggctggtcatattactgcgcaggtctcaagaaagtgaccgaagtaagagggtatacaaagggaggccctggccacgaggagccggtgcccatgagtacttacgggtggaatatcgttaaacttatgagcggaaaggatgtgttctacctgccacctgaaaaatgtgacaccttgctgtgcgatattggtgagtcctctcccagccctacagtcgaagagtccaggaccatccgcgtgctcaagatggtcgagccatggttaaagaacaatcagttctgtattaaagtgctgaacccctatatgcctactgttatcgaacatcttgagcggctgcagcgaaagcacggcgggatgctagtaagaaatccactctcaaggaactctacgcatgaaatgtactggataagtaatggaacaggcaacattgtggcctcggtcaatatggtgagccgcctgttgctgaaccggtttaccatgactcacagacgtcccaccatcgagaaagacgttgatctcggtgctgggacaaggcacgtgaacgcggaaccggagacgcctaatatggacgtcatcggagagcggattaagcgcataaaagaagaacataactccacctggcactatgacgatgaaaatccatacaagacttgggcctatcatggctcttacgaggtgaaggcaacaggctcagctagctccatgatcaacggggtagtgaaacttctgaccaagccctgggacgttgtccctatggtgactcaaatggccatgacagataccacaccattcggacagcagcgagtgtttaaagaaaaggtcgacactagaacccccaggagtatgccgggtacgcggcgcgttatgggcattaccgcagagtggttatggagaacactggggaggaataaaaagcctcgattgtgcactcgggaggagttcaccaagaaagtgcgtacaaacgccgctatgggagccgtatttactgaggaaaatcaatgggattctgcgaaggcagccgtggaggacgaagatttctggaaactcgtcgacagagagcgcgagctgcacaagctaggcaaatgtggtagctgcgtgtataacatgatggggaagagggagaagaaacttggagagtttggcaaagctaaaggctcacgggccatctggtacatgtggctgggggcaagatacctcgagttcgaggctctgggatttttgaatgaggatcattggttctcccgcgaaaacagttatagcggtgttgagggcgaagggctgcacaagctcggatacattcttagggacatctctaaaatacccggcggtgccatgtatgctgatgacaccgccgggtgggacacgcgaatcacagaggatgacctgcacaatgaagagaagattacccagcagatggatccagagcatcggcagttagcaaacgcgatctttaaactgacttaccaaaataaggtggtcaaggtgcagagacctacacccaccggaactgtaatggacattatctccaggaaagatcagcgcggctcaggccaggttgggacctatggattgaacacattcacgaatatggaagcccaactcatacgtcagatggagggtgaaggcgtgctgagcaaggctgacctagagaacccacaccttcccgagaaaaagattacccagtggctggagactaaaggggtcgagcggctcaagagaatggccatctcgggagatgactgcgtggtgaagcctatcgatgacaggtttgcaaacgctctgttggccttaaatgatatgggcaaagtccgcaaggacattccacagtggcaaccgtctaaaggttggcatgattggcagcaggttcccttctgtagtcaccacttccatgaactgataatgaaggacgggcgaaaactcgtggtaccttgccggccacaggacgagcttatcggcagagcaaggatttcccaaggcgccggctggagcctgcgcgaaacagcgtgtctagggaaggcttacgcccagatgtggtcactgatgtattttcacagacgggatctcaggttggcatccaacgccatctgctctgctgtgcccgtccattgggtgcctaccagccgtactacatggagtattcacgcccatcaccagtggatgaccacggaggacatgctgacagtttggaatcgagtgtggatcgaagataacccatggatggaggacaagacccccgtcactacctgggaggatgtgccttaccttggaaaacgcgaagaccaatggtgtggttccctgataggcctcacaagcagagcaacttgggctcagaatatcccgaccgccattcagcaggtacggtctttaatcgggaacgaggagttcctggattacatgccatcaatgaagaggtttcgcaaagaggaggaaagtgagggagcgatttggtga

SEQ ID NO: 15352 - RNA, 9873 nt, synthetic construct
  misc_feature 1..9873: note = derived and/or modified CDS sequence (opt3) from DENV-3__KJ189271__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgacaaaaaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgcaggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcgtactcgagcaggggaaaagaactctgacaccacagcctatggagttaaagtactcatggaaaacctggggaaaggcgaagatcgtcacagccgaaactcagaacagttccttcataattgatggccccaataccccagagtgccccagcgcttctagggcatggaacgtgtgggaagttgaggactatggttttggggtgttcacgacaaatatctggctgcggcttcgcgaagtctacacccaattgtgtgaccacagactcatgtcagccgctgtgaaagatgagagggccgttcatgcagacatgggatactggattgagagtcagaagaacggcagctggaaactggaaaaggcgtccctaatcgaggtgaaaacttgcacctggcctaagtctcacacactgtggtcgaatggtgtactcgaaagcgatatgataatcccaaagtccctggccggcccgatttcacagcataaccaccgtcccgggtatcacactcagaccgctggaccttggcatcttggcaaattggagctggactttaattactgcgaggggacaacggtcgtgatcaccgaaaactgtggaactcggggcccaagtttacgaacaaccactgtgtctggtaagctcattcacgagtggtgctgtagaagctgcacactgccccctcttaggtatatgggggaagatggatgttggtacggcatggagatccgcccaatatccgaaaaagaggagaatatggtcaagtcactggttagcgccggttctggcaaagtggacaacttcaccatgggggtattgtgcctcgcaattctgtttgaagaggtgatgcggggaaagctaggcaagaaacatatgatcgctggggtcttcttcacgtttgtgctgctcctgtccggacaaatcacttggagagatatggcccacacccttattatgatcggcagtaatgcaagcgacaggatgggtatgggggttacatatttggccctgattgctaccttcaagatacagccctttttagcgctcggattctttctgcgcaaacttacttctcgagaaaacctgctactcggcgtgggcctggccatggcaacaaccttgcagctgccggaggatatcgaacaaatggctaatgggattgccttaggactcatggccctgaagcttatcacacagttcgagacttaccagctgtggaccgctttgatttccctcacgtgttcaaacacaatctttaccctgactgtcgcatggcggaccgccacactaatactggcgggtgtgagtcttctccctgtttgccagagctcgtccatgcgtaaaactgactggctgccaatggctgtggccgcaatgggcgtcccccctttgcccctgttcatcttttctttaaaggataccctcaagagaaggagctggccactgaatgagggggtaatggccgtgggacttgtttcaattctggctagttccttgctccgcaacgacgtgcctatggcaggccccctggtcgccggtgggctactgatcgcgtgttatgtgattacgggaacatctgctgatcttaccgtagaaaaagccgcagacatcacttgggaggaagaggccgaacaaacaggcgtgagccataacctcatgataaccgtcgacgatgacggcactatgcggattaaggatgacgagacagagaatatcctgaccgttttgttaaaaacggctctgctcatcgtgtccgggattttcccatactcaataccggccactctgcttgtgtggcacacctggcagaagcagacacagagaagcggagtcctgtgggatgtgcctagtcccccagaaacccaaaaagcagagttggaagagggtgtttacaggatcaagcagcagggcatttttgggaaaacacaggtaggagtgggcgtccaaaaggagggtgtgttccacactatgtggcatgttacccgaggggctgtgctaacgtataacggaaagcgcctggaacccaattgggcctctgtcaaaaaggacctcatctcctacggcggcgggtggcggctgagcacacagtggcagaaaggagaggaagtgcaagtaattgcggtcgagcctggtaagaacccaaaaaattttcagactatgcccggcaccttccagacaaccactggggaaatcggagccatagcacttgatttcaagcctggcacctcgggttcaccgatcattaacagagaggggaaggtggttggattatatggcaatggcgtggtcacaaaaaacgggggatacgtgtctggtatcgctcagacgaatgccgagccagacggccccactcctgaactggaggaagagatgtttaagaaaaggaacctcaccattatggatttgcacccagggagtggaaagacacgtaaatatctgcccgctatcgttcgcgaagcaataaagcggagactcaggaccctgattcttgcccctactcgagtggtcgccgctgagatggaggaagcgctgaagggcttgccgatccggtaccaaacaaccgcaacgaaatccgagcatactggtcgcgaaatcgtggacctaatgtgccacgccacattcaccatgagactgctcagccccgtaagggtgccaaattataacttaattatcatggatgaggctcattttaccgaccctgcctctatagcagcccgggggtacattagcactcgagttggaatgggcgaagctgcggccatcttcatgacagcaacccccccaggcacagctgatgcctttcctcagtccaatgcacccattcaggacgaggagagagacatcccagaacgctcatggaacagtgggaatgagtggataactgatttcgccggaaagacggtctggtttgtgccgagcattaaagctggtaacgacatcgccaactgtctgaggaagaatggcaaaaaggtgatccagctttctcgtaagaccttcgatacagaataccaaaaaactaagctgaacgactgggattttgtcgtaaccacagacatttccgagatgggggcgaatttcaaagcagatcgggtgatcgaccctagaaggtgcctcaagcccgttattttgaccgatggaccagagcgcgtgatactggccggccccatgcctgtcactgctgcctcagctgcacagcgaagaggtcgggtggggaggaacccacagaaagaaaatgaccagtatatctttacgggccaacccctcaacaatgatgaggaccacgcccactggaccgaagctaagatgctgcttgacaacattaatacacctgagggaatcatcccggccctattcgaaccagagcgcgagaagagtgcagcgattgatggcgaataccgtctgaaaggggagagcagaaagactttcgttgaattgatgcggaggggagacttacccgtgtggctggcccataaagtcgcttccgagggtataaagtataccgatcgcaaatggtgctttgacggccagcgaaacaatcagatcctcgaagagaacatggatgtggagatttggacaaaggaaggggagaaaaagaagctgagacctcggtggcttgacgccaggacctactctgatcccctggcactcaaagaattcaaggactttgctgccggacgcaaatcgatcgcattggatctggtaactgagattggcagagtgccaagccacctagcccataggacacggaatgctctggacaacctcgttatgcttcacacgtcagaacacggtgggcgtgcgtatcgccatgccgtcgaggagctgcctgaaaccatggagactttattgctgctcggcctgatgatccttctgacaggaggcgcaatgctcttcttgatatccgggaagggaatcggtaaaaccagtattggcctgatctgtgtgattgcttctagcgggatgttatggatggccgaaatccccctacagtggatagcctccgcaattgtgctggagtttttcatgatggtcctccttatcccagagcctgaaaagcaacgaaccccgcaggataatcagctggcttacgttgtgattggaatcttgacactggccgcgataatcgctgccaacgagatgggcctcctggaaactacgaagagagaccttggtatgtcaaaagagcccggggtagtgtctccaaccagctatctcgatgtcgacctgcaccctgcaagtgcctggacattgtacgctgtggcaactaccgttattacacccatgctgaggcataccatcgaaaattccactgccaacgtgagcttagcggctattgccaaccaagcagtcgtactaatgggcctggacaagggatggccaatctctaaaatggatctcggcgtgcctcttctggccttggggtgctactcacaggttaatcccctgacgctcacagctgccgtgctgcttttaataacccactatgcaattatcggaccgggcctgcaggctaaggccactcgggaggcgcagaaacgcaccgccgcaggtatcatgaagaacccaacagtcgacgggattatgactatcgatctcgaccctgtgatatacgattccaagtttgagaaacaattgggacaggtcatgctgctagtgctgtgtgctgttcagctccttctgatgagaaccagttgggccttgtgcgaagcactgacactcgctacgggccccattaccactctgtgggagggtagcccaggcaagttctggaatacaaccatcgccgtgtcgatggccaacatttttagggggtcttatttagcgggagctggccttgcattctccatcatgaaaagcgtagggactggaaagcggggcacaggttcacagggggaaaccctgggagagaaatggaagaagaaactcaatcaactaagtcgaaaggaatttgacctgtacaaaaagtctggcataacggaggtggatagaaccgaggccaaagaaggtttgaagcgcggcgagatcacacatcacgctgtctccagggggagcgccaaactgcagtggttcgttgaacggaacatggtgattcccgagggacgtgtcatcgacctcggctgtgggagaggaggctggtcatattactgcgcaggtcttaagaaggtgactgaagtaagggggtataccaaaggaggccctggccacgaggagccggtgcccatgagtacatacgggtggaatattgttaagctgatgagcggaaaagatgtgttttacttgccacctgaaaagtgtgacactctgctctgcgatatcggtgagtcctctcccagccctaccgtcgaagagtcccgcacaattcgggtgttaaaaatggtcgagccatggctgaagaacaatcagttctgtatcaaggtgcttaacccctatatgcctaccgttatagaacatctggagcgactacagagaaaacacggcgggatgctcgtaaggaatccactgtcacgcaactctactcatgaaatgtactggattagtaatggaacgggcaacatcgtggcctcggtcaatatggtgagccggttgctgctcaacagattcacaatgacccaccgtaggcccactatcgagaaggacgttgatcttggtgctgggacccggcacgtgaacgcggaaccggagacacctaatatggacgtcattggagagcgcataaaacgaatcaaggaagagcataactccacgtggcactatgacgatgaaaatccatacaaaacctgggcctatcatggctcttacgaggtgaaggcaactggctcagctagctccatgattaacggggtagtgaagctgttaacaaaaccctgggacgttgtccctatggtgacccaaatggccatgactgatacaaccccatttggacagcagagagtgttcaaggaaaaagtcgacacaaggactccccggagtatgccgggtacccgcagagttatgggcatcacggcagagtggctgtggaggaccttggggcgaaataagaaacctcggctctgcacacgtgaggaatttactaagaaggtgagaaccaacgccgctatgggagccgtattcacagaggaaaatcaatgggattctgcgaaagcagccgtggaggacgaagatttttggaagctggtcgaccgcgagagggagctacacaaacttggcaagtgtggtagctgcgtgtataacatgatggggaaacgggaaaagaaactgggagagttcggcaaggctaagggctcaagagccatttggtacatgtggctcggggcacgctacctggaatttgaggctttgggattcctgaatgaggatcattggttttccagggaaaacagttatagcggtgttgagggcgaagggctccacaaacttggatacatcctgcgagacatatctaagatccccggcggtgccatgtatgctgatgacactgccgggtgggacacccggattacggaggatgacttacacaatgaagagaaaatcacacagcagatggatccagagcatagacagctggcaaacgcgattttcaagttgacctaccaaaataaagtggtcaaggtgcagaggcctactcccacaggaaccgtaatggacatcatatcccgcaaggatcagcgtggctcaggccaggttgggacttatggactcaacacctttacaaatatggaagcccaactgattcggcagatggagggtgaaggcgtgctaagcaaagctgaccttgagaacccacacctgcccgaaaagaaaatcacgcagtggctcgagaccaagggggtcgagagactgaaaaggatggccatctcgggagatgactgcgtggtgaagcctattgatgaccgcttcgcaaacgctttgttagccctgaatgatatgggcaaggtccgaaaagacataccacagtggcaaccgtctaagggttggcatgattggcagcaggttcccttttgtagtcaccacttccatgaactcatcatgaaagacgggcggaagcttgtggtaccttgcagaccacaggacgagctgattggaagggcacgcatctcccaaggcgccggctggagcctaagagaaactgcgtgtctggggaaagcttacgcccagatgtggtcactcatgtatttccaccggagggatttgcgtctggcatccaacgccatttgctctgctgtgcccgtccattgggtgcctacaagccgaaccacttggagtatccacgcccatcaccagtggatgacaaccgaggacatgcttacggtttggaatcgcgtgtggatagaagataacccatggatggaggacaagacacccgtcaccacttgggaggatgtgccttacctgggaaagagagaagaccaatggtgtggttccctcatcggcttaaccagccgggcaacatgggctcagaatattccgactgccatccagcaggtaaggtctctgattgggaacgaggaatttttggattacatgccatcaatgaaacgcttcagaaaggaggaggaaagtgagggagcgatctggtga

SEQ ID NO: 15353 - RNA, 9873 nt, synthetic construct
  misc_feature 1..9873: note = derived and/or modified CDS sequence (opt3) from DENV-3__KJ189272__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccatatattactgaagttgagccggaagacatcgattgctggtgtaacctgaccagtacatgggtgacctacgggacttgcaatcaggctggagagcatcgccgagacaagcgtagcgtagcccttgcaccccacgtgggcatgggtctggatacaagaacccaaacgtggatgtccgccgagggggcttggaggcaggtcgaaaaagtggagacttgggcattgcggcatcctggattcaccattctcgccctgtttctggctcactatatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcatggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattacgtttgtaaacacacttatgtggatcgcggttgggggaacggatgcggcctcttcggcaaggggagtctggtaacctgcgccaagtttcaatgtttagagcccatagagggaaaagtggtccagtacgaaaatctgaagtatacagtgattatcactgttcacaccggtgaccagcatcaggtgggcaacgagacacaaggggtcaccgcagaaattactcctcaggcttccacgacagaggccaccctcccagaatacggaactcttggcctggagtgctctccgcgaaccggtttggacttcaatgagatgatcctactgacaatgaaaaacaaggcgtggatggtgcacagacagtggtttttcgatctccccctgccttggaccagcggggccactacagaaacgccaacctggaataggaaagagcttctggtaacttttaagaacgcacatgctaaaaagcaagaagttgtggtcttgggctcccaggagggagccatgcacacagctctcaccggcgccacagaaatccagaattcagggggaactagtattttcgcaggtcacctgaagtgtcggttaaaaatggacaagctggagctaaaaggcatgagctacgccatgtgcaccaacacgtttgtgctcaagaaagaggtctctgaaacccagcatgggacaatactgatcaaggtggagtataagggagaagatgctccctgtaaaattcctttctccactgaggacggccacggtaaggcgcataacgggcgtcttatcaccgcaaatccagttgtgacaaaaaaggaggaacccgtatcaatagaggccgaaccgcctttcggcgagagcaacattgtcatcggaatcggcgataatgctttgaaaattaactggtacaagaaggggagttctatcggaaaaatgtttgaagccactgcacgcggtgccagaaggatggctattctgggcgacaccgcctgggatttcgggtccgtgggaggcgttctcaatagcctgggtaagatggtgcaccaaatatttgggtcggcatatacggcgcttttctctggcgtctcctgggtgatgaaaatcggaattggcgtactgttgacatggatcgggctcaactcaaagaataccagtatgagcttttcctgcatcgctattggaataatcactctgtacttaggcgccgtggttcaggcagacatgggttgtgtcattaactggaaagggaaggagctgaagtgcggatctggcatcttcgtgacaaatgaggtgcatacctggactgaacagtataaatttcaggccgatagccccaagcggctagctaccgccattgcaggtgcttgggagaacggcgtctgtgggatccgatcaacaacgcgcatggaaaatctcctgtggaaacaaatagccaacgagcttaattacatcttgtgggaaaacaatattaagctgaccgttgtggtgggagacatcattggcgtactcgagcaggggaaaagaactctgacaccacagcctatggagttaaagtatagttggaaaacctggggaaaggcgaagatcgtcacagccgaaactcagaactccagcttcataattgatggccccaacaccccagagtgcccctctgcttcaagggcatggaatgtgtgggaagttgaggactacggttttggggtgttcacgacaaacatctggctgcggcttcgcgaagtctacacccaattgtgtgaccacagactcatgagtgccgctgtgaaagatgagagggccgttcacgcagacatgggatattggattgagagccagaagaatggctcctggaaactggaaaaggcgtctctaatcgaggtgaaaacttgcacctggcctaagtcgcatacactgtggagcaacggtgtactcgaatccgatatgataatcccaaagtcactggccggcccgattagtcagcacaatcatcgtcccgggtaccacactcagaccgctggaccttggcaccttggcaaattggagctggactttaactattgcgaggggacaacggtcgtgatcaccgaaaattgtggaactcggggcccatctttacgaacaaccactgtgagcggtaagctcattcatgagtggtgctgtagatcctgcacactgccccctcttaggtacatgggggaagatggatgttggtatggcatggagatccgcccaatatcagaaaaagaggagaacatggtcaagagcctggtttctgccggttccggcaaagtggacaatttcaccatgggggtattgtgcctcgcaattctgtttgaagaggtgatgcggggaaagttcggcaagaaacacatgatcgctggggtcttctttacgttcgtgctactgctcagtggacaaatcacttggagagatatggcccataccctgattatgatcggcagcaacgcatctgacaggatgggtatgggggttacataccttgccttgattgctacctttaagatacagcccttcctggcgttaggatttttcctccgcaaactgacttcccgagaaaatcttctgctaggcgtgggcctcgccatggcaacaaccctgcagttgccggaggatatcgaacaaatggctaacgggattgccctgggattaatggccctcaagctgatcacacagtttgagacttatcagctttggaccgctctgatttcattgacgtgtagtaatacaatcttcaccctcactgtcgcatggcggaccgccacactgatactagcgggtgtgagcctgcttcctgtttgccagtcgtcctctatgcgtaaaactgactggctcccaatggctgtggccgcaatgggcgtcccccctctgcccttgtttatcttcagcctgaaggataccttaaagagaaggtcatggccactcaacgagggggtaatggccgtgggactggttagtattcttgcttcctctctgttgcgcaatgacgtgcctatggcaggccccctcgtcgccggtgggctgctaatcgcgtgttacgtgattacgggaacaagcgctgatctgaccgtagaaaaagccgcagacatcacttgggaggaagaggccgaacaaacaggcgtgtcccacaaccttatgataaccgtcgacgatgacggcactatgcggattaaggatgacgagacagagaacatcctcaccgttctgttgaaaacggctttactgatcgtgtcagggatttttccatacagcataccggccactctcctggtgtggcatacctggcagaagcagacacagagaagtggagtcctttgggatgtgccttctcccccagaaacccaaaaagcagagctggaagagggtgtttataggatcaagcagcagggcattttcgggaaaacacaggtaggagtgggcgtccaaaaggagggtgtgtttcacactatgtggcacgttacccgaggggctgtgttgacgtacaatggaaagcgcctagaacccaactgggcctccgtcaaaaaggacctgatcagctatggcggcgggtggcggctctcgacacagtggcagaaaggagaggaagtgcaagtaattgcggtcgagcctggtaagaatccaaaaaacttccagactatgcccggcaccttccagacaaccactggggaaatcggagccatagcactggattttaagcctggcacctcaggttctccgatcattaatagagaggggaaggtggttggactttacggcaacggcgtggtcacaaaaaatgggggatatgtgagtggtatcgctcagacgaacgccgagccagacggccccactcctgaattagaggaagagatgttcaagaaaaggaatctgaccattatggatctccatccagggtccggaaagacacgtaaatacttgcccgctatcgttcgcgaagcaataaagcggagactgaggaccctcattctggcccctactcgagtggtcgccgctgagatggaggaagcgcttaagggcctgccgatccggtatcaaacaaccgcaacgaaaagcgagcacactggtcgcgaaatcgtggacttgatgtgccatgccacatttaccatgagactactgtctcccgtaagggtgccaaactacaatctcattatcatggatgaggctcacttcaccgaccctgccagcatagcagcccgggggtacatttccactcgagttggaatgggcgaagctgcggccatctttatgacagcaacccccccaggcacagctgatgccttccctcagtcaaacgcacccattcaggacgaggagagagacatcccagaacgcagttggaatagcgggaacgagtggataactgattttgccggaaagacggtctggttcgtgccgtctattaaagctggtaatgacatcgccaactgtttaaggaagaacggcaaaaaggtgatccagctgtcccgtaagacctttgatacagaatatcaaaaaactaagcttaatgactgggatttcgtcgtaaccacagacatttcagagatgggggcgaactttaaagcagatcgggtgatcgaccctagaaggtgcctgaagcccgttattctcaccgatggaccagagcgcgtgatattggccggccccatgcctgtcactgctgccagtgctgcacagcgaagaggtcgggtggggaggaatccacagaaagaaaacgaccagtacatcttcacgggccaacccctgaataacgatgaggaccatgcccactggaccgaagctaagatgctcctggacaatattaacacacctgagggaatcatcccggcccttttcgaaccagagcgcgagaagagcgcagcgattgatggcgaatatcgtctaaaaggggagtccagaaagacttttgttgaactgatgcggaggggagacttgcccgtgtggttagcccacaaagtcgcttctgagggtataaagtacaccgatcgcaaatggtgcttcgacggccagcgaaataaccagatcctggaagagaatatggatgtggagatttggacaaaggaaggggagaaaaagaagctcagacctcggtggctggacgccaggacctattcggatccccttgcactgaaagaatttaaggacttcgctgccggacgcaaaagcatcgcactcgatttggtaactgagattggcagagtgccatcacatctggcccacaggacacggaacgctctagacaatctggttatgctccatacgtccgaacacggtgggcgtgcgtaccgccacgccgtcgaggagcttcctgaaaccatggagactctgttattgctgggcctcatgatcctgcttacaggaggcgcaatgctgtttctcataagtgggaagggaatcggtaaaacctctattggcttgatctgtgtgattgctagctccgggatgctgtggatggccgaaatccccttacagtggatagcctcagcaattgtgctagagttctttatgatggtcctgctcatcccagagcctgaaaagcaacgaaccccgcaggataaccagcttgcttatgttgtgattggaatcctgacattggccgcgataatcgctgccaatgagatgggcctgctcgaaactacgaagagagacctgggtatgtctaaagagcccggggtagtgagcccaaccagttaccttgatgtcgacctccatcctgcatccgcctggacactgtacgctgtggcaactaccgttattacacccatgttgaggcacaccatcgaaaacagcactgccaatgtgtctctggcggctattgccaaccaagcagtcgtattaatgggcctagacaagggatggccaatctcaaaaatggatctgggcgtgcctctccttgccctggggtgctattcccaggttaaccccttgacgctgacagctgccgtgctcctgcttataacccattacgcaattatcggaccgggcttacaggctaaggccactcgggaggcgcagaaacgcaccgccgcaggtatcatgaagaatccaacagtcgacgggattatgactatcgatctggaccctgtgatatatgatagtaagttcgagaaacaactcggacaggtcatgttgctggtgctatgtgctgttcagctgctccttatgagaaccagctgggccctgtgcgaagcattgacactggctacgggccccattaccactctctgggagggttcgccaggcaagttttggaacacaaccatcgccgtgtctatggccaatattttcagggggtcctacctggcgggagctggcttagcatttagcatcatgaaatcagtagggactggaaagcggggcacaggtagtcagggggaaacccttggagagaaatggaagaagaaactgaaccaactctctcgaaaggaattcgacctatataaaaagtccggcataacggaggtggatagaaccgaggccaaagaaggtctgaagcgcggcgagatcacacaccatgctgtcagcagggggtcagccaaattgcagtggtttgttgaacggaatatggtgattcccgagggacgtgtcatcgacctgggctgtgggagaggaggctggagttactattgcgcaggtctcaagaaggtgactgaagtaagggggtacaccaaaggaggccctggccacgaggagccggtgcccatgagcacatacgggtggaacattgttaagcttatgtccggaaaagatgtgttctatctgccacctgaaaagtgtgacactttgctgtgcgatatcggtgagtctagcccctcccctaccgtcgaagagtcacgcacaattcgggtgctcaaaatggtcgagccatggttaaagaataaccagttctgtatcaaggtgctgaatccctacatgcctaccgttatagaacaccttgagcgactgcagagaaaacatggcgggatgctagtaaggaacccactctctcgcaatagtactcacgaaatgtattggatttcgaacggaacgggcaatatcgtggccagcgtcaacatggtgtcccggctgttgctgaatagatttacaatgacccatcgtaggcccactatcgagaaggacgttgatctcggtgctgggacccggcacgtgaacgcggaaccggagacacctaacatggacgtcattggagagcgcataaaacgaatcaaggaagagcacaattctacgtggcattacgacgatgaaaacccatataaaacctgggcctaccacggctcatatgaggtgaaggcaactggcagcgcttccagtatgattaatggggtagtgaagcttctgacaaaaccctgggacgttgtccctatggtgacccaaatggccatgactgatacaaccccattcggacagcagagagtgtttaaggaaaaagtcgacacaaggactccccggtctatgccgggtacccgcagagttatgggcatcacggcagagtggttatggaggaccctggggcgaaacaagaaacctcggttgtgcacacgtgaggaattcactaagaaggtgagaaccaatgccgctatgggagccgtatttacagaggaaaaccaatgggatagcgcgaaagcagccgtggaggacgaagatttctggaagctcgtcgaccgcgagagggagctgcataaactaggcaagtgtggttcatgcgtgtacaatatgatggggaaacgggaaaagaaacttggagagtttggcaaggctaagggctccagagccatttggtacatgtggctgggggcacgctatctcgaattcgaggctctgggatttttgaacgaggatcactggttcagtagggaaaatagctactctggtgttgagggcgaagggctgcataaactcggatatatccttcgagacatatccaagatccccggcggtgccatgtacgctgatgacactgccgggtgggacacccggattacggaggatgacctgcacaacgaagagaaaatcacacagcagatggatccagagcacagacagttagcaaatgcgatttttaagctgacctatcaaaacaaagtggtcaaggtgcagaggcctactcccacaggaaccgtaatggacatcatatcacgcaaggatcagcgtggcagcggccaggttgggacttacggattgaataccttcacaaacatggaagcccaactcattcggcagatggagggtgaaggcgtgctgtcgaaagctgacctagagaatccacatcttcccgaaaagaaaatcacgcagtggctggagaccaagggggtcgagagactcaaaaggatggccatctctggagatgactgcgtggtgaagcctattgatgaccgctttgcaaacgctctgttggccttaaacgatatgggcaaggtccgaaaagacataccacagtggcaaccgagtaagggttggcacgattggcagcaggttcccttctgttcccatcacttccacgaactgatcatgaaagacgggcggaagctcgtggtaccttgcagaccacaggacgagcttattggaagggcacgcatcagccaaggcgccggctggtcactgagagaaactgcgtgtctagggaaagcttatgcccagatgtggtccctgatgtactttcatcggagggatctccgtttggcatctaatgccatttgcagcgctgtgcccgtccactgggtgcctacaagtcgaaccacttggtccatccatgcccaccatcagtggatgacaaccgaggacatgctgacggtttggaaccgcgtgtggatagaagataatccatggatggaggacaagacacccgtcaccacttgggaggatgtgccttaccttggaaagagagaagaccaatggtgtggtagcctgatcggcctcacctctcgggcaacatgggctcagaacattccgactgccatccagcaggtaaggtcattaattgggaatgaggaattcctggattatatgccaagtatgaaacgctttagaaaggaggaggaatccgagggagcgatctggtga
